United States Patent 11,098,302 (IDENTIFICATION OF POLYNUCLEOTIDES ASSOCIATED WITH A SAMPLE) - sequence listing, part 121

SEQ ID NO: 419210 - DNA, 586 bp, Homo sapiens
  misc_feature: GZ8MTXP02I1RYI.21.78.H01.1.454.CMB.2.raw
  modified_base (367)..(367): a, c, t, g, unknown or other
  modified_base (407)..(407): a, c, t, g, unknown or other
  modified_base (460)..(460): a, c, t, g, unknown or other
  modified_base (489)..(489): a, c, t, g, unknown or other
  modified_base (495)..(495): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtctaggtggcgactacatgagcgtggggtccgccaggcctccgaggggaacggccgtggaggtggatctcactttatttactagtggtgtaccccanatactacacagactcgtgaacggggccattccacatctanagaacgacaattcccaagaacacattcgtatctacaaatgaaactaacctganaggaccgagacgacggcaatgtattacgngttagnggggtactatttaccgttcgacccggtacggggacccgggtaaccgtcggtccgaccgtcccgaccccacccgtaccgaacccgtaaccgg

SEQ ID NO: 419211 - DNA, 636 bp, Homo sapiens
  misc_feature: GZ8MTXP02G62VM.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatggagcgtcgggtcccgccgaggcctccgaggggaaggcctggagtggatctcacttattatggtggtgtacccacatactacacagactccgtagaacgggccattcaccgatcctacgagaaacgactaacttaccaggaaacactaattagtattcttactaaaatcgtaaataccgtagagtacgacggaacgacgacggacctaagtgttaaacttacgtggtaggtcggggtacttacgtttaacgttccggtaccccgtcggggggtaccccgggtaacccgtcgggtcccgtaaccccggtccctaccccccgaaccccgttcccgaacccggtaaccccggg

SEQ ID NO: 419212 - DNA, 699 bp, Homo sapiens
  misc_feature: GZ8MTXP02JZX1R.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcgtgggttttcctgttgctatttacaaaaggtgtccagtgtgaggtgcagttggtggagactggaggaggcttgatccagccgtgggggtccctgagactctcctgtgcagtctctgggttcgtcagtggcgactacatgagtcgtgggtccgccaggcctccgaggggaacgggcctgggagtgggatctctacgtttattagtagtggtcggtacccacatactacacagtacctccggtaggaacgggtacccgattccacctacgtcctaccgaaaggtaaacgaaccctaaacgtttacccgaaacggaaacctaacctatttaggtaactttacgttaaaccaaaacgtagtaaacttaaccgtagaacggacggaccccggaaggaacccgacgggacccattcggttaattacgtagtgggtacggggtcctaagttttaccgtacgtacccccggtacggggggtaccccgggtaaccccttgggtaccccgtacccggttccctacccccccaccccgtttacccgaacccgtaacccgggg

SEQ ID NO: 419213 - DNA, 643 bp, Homo sapiens
  misc_feature: GZ8MTXP02JLEJ7.21.78.H01.1.454.CMB.2.raw
  modified_base (447)..(447): a, c, t, g, unknown or other
  modified_base (605)..(605): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccaggccgtggggggtccctgagactctcctgtgcagtctcgtgggttcgtcagtggcgactacatgagcgtcgggtccgccgaggctccgagggaaggccgtaggagtggatctctacttattagtagtggtgtacccactatactacacagactcgagaacggctatcacatctacagaaacacatacaagaacactagttagtaactacgtaactaaaagtnaaaacgtaacctagaagtacggaccgaacggacaaccgggtacctattaggttaaactcgtaggttcgggtggggtacttaacgtttaccggttacgacccccggggttacgggggacccccggttaaacccgtgggtaacccctacccggttacccnccccccgtaaccccgtaccccgaaccgtaaccccgggg

SEQ ID NO: 419214 - DNA, 559 bp, Homo sapiens
  misc_feature: GZ8MTXP02FGJE1.21.78.H01.1.454.CMB.2.raw
  modified_base (340)..(340): a, c, t, g, unknown or other
  modified_base (356)..(356): a, c, t, g, unknown or other
  modified_base (397)..(397): a, c, t, g, unknown or other
  modified_base (444)..(444): a, c, t, g, unknown or other
  modified_base (518)..(518): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaaggcctggagtggatctcactttatttanagtggtggtaccccanatactacacagactccgtgaaaggccgattcaccatctcanaagacaaattccaagacacattgtatcttacaaatgaataacctganagcgaggacacggccatgtaattacgtagtgtaggggcatttaactcgtaccccgtcgggggccgggaacccgnggtcacccgtccgtcccccaccgtacccacccgaaaccggg

SEQ ID NO: 419215 - DNA, 656 bp, Homo sapiens
  misc_feature: GZ8MTXP02JQWEV.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtcggcgactacatgagcgtcgggtccgccgaggcctccgaggggaacgggccgtggagtggactctctactttatttagtaggttcggtcggtacccctacgtatacctaacacaacgtacctcccggtaggaacggggtccctatccgaccatcctacaagaaacgactaacttaccgaaggaaacactagtttacgtaacttcttaacaaaagtgaaaactacgtagacgaggccgaacggacacggaccagtcgttagttacgtggtacggtgggtcttacgtttacgtccggtaccccggtcgggggtaccccgggtaacccgtcggtcccaacccggttccctaccccccgacccgtacccgaacccgaacccggg

SEQ ID NO: 419216 - DNA, 673 bp, Homo sapiens
  misc_feature: GZ8MTXP02ID9J4.21.78.H01.1.454.CMB.2.raw
  modified_base (452)..(452): a, c, t, g, unknown or other
  modified_base (493)..(493): a, c, t, g, unknown or other
  modified_base (535)..(535): a, c, t, g, unknown or other
  modified_base (539)..(539): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggtagttttggctgagcttgggttttccttgttgctatttcaaaaggtgtccagtgtgaggtgcaggttggtggagacgtggagggaggtcttgatccgaggccggtgggggtccctgacgctctcctgtgcagtctcgtgggttcgtcaggtggcgactacatgagcgtggtccgcaggcctccggaaggggacggccgtagggagtgggctactctaactttagtttacgtaggtcgggttacggtaaccccacgtaactaacctacacgacgaccttcgggaggacggggtccgtacttaccacatacctacgaaanacgtaaactattaccgacgaaactactattgtactccttanaaaactgtaaactaccgtagacgacgacgacgaacacgtacngttntaacttagtgtagggcggggtacttacgtttaacgtcccggtacccggggtccgggggtaccccggggtaacccttggggtaccccaacccgttcccggtacccccaaccgttaccccaacggtaaaccccggg

SEQ ID NO: 419217 - DNA, 652 bp, Homo sapiens
  misc_feature: GZ8MTXP02FVETH.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtcgggtccgccaggctccgaggggaaggccgtggagtggatctcactttatttatagtggtggtaccccacatactacacgacgactccggtagaaagggccgtaattcaacctatactacaagaaaagacaaacttaccgaaggaaaccactaattagtaattacttacaaaattagaaactaacccgtagaacgacgacccggaaggaccgaacggccaagtacgttaattacgtaggtcggttaggggactacgtttacgtacggtacccccggtcgggggtacccggggtaaaccccgtcgggtacccgtaccccgtcccgtacccccaccccgtacccgaacccgtaaacccgggg

SEQ ID NO: 419218 - DNA, 658 bp, Homo sapiens
  misc_feature: GZ8MTXP02GDZX9.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtcgggtccgccgaggcctccggaggggaacgggccgtggagtggatctctactttatttataggtggtacggtaccccacatactaacacgaagactccggtaggaaacggggccgtattcccgaacctatcctacaaggaaacgaactaaattacccgaaaggaaaccactaattagtactacttaacaaatagtaaaactaaccgtagaagacgaccgaaggacgacggacctaagtacgttaattcgtggtggtaggggtacttacgtttaacgtcggtaccccggtacgggggaccccgggtaaacccgtcggtcccgtaacccgttccctacccccgacccgtacccgaaccggaaacccggg

SEQ ID NO: 419219 - DNA, 771 bp, Homo sapiens
  misc_feature: GZ8MTXP02IVVYZ.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtccctgagctctcctgtgcagtctcgtgggttcgtctaggtggcgactacagtcgagtcgtcgggtccgccgaggcctccggaaggggaacggggtcccgtaggggacggtacggacttcccgttaccttaacgttttagtttaacgtaggttacggggttacggtaccccctaactaacgttacctaaactaccgaacgtaccgtccgggtaggaaacgggggtccctaatttacccaaccgtactaccgtacgaagaaacgactaaacgttacccgaaagggaaacctacgtaatttacgttaactacctttaactaaaagtaacgttaaacgttaaacccgttagaacggtacggaacccggacggaaccacgggcctaagttcggttaaacttcggtaggttagggtcggggtacttaacgtttaccgtacggtacccccgggttacgggggcccccgggtaaaacccttcggggtaacccctaccggtaccccctacccccgaaccccgttaccgaaccggtaaaccccggg

SEQ ID NO: 419220 - DNA, 707 bp, Homo sapiens
  misc_feature: GZ8MTXP02GX5AJ.21.78.H01.1.454.CMB.2.raw
  modified_base (418)..(418): a, c, t, g, unknown or other
  modified_base (423)..(423): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgctagtctcgtgggttcgtcaggtggcgactacatgagcgtcgggcccgccgagggcctaccggaggggaacggggcccgtagggaggtggatcctctactttatttaagtggtggtcggtaccccatactactacacagactcgtagaagggcctatccacatcanagaanacaactccgaagaacacctattagtactacttaacaaaatacgtaaataaacccgtaggaacgaacggacccggaaggaaccaccgggtaccaacgtttagttaacgttaaccgtgggttagggtacgggggttaccttaaacgtttttacccggtaccgggtaccccccggggtacgggggggaccccccgggttaaaacccggttcggtacccccgtaacccccgttcccgttaccccccccgaacccccgtacccgaaaacccccgggtaaacccccgggg

SEQ ID NO: 419221 - DNA, 585 bp, Homo sapiens
  misc_feature: GZ8MTXP02F7FRZ.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacatgagctgggtccgccaggctccgaggggaaggcctggagtggatctcactttatttagtagtggtacggtacccacatactacacagactccgtgaacgggccgattccaccatctcagaagacaattaccagaacactattagtatactacaaatagaaataactagagagacgagacacggcatgtatacgtggtggtggggctagtttacgttacgacccggtacgggggacccggggaacccgtcggtaccgtacccgttaccctcccccgtaccctacccgaccgtaacccggg

SEQ ID NO: 419222 - DNA, 641 bp, Homo sapiens
  misc_feature: GZ8MTXP02FUFE5.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctgtgggttcgtcagtggcgactacagtgagcgtgggtcccgccgaggcctccggagggaacgggcctggagtggatctactactttatttataggtggttacgtaccccactatactacacacgactccggagaacggggcctattccacatctacagaaagacaattcccaaggtaacacgtaattgtattactacaaaatagaaataaccgtgagacgacgaacggacacggcatagttactacgtgttggtcggggtactacgttttaccgtacggtaacccccgggttcgggggacccccggggtaacccgtcgggttaccccgtacccggttacccctaccccccgtaacccgtaccccgaacccggtaaccccggg

SEQ ID NO: 419223 - DNA, 847 bp, Homo sapiens
  misc_feature: GZ8MTXP02IMAQN.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaggtgtccagtgtgaggtgctagttggtggagacgtgggaggaggcttagactccagccggtcgggggtcctgacgactctcctgtgctgtctcgtggttcgtcgaggtggcgtactacatgagtcgtcgggtccgcgaggcctccggaaggggacggccgtggagtggactctactactttattagtaggtaggtcggtaaccccacgtactactacacgtacgtacctccggtggaaacgggacctattaccgaccattaccgtacaaacgtaaacgaactaaacttacccgaaacggtaaacctaaacgttacgtttaacgtaacctttacttaaacgtaaaaacgtaacgttaaaaccgttaaaaccccgtttagggaacgggtaaaccgggaacccgggtaaacgggggtaaaccccgaaacccggggaacccttaaaggtttacggttaacgttttaaaccgggttcggggtttacggggttacggggggttacctttaaacggtttttaacccgggttaccggggttaacccccccgggggtttacggggggtaacccccgggggttaaacccggtttcccggggttaccccgtaacccccggggttaccccctacccccccgttaacccccgtacccccggttaaaccccggtaaacccccgggg

SEQ ID NO: 419224 - DNA, 646 bp, Homo sapiens
  misc_feature: GZ8MTXP02IV8P7.21.78.H01.1.454.CMB.2.raw
  modified_base (419)..(419): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtcccgcccgaggcctccggaaggggaacgggtcccgtaggaggttggacttccgtactactttagtttagtaggtggtacgtacccacatactacacacgactccggtagacgggcctattcacntctacagaacgacaatccaagaacactattgtattactacaaagtataaataacctagacgacggaccgaacgaccgaacggcctaatggttattacgtggtggtacggggtacttacgtttaccgttacggtaccccgggttacgggggaccccggggtaacccgtcgggtccctacccggttccctaccccccgtaaccccgtaccccgaacccgtaaccccggg

SEQ ID NO: 419225 - DNA, 589 bp, Homo sapiens
  misc_feature: GZ8MTXP02H0EAZ.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggtcttgatcagccgtgggggtcctgagactctcctgtgcagtctcgtgggttcgtcagtggcgactacagtgagcgtcgggtccgccgaggctccggagggaacgggcctaggagtggactctcgtaacttattagtaggtggtacggtacccacactacaacacagtactccggtaggaaggccattccacatcacagaagacaaacttaccgaagtaacactattagtacttactaactaaatagtaaactaacgtagagacgacgagacgacggacatagtatacgtgtaggtgggtcttattacgtcgacccggtcgggggacccggaccgtcgtcccgaccgtcctaccccaccctccaaccggaccg

SEQ ID NO: 419226 - DNA, 803 bp, Homo sapiens
  misc_feature: GZ8MTXP02ILSL4.21.78.H01.1.454.CMB.2.raw
tcagtcgtcgctcgcacgaccggtgctcgatttagtgtgagtagtttgggtttggggggagaggagccagcactgggattccgaggtgtttccattcggtgatcagcactgaacacagaggactcaccatggagttttggctgagctgggttttccttgttgcttattcaaaaggtgtccagtgtgaggtgctaggttggtggagacgtgggaggaggcttgacttccgacggccggttcggggggtccctaggacgtacctctcgtgtgactagtcttcgttgggttctcgtagtcggcgactacagtcgagccggtcgggtcccgaccggaggtccgtacgggaacggggacggggtcccgtggggtaggttaggacttaccgttacgttaacgttttaacgtttaggtacggttacggggttaccggtaaccccaacgtaccttaaacgttaaccaacgtacgtaccgtccggggtaaggaacgggtaccgtacttaccactactacgtatacgaaactaactaacttaccgaaacgaactacgttagttagttaacttactacttaaaatacgtaaaacttaacgtaggaacggacggaacccgaacgggaactaccggggtactaacgttagttaaacgtttcggtaacgggttacgggttacgggggttacttaacggtttaccggtaccggggtacccggggtaccggggggtaaccccggttaccggtaacggttaccccgtacccgttacccccgtacccccgtacccgtacccgtaacccggtaaaccccggg

SEQ ID NO: 419227 - DNA, 550 bp, Homo sapiens
  misc_feature: GZ8MTXP02FGUGS.21.78.H01.1.454.CMB.2.raw
  modified_base (344)..(344): a, c, t, g, unknown or other
  modified_base (379)..(379): a, c, t, g, unknown or other
  modified_base (431)..(431): a, c, t, g, unknown or other
  modified_base (472)..(472): a, c, t, g, unknown or other
  modified_base (480)..(480): a, c, t, g, unknown or other
tcagtcgtcgctcgcacgaccggtgctcgatttagtgtgagtagtttgggtttggggggagaggagcccagcactggggattccgaggtgtttccattcgggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctggggtccgccaggctccaggggaagggcctggagtggatctcactttatttanagtggtggtacccccacatactacacagactccgngaaagggccattcaaccatctcagaaagacaaattccaagaacacatagtancttcaaaatgaaataaacctgagagccgaggacacggccanagattacngtgtggggcattaacttgacccctcgggggccggggaaaccctgcaccgctccccacctccactaaacgg

SEQ ID NO: 419228 - DNA, 615 bp, Homo sapiens
  misc_feature: GZ8MTXP02G4MOS.21.78.H01.1.454.CMB.2.raw
  modified_base (301)..(301): a, c, t, g, unknown or other
  modified_base (430)..(430): a, c, t, g, unknown or other
  modified_base (587)..(587): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttacaaaaggtgtccagtgtgaggtgcagttggtggagactggaggaggcttgatccagccgtgggggtccctgacgactctcctgtgcagtctcgtgggttcgtcaggtggcgactacatgagcgtgggccncgaggcctccggaggggaacggccgtaggagtggtatctactaactttatttaagtggtggtacgtaccccaactatacacacagaccgtccgtaggaaaccgggcgtaattcaacatctacaagaaanaacaattccaaagaacacgtattagtatacttacgaaaatagaaataaccgtagaagacgaccgacgacgacggacatgtatactggtaggtcgggatacttacgttacggaccccggtcgggggaacccggggtacctcggtacctacccgtcccncccccgaccctacccgaccgaaacccgg

SEQ ID NO: 419229 - DNA, 650 bp, Homo sapiens
  misc_feature: GZ8MTXP02HXYMS.21.78.H01.1.454.CMB.2.raw
  modified_base (256)..(256): a, c, t, g, unknown or other
  modified_base (490)..(490): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgaggccgtggggggtcctgagtactctcctgngcagtctcgttgggttcgtcgaggtgcgactacagtgagtcgtcgggtccgccgaggccgtaccggaggggaacgggccgtaggaacggtggactcgtacctaatttagttaagtaggtggtacgtaccccatacttacaactacagtacgtccgtaggaacggccgtattaccactatccagaacgaaagactaacgtcccaaggaaacctagtattagtaacttcttaaaanaaatagtaaactacgtagaacgacggaccgagaaccgacgtactacgttagtacgtacgtggtcggtacggtcttacgttaccgtccggacccgggtacggggtacccgtacgtccgtacctacccgtcccctaccccgtacccgacccgaaccggaccg

SEQ ID NO: 419230 - DNA, 658 bp, Homo sapiens
  misc_feature: GZ8MTXP02IT2MD.21.78.H01.1.454.CMB.2.raw
  modified_base (380)..(380): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagcctgggggtccctgagactctcctgtgcagtctcgtgggttcgtcagtggcgactacatgagctgggtccgccgaggctccgaaggggacggcctggagtggatcgtcactttattatgtggtgtaccccacataactacacaagacttccggngaacggggcctatttccgacctatctacgaagaaacgacaaacttcccaaaggaaaccactaatttcgttaattacttacaaaatacgtaaactaaccttagacgacggaccggaggaacgacgaccgtaatgtttaacgtattggtgggtacggggtcctaagttttacccgtacgtacccccgggtacgggggtaccccggggttaacccgtcgggtacccctaacccggttacccctccccccggtaacccttccccgaacccggtaacccgggg

SEQ ID NO: 419231 - DNA, 888 bp, Homo sapiens
  misc_feature: GZ8MTXP02G54W5.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgcttatttacaaaggtgtccagtgtgaggtgcgtaggttggtggagacgtgggaggaggtcttgactccgacggccggtcggggggtccctggacgaccttccgtccgtgtgctagttctcggttgggttcgtcgaggtggcgtactacatggagtcgtcgggtcccgccgacggccgtaccgggaaggggaacgggcccgtaggggaggtacgggtactttcccgttacgttaaccttttaagtttaagtttagggtcgggttaacggtaaccccaacctaaacgttaacctaaccacgaacgtaacccgttccgggtaaagggaaaccggggtccccgtaaacttacccaacctacgttaccaacgtaaacgaaacgtaaacctaaacgttaaccgaacggtaaactacctaagtttacgttaacttcctaaaataaaacgtagtaaaacgttaacccgtaagggaacgaacggaccggaaacggaaccggaaaccggaccctaaagttcggtttaaacgttacggtagggtttacggggtacggggtactttaacggttttacccggttacccgggtaacccccgggggttaccggggggtaacccccgggggtaaaaccccgggtttccggtaaacccccggttacccccggttaacccccccggttaccccccctaaaccccccggttacccccggaaaccccggtaaaaccccccgggg

SEQ ID NO: 419232 - DNA, 771 bp, Homo sapiens
  misc_feature: GZ8MTXP02F1AEH.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgctagttggtggagactggaggaggcttgatccagccgtgggggtccctgagctctcctgtgcagtctcgtggttcgtcagtggcgactacatggagtcgtcgggtcccgaccgaggccgtccggaaggggaacggggccgtagggaggttacggactcgtactacgttttaatttagtagggtcggttacggtaaccccactaacttaacctaacgaactaacggtaccgtccggtaagggtaaaccgggggtccgtaaaccgttacccaacctactaccgtaaccgaaaggtaaaacctaaaccgtaaactttcccgaaaagggtaaaccaccgttaatttacgtacttacttaactaaaagttcggtaaaactaaccgtagaaccgtacgggaacccgacggaacaccgggtctaacgttaggtaacctttacggtggttacggggttacggggtactttacggtttaaacccggtccggtacccccgggttaccggggggaccccggttaacccgtcggtaaaccccgtcccgttacccctacccccgtacccctaaccccggaacgtaaccccggg

SEQ ID NO: 419233 - DNA, 697 bp, Homo sapiens
  misc_feature: GZ8MTXP02IP61O.21.78.H01.1.454.CMB.2.raw
  modified_base (258)..(258): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagccgtgggggtccctgagactctcctgtgcngtctcgtggttcgtcagtggcgactacatgagcgtgggtccgccgaggctccgagggacggcctgggagtggactctactactttatttacgtagtggtacggtacccctaacataccgtaacaacgtaacgaccgtccggggtacggaaacggggtacccggtaatttacccgaacctactcctaccgaagaaagtaacaaacttacccgaaaggaaactactaagtttgtaacttacttaacaaatagtaaacgttaaccgtgaacggacggaccgtaacgggaccaccgggtaccaaggttagtaacgtttactgggttggttacggggtatacgttttaaccgtccggttaccccgggtcggggggtaccccgtaacccggtggtacccgaacccgtccccctaccccacccccgttaccaacccggaacccggg

SEQ ID NO: 419234 - DNA, 590 bp, Homo sapiens
  misc_feature: GZ8MTXP02IXHEN.21.78.H01.1.454.CMB.2.raw
  modified_base (463)..(463): a, c, t, g, unknown or other
  modified_base (469)..(469): a, c, t, g, unknown or other
  modified_base (504)..(504): a, c, t, g, unknown or other
  modified_base (518)..(518): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcaggttggtgggagacgtgggaggaggcttgatccagccgtgggggtccctgagactctcctgtgcagtctcgttgggttcgtcgaggtggcgactacatgagcgtgggtcccgccgaggcctccggaagggacgggccgtggagtggatcctactactttatttagtggtggtacgtaccccatactactacacagactccggtagacggcgtacttccactatctacaagaacaactaactaccgaagaaacactattgtaatcttanaaatanaaactaacgtgacgagacccgaagacacggctatntaagtcgtgtcggnggtcttagttcgtacgcccggtacggggccggtaacccgtgtccgaccgtccctcccaccctcacccgaccg

SEQ ID NO: 419235 - DNA, 629 bp, Homo sapiens
  misc_feature: GZ8MTXP02FOZOK.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagctgggtcccgcaggctccgaggggaacggcctggagtggatctctactttattataggtggtggtaccccagatactacacagactccgtagaacggccgattcacgtatctacagaaacgacaattcccgaagtaaacactattacgtaattcttaacaaaatgaaaactacctagaacgaacgccgaaggacacggacctaagtacgtaattagtagggtcgtcggggtattacgtttaccgtacggtacccccggtgggggtaacccgggtaaccccgttgggtacccgaacccggttccctaccccccgtacccgtacccgaacccggtaaacccgg

SEQ ID NO: 419236 - DNA, 671 bp, Homo sapiens
  misc_feature: GZ8MTXP02G6I2E.21.78.H01.1.454.CMB.2.raw
  modified_base (452)..(452): a, c, t, g, unknown or other
  modified_base (627)..(627): a, c, t, g, unknown or other
  modified_base (636)..(636): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgctagttggtggagacgtgggaggaggtcttgactccgaggtccggtcggggggtccctggacgacctctccgtgtgcgtacgtctcggttagggttcgtcgaggtggactactacagtgagcgtcgggtcccgcgacggccgtaccggaggggaacggtccgtagggagtaggacttcctacgttactttatttagtaggtcggtacgtaccctactactactacacgacgtacgtccggaggaacggtccgtatccgacnctactacgaagaaacactaactaccgaagtaacactagtttacgaacttctaaacgaaatagaaacctaccgtaggaacggtacgaccgaaacggtaccacggtacaagttcgttaatgtcgggtggtcggtacttcgtttaacgccggtacccgggtcggggacccggttaccngggtacccnccggtaccctaccccgaccgtacaccgggaacccg

SEQ ID NO: 419237 - DNA, 603 bp, Homo sapiens
  misc_feature: GZ8MTXP02I66GA.21.78.H01.1.454.CMB.2.raw
  modified_base (297)..(297): a, c, t, g, unknown or other
  modified_base (393)..(393): a, c, t, g, unknown or other
  modified_base (431)..(431): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcagtggcgactacatgagctgggtccnccaggctccgagggaaggcctggacgtggatctcacttatttatagtggtggtaccccacatactacacagactccgtgaaagggccattccaccntctcagaaagacaaattcaagaacacattgtactctanaaaattgaaataacctgaacgagaccgaagaccgacggtaccaagtgtaattagtgtacggtggggactacgtttactacggtaccccgttgggggaccccgggtaacccgtaaggggtacccaaccggtccccttacccccgacccccgttcccaaaccgaaaccccgggg

SEQ ID NO: 419238 - DNA, 658 bp, Homo sapiens
  misc_feature: GZ8MTXP02IX3SG.21.78.H01.1.454.CMB.2.raw
  modified_base (255)..(255): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtcctgagactctcctgtgcngtctcgtgggttcgtcagtggcgactacagtgagcgtcgggtcccgccgaggcctccggaaggggaacggggccgtagggagtggacttctctactttaatttagtagtggtacgtaccccactatactacacgacgactccggtaggaacgggtccgtattccaacgtatactacaagaacgtaacaacttacgaagaaacactattagtaactctacaaatagtaaactaaccgtagacgacggaccgaacggtaccgacggcctaagtgttattacgtggttacggtggggactttacgtttacgttaccggacccgggttacgggggacccggggtaacccgtcggtacccgtacccggtcccctacccccgacccgttacccgaaccgtaaccccggg

SEQ ID NO: 419239 - DNA, 560 bp, Homo sapiens
  misc_feature: GZ8MTXP02HEEMH.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagcctggggggtccctgagactctcctgtgcagtctctgggttcgtcagtggcgactacatgagctgggtccgccaggctccgaggggaaggcctggagtggatctcacttatttatagtggtggtaccccacatactacacagactccgtgaacgggccgattcaccatctcagaagacaattccagaacacattgtatctacaaatgaaataacctgacgagactagaggacacggacagtagtattaactgtgtggggactatttactcgacccgtgggggacccgggtaacccgtggaccaccggtcctacccccgaccctaccgaacccg

SEQ ID NO: 419240 - DNA, 619 bp, Homo sapiens
  misc_feature: GZ8MTXP02JETEW.21.78.H01.1.454.CMB.2.raw
  modified_base (367)..(367): a, c, t, g, unknown or other
  modified_base (400)..(400): a, c, t, g, unknown or other
  modified_base (403)..(403): a, c, t, g, unknown or other
  modified_base (409)..(409): a, c, t, g, unknown or other
  modified_base (487)..(487): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagactctcctgtgcagtctcgtgggttcgtcaggtggcgactacatgagcgtgggtcccgccaggcctccgaggggaacgggcctggagtggatcgtctacttatttagtagtggtggtaccccanatactacacagactccgtgaagggccgatcacntcncagaanacaatccaagaacacattgtatactacaaaatgaaattaaccagagacgaccgaaggacacgggcagtgtaattacgngttggtggggtactacgtttacgttaccgggtaccccggttacgggggaccccgggggtaaacccctggggtaccccgtaaccccggtccccgtacccccctaccccgtaccccgaacccgtaaacccgggg

SEQ ID NO: 419241 - DNA, 640 bp, Homo sapiens
  misc_feature: GZ8MTXP02J1ON3.21.78.H01.1.454.CMB.2.raw
  modified_base (378)..(378): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcactacatggagcgtcgggtccgccgaggctccggaaggggacgggccgtggaggtggatcgtctactttatttagtgtggtggtaccccacatactacanacgactcggtagaacgggcctattccactatccacgaaagaaacactaacttaccgaaagaacaatacgttagtaacttacttacaaaatacgaaactaaccgtagaacgacgacccggagaaccgacggacctagtacgttatacgtgtcgggtacgggtcttacgtttaccgtcggtaccccggtcgggggaccccgggtaaccgttcgggtacccgtacccgtcccctacccccgacccctaccgaacccgtacccggg

SEQ ID NO: 419242 - DNA, 799 bp, Homo sapiens
  misc_feature: GZ8MTXP02F2J9K.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtcggggtcccgccgaggcctccgaaggggaacgggccgtagggaggtgggaacttcctactaacttttaagtttaagtaggttgggtacggtaaccccactactaactaaccaacaacgacttccggtagaaacggggccaacttccaacctacttctaacgaagaaaacgtacaaaacgttcccgaaagggaaaaccactaagttttacgttaaactttaccttaactaaaaaagttcggaaaaaccttaaaacccgttgggaaaacgtaaccggggaccccgggaaaacgggggaacccaaacccggggacctaaacgtttaggttaaacgttttaacggtgggttacggggttacgggggtacctttaaaacggtttttacccggtacccggttaaccccccgggtaggggggggaccccccggtaaaccccgttcggggtacccctaccccgggttaccccctcccccccgaaacccgttaccccgaaaacccggaacccccgggg

SEQ ID NO: 419243 - DNA, 789 bp, Homo sapiens
  misc_feature: GZ8MTXP02I5W4M.21.78.H01.1.454.CMB.2.raw
  modified_base (255)..(255): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagccgtgggggtccctgagactctctgtgcngtctcgtgggttcgtcgagtggcgactacatgacgcgtcgggtccgccgaggcctaccggaggggaacggggccgtagggaggtggacttcctacgtacttttaagtttagtaggtggttacggtaacccctactataactaacacgtaacgaccgttccggtaggaaaccggggtccgtacttacccactactcctacgaaagaaacgaactaaacgttacccgaaggaaaccctacgttaatttgtaattaccttaaactaaaagttagtaaaaccttaacccgtaggaaggaaccggacccggaacggaaccgacccgggtaactaagttacgttaaacgttacgggttggttacggggtacggggttacctttaacggttttaaacccgttcccgggggtaacccccggggttacggggggtaaccccccgggggtaaacccgtttccggggtacccccgttaaacccccggttcccccgttacccccccgaaacccccgtttcccgaaaaccccggggtaaccccgggg

SEQ ID NO: 419244 - DNA, 753 bp, Homo sapiens
  misc_feature: GZ8MTXP02ISR4S.21.78.H01.1.454.CMB.2.raw
  modified_base (295)..(295): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagcttgggttttccttgttgcttatttacaaaaggtgtccagtgtgaggtgcagttggtggagacgtgggaggaggcttgactccaggccggtcgggggtcctgacgactctcctgtgctagtctcgtgggttcgtcaggtcggcgactacngtggtaggttcgggtcccgccgaggcctacccggagggggaacggcctagggagtaggactctactatttaatttagtaggtggtacgtaccactactactaacacagacctcggtaggaacgggcctacgttaccacctatacctacaagaaacgaactaacgttacccgaaaggaaaccctagttactttagtaacttaccttaaacgaaataacggaaaacttaaacccgtggaacgaaccgggaccgggaaaggaacccaaccggaccttaaagttggttaaactttaacgtgggttacgggtacggggtactttaacgttttacccggtaccggtaacccccggggttcggggggaaacccccggggttacccctaggggtaacccccgtaaccccgtttccccgtaaccccccgacccgttccccggaaaaccggtaaccccggggtacccc

SEQ ID NO: 419245 - DNA, 812 bp, Homo sapiens
  misc_feature: GZ8MTXP02HP0Q4.21.78.H01.1.454.CMB.2.raw
  modified_base (471)..(471): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggtagttttggctgagcttgggttttccttgttgctatttcaaaaggtgtccagtgtgaggtgcagttggtggagacgtgggaggaggcttgatccgaggccgtgggggtccctgagactctcctgtgctagtctcgtggttcgtcagtggcgactacatgagcgtcgggtccgccgaggcctccggaggggaacggccgtagggaggtcggacttcgttactaacttttaagtttagttaaggtcgggttacggttaccccaactacttacgtaaccacgacgtacctcccggggtagggaaacggggtcccgtacgttaccaaccctacttacccganaaagtaaaccggtaaaccctaaacgtttacccgaaaagggtaaaccccacgtttaattacgttaacttcttaaaccgaaaattaggaaaacttaaacccgttaggacggaacggccgggaaacggaaccgaccggggtacctaaaggttccgtttaaagtttaacgtcgggggtttagggtaccgggggttacctttaacgtttttaaaccccggttccgggtaaccccccggggttcgggggggtaacccccggggtaaacccgtttcggggtaccccctacccggttaccccctacccccccgaccccgtttaccccgaaacccggtaaacccccgggg

SEQ ID NO: 419246 - DNA, 787 bp, Homo sapiens
  misc_feature: GZ8MTXP02JTZP4.21.78.H01.1.454.CMB.2.raw
  modified_base (300)..(300): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctggggttttccttgttgctatttcaaaaggtgtccagtgtgaggtgcagttggtggagactgggaggaggcttgatccagccgtggggggtccctgagactctcctgtgcagtctcgtgggttcgtcagtggcgactacatgagctgggtccnccaggctccgaggggaacggcctggagtggatctctacttatttatacggtgggttcggtaacccccacgtaactactaaacctacgaagtaacccttcccgggtagaaacgggggtacccgtaatttccaaaccctagttcctacgaaagaaacgaacaaactttacccaaagggtaaacaacctaagttacgttaatacctttaacaaaattacgtaaaacttaaacccctagtaacgggtaacgacccgggtaaacggaaaccgtaacccggggtaccctaaagttacggttaaacgtttaaaccgtgggttacgggttacggggggtactaaaaccggtttttaccgttaacccgggttacccccgggttacggggggaacccccgggggttaaacccccgtcgggggttaccccctaaccccggggttacccctacccccccgtaacccgttacccccgaaaacccggtaaaacccccgggg

SEQ ID NO: 419247 - DNA, 688 bp, Homo sapiens
  misc_feature: GZ8MTXP02I3MIE.21.78.H01.1.454.CMB.2.raw
  modified_base (512)..(512): a, c, t, g, unknown or other
  modified_base (549)..(549): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgctaggttggtggagacgtgggaggaggcttgatccgacgccgttcggggggtccctgagtacctctcctgtgctagtctcgtggttcgtcagtggcgtactacagtgagtcgtacgggtccgccgtagggcctaccggtaaggggaacggggtccgtagggaggttcgggacttccttacgttactttaagttttacgttaggttgggttacgtaacccgactatactacacacgactcggtagaacggtcgtacttccactagtctacaagtaacgactaaagtcccaaagaacctacgtaattcgtaacttacgtaanaaaagtgaaactacgtagacggagacccggaggaccncggtacaagttgttaatcgtggtcgggtggtacctttactttaacccgtcggaaccccgggtcgggggtaccccgggtaaccttggggtaccccctacggttcccccaccccgtacccctaccgaacccggtaaaccgg

SEQ ID NO: 419248 - DNA, 745 bp, Homo sapiens
  misc_feature: GZ8MTXP02HT5VJ.21.78.H01.1.454.CMB.2.raw
  modified_base (244)..(244): a, c, t, g, unknown or other
  modified_base (716)..(716): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcaggttggtggagacgtgggaggaggcttgatccacggccggtgggggtccngagactctcctgtgcagtctcgttcgggttcgtcaggtggacgactacagtggagcggttcggggtcccgccgagggcctacccgggaaggggaacggggtcccgtaggggaggtgggtacttcgttactaacgtttttatttaagttaaggggttgggttacggtaacccctaactaacgttaacctaacgaacaaccggtaaccgtttccgggtaagggaaacgggggtcccgtaactttacccgaacccgttatccgtacgaaagaaacgtaaacctaaacttacccgaaggaaactactagttagtacttacttaacaaaagttacgaaacttaaccgtagacgacggaccgaggaccgacggaccaagtacgttaattacgtggtcggttaggggcttaacgtttacgttaccggtacccgggtcgggggtacccgggtaaccgttcgggacccctacccgtccccnccccgtacccctaccgacccgtaacccgg

SEQ ID NO: 419249 - DNA, 765 bp, Homo sapiens
  misc_feature: GZ8MTXP02GA0DD.21.78.H01.1.454.CMB.2.raw
  modified_base (252)..(252): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagcctggcggtcctgagctctctgtgcngtctcgtgggtcgtcgagtggcgactacagtgagtcgtcgggtcccgccgaggccgtaccggaggggaacggccgtgggagtggactcgtcttactttaatttagtaggttggtaccgtaccacgtatacctaacacgaacgtccgtccggtaagggaacgggtcccgtatttacccaaaccgtattaccgaacgaaaggaaactaacctaaacgtccgaaacggtaaacctaacgttagtttactacttaccgtttaaaacgaaagttaagtaaaacccgttacgtagggaaacgggtaccgaaacccggaaggtaacccgaaccgggtaccttaaggtttacgttaaacgtttaccgggttggggtaggggtttaccggggtaacttttaaacggttttccggtacccggggtacccccggggttacggggggtaacccccggtaaccggttacggtacccccgtaccccggttccccctacccccgtaccccgacccgtaaaccccgggg

SEQ ID NO: 419250 - DNA, 671 bp, Homo sapiens
  misc_feature: GZ8MTXP02F6Z9G.21.78.H01.1.454.CMB.2.raw
  modified_base (293)..(293): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagccggttttccttgttgctattcaaaaggtgtccagtgtgaggtgcagttggtggagactggaggaggcttgatccagccgtgggggtccctgagactctcctgtgcagtctcgtggtcgtcagtggcactacagtgagctgggaccnccaggcctaccgaggggaacggccgtaggagtacggatcgtacctaatttatttagtaaggtcgggttggtaacccactaactacctaaacactaacgtaccgttaccgtaggaaacggggcctaaattaccaacctaattccgaacaaacgaaacgaactaaacgtaccgaagaaactaactattataactactaacgtaaataacgtaaactaacgtaggaagacgaaccggaaggaaccgacgactaagtagttaacgttacgtggtaggtcggtacttagtttaccgtacggtacccggtacggggtaccggtaaccgtaccgtaaccgtacccgtaccctaccccgacccgtaccgaaccggaaccgtacccg

SEQ ID NO: 419251 - DNA, 695 bp, Homo sapiens
  misc_feature: GZ8MTXP02G83RO.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgactccagccgtgggggtccctgagactctcctgtgcagtctcgtgggttcgtcagtggcgactacagtgagtcgtcggggtcccgccgacggcctccggaaggggaacgggccgtgggaaggttgggacttcctactaacttttaagtttacgtaaggtcgggtacggtaacccccactaactaacctaccgactaacgactcccgggtagaacgggggcctagttccaactattcacctaaggaaacaactaacttcccgaaagaaccacgttattacgtaattaccttaacaaaattcgaaaactaccgtaggaacgacgaccgaacggacgaacggtaccagtacgtacttaacgtggtaggtacgggtactagtttaaccgtcggtacccccggtcgggggaccccggtaacccgtcggtaccctacccgtcccgttacccccacccgttacccgaaccggtaaccccgg

SEQ ID NO: 419252 - DNA, 796 bp, Homo sapiens
  misc_feature: GZ8MTXP02FP7ZI.21.78.H01.1.454.CMB.2.raw
  modified_base (244)..(244): a, c, t, g, unknown or other
  modified_base (540)..(540): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgagccgtgggggtccctganactctcctgtgcagtctcgtggttcgtcgaggtggcgactacagtggagcgtcgggtccgccgagggcctccggaaggggtaacgggtccgtagggtaggtggacttctactacttttaagtttagtaggttggtacggtaccccaactaacgtactaacgaacaacgtaccgtccggggtaggaaacggggtcccgtagttaccaaccgtactctaacgaagaaaccgtaaacctaaactttccccgaaaaggaaacctacttaaagtttacgtttaaacttacccgtttaaaanaaaaacgtttacgaaaaaccttaaacccggtaggaaacggaacggggtacccggaaaccgggaccgtaaccgggtacccttaaaggttacgttaaaacgtttcgttagggttacgggttcggggtaacctttacgggtttaaacccgtccgggtaacccccgggtacgggggtccccggggtaaaccctcggggtaccccctaacccgggttccccctacccccggtaaccctacccgaacccggtaaaccccggg

SEQ ID NO: 419253 - DNA, 795 bp, Homo sapiens
  misc_feature: GZ8MTXP02F5EQL.21.78.H01.1.454.CMB.2.raw
  modified_base (276)..(276): a, c, t, g, unknown or other
  modified_base (311)..(311): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgctagttggtggagacgtggaggaggtcttgatccagccgtgggggtccctgagacctctcctgtgctagtctgtgggttaccngagtggcgactacagtgacgtcgtcggggtccccncgacggccgtacggagggtacggtcgaggtacgtacgtctactacttaacgtttagtttaagtaggttacggtacgtaacccctaacgtacttaaccgtaacacgtaaccggttaccgttccgggaaacgggtaaacggggtacctaacttacccgtaacctataccgtaacgaaacgtaaacgtaactaaactaacgaacgaaactacttagttacgttaacttacctaataaaacgtacgtaaaacgtaccgtagaacggaacggaccggaaacgtaaccggaaccggtacgtaacgttacgttaaacgttacgttacggttacgggttacgggttaacctttaaccgttttacccggttacccgggttaacccccgggggttaaccgggggtaacccccggtaacccggttaaccggtacccccgttaaccccgtaccccctaccccccgtaccccgtaccccggaaaccccggtaaccgg

SEQ ID NO: 419254 - DNA, 660 bp, Homo sapiens
  misc_feature: GZ8MTXP02FGTFH.21.78.H01.1.454.CMB.2.raw
  modified_base (474)..(474): a, c, t, g, unknown or other
tcagtcgtcgctcgcacgaccggtgctcgatttagtgtgagtagtttggggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtcgggtccgccaggcctccgaaggggaacgggcctggagtggactcgtcactttatttagtaggtggtacggtaacccctacgatactacacacgacgtcccgtaggaaacgggccgtacttcaccgatctacaaagaaacgaacaattacccgaaggtaacacgtatttagtataccttanaaaatgaaatacctgacgacgaccgagaccacggcctagtagtaagttactaggtcggtacggggtcttaaacgttttaccggtaccggtacccccgttcggggggacccccggggtaaaccctccggggtacctaccccggtacccctacccccgtaccccgaccccgacccgtaaaccccgggg

SEQ ID NO: 419255 - DNA, 634 bp, Homo sapiens
  misc_feature: GZ8MTXP02GFIRA.21.78.H01.1.454.CMB.2.raw
  modified_base (302)..(302): a, c, t, g, unknown or other
  modified_base (402)..(402): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgctagtctcgtgggttcgtcgagtggcgactacatgagctcgggtccncgagctcgagggaacggctggagtggatctcgtaacttatttagtagtggtacgtacccatatactacacagactcgtagaacggggcctaattcaaccnttacctacaagaaacaacaaacttcaaaggaacaactaagtttagacttactacaaaatagaaactaacctagacgtaagccgaagacacggacctagtagttactacgtggtggtacggggtacttacgttacgttaccggtccccggttacgggggacccccggggtaaccgtcggtaccctaaccccggtcccacccccgtaaccccgtcccgaaccccgaaacccggg

SEQ ID NO: 419256 - DNA, 877 bp, Homo sapiens
  misc_feature: GZ8MTXP02FHU2K.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggtagttttggctgagctgggttttccttgttgctatttacaaaaggtgtccagtgtgaggtgcagttggtggagactggaggaggcttgatccagccggtcgggggtcctgacgtactctcctgtgctagtctcgtgggttcgtcaggtggacgactacgatggacgtcggtcggggtccgccgagggcctaccggaagggggaacggccgtggggagtgggtactccgtactaaccttttaatttaagtaggttcgggttacggtaaccccctactaacttaacctaccaacgtaacggtaccgttcccggtagggggaaaaccggggtcccggttaactttacccgaaaccccttaagttacccgttaccgaaaacgtaaaacgtaaacctaaaacgtttaccccgaaaagggtaaacccaacctttaaagtttacggttaaactttacctttaaaccaaaaactttacggaaaaactttaaaccctagggaaaaccgtaccggggaacccgggaaacggggtaacccgaaccggggtaccctaaaggttacgttaaactttacgggttaggttggggttaccgggggtaactttacgtttaacccgggtttacccggggaccccccgggttcgggggggtaacccccggggttaaccccggttaacgggtacccccgtacccccgggttacccccctacccccccgtaacccgttacccccgaaccccgggaaaccccgggg

SEQ ID NO: 419257 - DNA, 676 bp, Homo sapiens
  misc_feature: GZ8MTXP02IIZG3.21.78.H01.1.454.CMB.2.raw
  modified_base (308)..(308): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggagggaggtcttgatccgaggccgtgggggtccctgagactctctgtgcagtctcgtgggttcgtcagtggcgactacagtgagtcgtacgggtcccnccgaggcctccggaaggggacgggcccgtgggagtgggatctactactttatttagtagtggtcggtaccccactatactacacagacctcgggtagaacgggtccgtacttccaccatcctacgaagaaagtaacattaccgaaaggaaccactagttgtaacttactactaaaatgtaaaactacccgtagaacgacggaccgaacgggacaccggacctagttataacttacgtggttcgggtagggacttaacgttttacggtaccggtccccggggtaccggggggtcccggaaacccgttcgggtaccccgtaccccggttccctaccccccgtaccccgtacccgaaccggtaaccccggg

SEQ ID NO: 419258 - DNA, 567 bp, Homo sapiens
  misc_feature: GZ8MTXP02IU8VY.21.78.H01.1.454.CMB.2.raw
  modified_base (335)..(335): a, c, t, g, unknown or other
  modified_base (395)..(395): a, c, t, g, unknown or other
  modified_base (419)..(419): a, c, t, g, unknown or other
  modified_base (428)..(428): a, c, t, g, unknown or other
  modified_base (434)..(434): a, c, t, g, unknown or other
  modified_base (447)..(447): a, c, t, g, unknown or other
tcagtcgtcgctcgcacgaccggtgctcgatttagtgtgagtagtttggggtttggggggagaggagcccagcactggggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctcgtgggttcgtcagtggcgactacatgagcgtgggtccgcaggctccgaggaaggctggagtgatccccctnacttattatagtggtgtacccacataactacacagactcgtgaaaggccgtatcacatcncagaagacaatcaagaacacattntatctaaanaaatanaaactaactaganacgaccgaagacgacgcatagtatacgtagtcggtggactacttacgtcgacccggtacgggggaccgggtaaccgtcggtaccgtacccgtccctaccccacccgtaccaaccgaacgg

SEQ ID NO: 419259 - DNA, 798 bp, Homo sapiens
  misc_feature: GZ8MTXP02F0RG5.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgctagttgggtggagactggaggaggcttgatccagccgtggggggtccctgagtactctcctagtgcagtctcgtgggttcctcaaggtggcactacatcgagcgtgggtccccgccgacggtcctacggaaggggtaacggccgttaggggaagttgggacttcctactaacgttttaatttaagtaggttacggggtaccgtaaccccactaactaacgttaccaacgtacggaccttccggggaagaacgggggtccctaatttccaacccgtattccctacgaaggaaacaactaaacttacccgaaaggaaaccacttaacgtttacgttacttaccttaaccgtaaaattacggaaaactttaaaccccgtaggaaacgaagggaaccccggtaaacggacccgaaccggtacctaaacggttagttaaacctttaaggtcggttagggggtacggggttacctttaacgtttaaccggtaccggtaccccggggtaccggggggtaccccgggtaacccggtaacgggttaccccgtaaaccccggggttcccctaccccccgtaaccccgtaccccgtaaacccggtaaacccccgggg

SEQ ID NO: 419260 - DNA, 701 bp, Homo sapiens
  misc_feature: GZ8MTXP02IG384.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggtagttttggctgagcttgggttttccttgttgctatttacaaaggtgtccagtgtgaggtgctagttggtggagacgtgggagggaggtcttgactccaggtccggtcggggggtccctggagtactctccgtgtgctagtctcgttgggttcgtcaggtggcgactacatgagcgtcgggtccgccgaggctacgagggaaggccgtggagtggatcgtctactttatttagtaggtggtacggtaaccccaacgtactaactacactacgaccgtccgtaggaaacggggccctaacgtttccaccaaattcccacgtaaaggaaacgaaactaacttacccgaaacgggtaaacaaccttaattacgtacttacctttaacaaaagttaagaaactaaacttaggaacgacggacccgaaggaaccacggacctagttagtaactttaccgtagttgggtagggtaccttacgttttacgtaccggtacccccggtggggaccccgggtaccgtaaggtcccaccccggttacctcccccgtaccctaccgaaccccgtaaccgg

SEQ ID NO: 419261 - DNA, 677 bp, Homo sapiens
  misc_feature: GZ8MTXP02FHHG5.21.78.H01.1.454.CMB.2.raw
  modified_base (346)..(346): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttacaaaaggtgtccagtgtgaggtgcagttggtggagactggaggaggcttgatccagccgtgggggtccctgagactctctgtgcagtctcgtgggttcgtcaggtggcgactacatgagcgtcgggtccgccgaggctccgaggggaacgggcctggagtggatctcactttattanaggtggtggtaccccacatactacacagactccgtagaacgggccattccacgatctacaagaaacgaactaaacttacccgaaaggaaaccactaatttagtactttaccttacaaaaattgaaaacttaaccgtagaacgaacggacccgaaggaacccaccgggtacctaaagtcgtaatttaccgaggttagggtcgggggtacttaacgttttaccgtacgggtaccccccggttagggggggcccccgggtaaaacccgttcgggtaccctaaaccccggttcccctaccccccgaccccgtacccgaaacccgtaaacccgggg

SEQ ID NO: 419262 - DNA, 718 bp, Homo sapiens
  misc_feature: GZ8MTXP02H8VL0.21.78.H01.1.454.CMB.2.raw
  modified_base (194)..(194): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgctatttcaaaaggtgtccagtgtgaggtgngagttggtggagacgtggaggaggcttgatccgagtccgtgggggtcctgagactctcctgtgcagtctcgttgggttcgtcaggtggcgactacagtgagcgtcgggtccgaccgaggcctccggagggacgggccgtaggagtggatctactacttattagtaggtggtacggtaccccagtactacctaacacgaacgtacctcggtacgggaaacggtccgtaacttccgaccctatacctacgaagaaacgaactaaacgttacccaaacgggtaaactacctaagttcgtaacttacttaaacgtaaatacgtaaagtaaacccgttgaacggacggaccggaacgaaacgaccgtaccgtaattaggtaactttacgacggttaggtacggggtacttaacgtttaaccggttcggtaacccccgggtcgggggtaaccccggggtaacccgtcgggtacccctacccggtaccccgtacccccgtaaacccctaccccgaaacccggtaaccccgg

SEQ ID NO: 419263 - DNA, 582 bp, Homo sapiens
  misc_feature: GZ8MTXP02JVUKB.21.78.H01.1.454.CMB.2.raw
  modified_base (292)..(292): a, c, t, g, unknown or other
  modified_base (301)..(301): a, c, t, g, unknown or other
  modified_base (374)..(374): a, c, t, g, unknown or other
  modified_base (397)..(397): a, c, t, g, unknown or other
  modified_base (411)..(411): a, c, t, g, unknown or other
  modified_base (415)..(415): a, c, t, g, unknown or other
  modified_base (428)..(428): a, c, t, g, unknown or other
  modified_base (437)..(437): a, c, t, g, unknown or other
tcagtcgtcgctcgcacgaccggtgctcgatttagtgtgagtagtttggggtttgggggggagaggagcccagcactgggattccgaggtgtttccattcgggtgatcagcactgaacacagaggactcaccatggagttttggctgagctgggttttccttgttgctatttcaaaaggtgtccagtgtgaggtgcagttggtggagactgggaggaggcttgatccagcctggggggtccctgagactctcctgtgcagtctctgggttcgtcagtggcgactacatgagngtgggtccnccaggctccgagggaaggcctggagtggatctcacttatttatagtgtggtacccacatacacacagactcgnaagggccatcacatctcagaaanacatacgaagacanattntatctacaaatanaaactaacngagacgaccgaagacgacgacatagtattactagtacggtagggtactaacgtttaccgtaccgtaccccggtacgggggacccggtaacccgtcgggtaccacccgtccccgtaccccctacccgtaccccgaacccgaaccgg

SEQ ID NO: 419264 - DNA, 747 bp, Homo sapiens
  misc_feature: GZ8MTXP02GBP74.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtcgggggtccctgacgactctcctgtgcagtctcgtgggttcgtcaggtggcgactacatggagcgtcgggtcccgccgaggcctccggaggggaacggccgtggaggtggatctctactttatttagtaggtggtacgtaccccatatactacacacgacgtccggagaacggccgtacttaccgactagtctacgaagaaacgactaacgttcccgaaaggaaaccacgtaatttacgtaacttacttaacaaaattacgttaaaacgtaccgttaggaacggtaccggacccggaaacggaccgaaccgggtaccttaagttacggttaacgtttaccggttaggttacgggggttacggggtaccttttaaccgttttaaccgggtcccggtaacccccgggggttcggggggtaaacccccgggggtacccgttaacggggtacccccgttacccccgttaccccgtaccccccgtaacccccgtaccccgtaacccggtaaacccccgggg

SEQ ID NO: 419265 - DNA, 646 bp, Homo sapiens
  misc_feature: GZ8MTXP02GVHPE.21.78.H01.1.454.CMB.2.raw
  modified_base (500)..(500): a, c, t, g, unknown or other
  modified_base (546)..(546): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccgagccgtgggggtccctgagactctcctgtgcagtctcgtggttcgtcaggtggcgactacatgagtcgtcgggtcccgccgacgggctaccgaggggaacggggtccgtagggaagtgggtactccgtactactttaagtttagtaggtggtacggtaaccccacgtactactacacgtaacgaccgtccggtagggaaacgggtccgtacgtttaccaacctagttcaacgaagaagaactaacttaccaaggtaacacgtattcgtatccttanaaatagaaactacgtgagacgacgaagactacgctagtgtactcgnggttacgtgggtctaactttcgtcggacccggtacgggggacccggttaacctcgggtaccctacccgtcccgtacccacccgacccgaaccgtacccgg

SEQ ID NO: 419266 - DNA, 606 bp, Homo sapiens
  misc_feature: GZ8MTXP02G188E.21.78.H01.1.454.CMB.2.raw
  modified_base (411)..(411): a, c, t, g, unknown or other
  modified_base (454)..(454): a, c, t, g, unknown or other
  modified_base (461)..(461): a, c, t, g, unknown or other
  modified_base (495)..(495): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagacgtctcctgtgcagtctcgtgggttcgtcagtggcgactacagtgagcgtcggggtcccgccaggcctccgagggaaggcctggagtggatctcactttattagtgtggtggtaccccacgatactacgacagactccggtgaacgggccgtattcactatcctanagaaacgacaattacccgagtaacacgtattgtatccttaaanaaagtanaaactacgagacgacgacgacgacgacgctagtntacgtgtggtcggtcggtacttacgttacgtcggtaccccggtacgggggacccggtaccgtcggtaccctacccgtccccgtacccccgacccgtacccgaccggaccgg

SEQ ID NO: 419267 - DNA, 684 bp, Homo sapiens
  misc_feature: GZ8MTXP02JZVL4.21.78.H01.1.454.CMB.2.raw
  modified_base (383)..(383): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacagtgacgcgtcggggtcccgccgagggcctccggaggggaacggggccgtgggaggtggactcgtactactttatttagtaggtggtacgtaaccccanatactacacagactcggtagaacggggccatccactatcctacagtaaacactaaattacccgaaggaactactagtttacgtaacttacttaacaaattagtaaacttaaacccgtagaacgtacgggaccggaaacggaccgaacggacctaagttacggttaacttacgtggttaggggtacggggacttaacgtttaccggtacggtacccccggggtacgggggaccccgggtaacccgtcggtaccccacccggtcccgtacccccgaccccgtaccccgaccggtaaccccggg

SEQ ID NO: 419268 - DNA, 906 bp, Homo sapiens
  misc_feature: GZ8MTXP02HGBLP.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggtagttttggctgagcttgggttttccttgttgcttatttcaaaggtgtccagtgtgaggtgctagttgggtggagacgtgggaggaggtcttgactccaggccggttcggggggtccctggacgctctcctgtgctagtctcgtgggttcgtcagtggcgactacatgagcgtcgggtccgccgaggtcctacggaggggaacgggtccgtagggaggttggacgtttccgttaccttaacgtttaattttaagtacggttacggggttaccggttaacccccaactaaactaaccttaacgaacctaacggtaccgttccgggtaacggggaaacggggtacccgttaacttacccgtaccaaactttcccgaacgaaacggaaactaaaccctaaacgtttaacccgaaaacggggtaaaacctaaccgtaaacggttttagttaaactttacccttaaaacgtaaaaagtttaacgttaaaaacccgttaaaccccggtttagggtaaacgtaaacccggggaaccgggtaaaacccggggtaacccaaaccgggggtaacccttaaagggtttaaccgtttaaagtttaccggttaacgggttgggggttacggggttactttaacggtttttacccgtaacccgggggttacccccggggtacggggggtaaccccccgggttaaaccgtccggggttacccccgtaaccccggttccccctacccccggtaccccccttacccggtaaccccggtaaacccccggg

SEQ ID NO: 419269 - DNA, 782 bp, Homo sapiens
  misc_feature: GZ8MTXP02HX5TP.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgcttatttacaaaaggtgtccagtgtgaggtgctagttggtggagacgtgggaggaggcttgatccaggtccggtgggggtcctgagactctcctgtgcagtctcgtgggttcgtcagtggcgactacatgagcgtcgggtccgccgaggcctccggaggggaacggccgtgggagtggatctctactttattagtaggtggtacggtaaccccactaatacctaacacacgtaaccttcccggtaggaaacggggtccctacttacccaacctattccctaacgaaagtaaacggaactaaacgttacccgaaaagggtaaaacccaaccgttaatttacgtaaactttacctttaaacctaaaaagttacgtaaaaacttaaaacccgttaggaaaccgtaacgggaccccgtaaaggggaaacccgaaccggggtaccctaaagttacggttaaactttaaccggtgggttagggtcggggtaacttaacgtttttaaccggtccggtaacccccgggtcgggggtaaccccggggtaaaccccgttcgggtaccccgtaaccccggttcccccttaaccccccgaaccccgttacccgaaacccggtaacccggg

SEQ ID NO: 419270 - DNA, 591 bp, Homo sapiens
  misc_feature: GZ8MTXP02GUN0H.21.78.H01.1.454.CMB.2.raw
  modified_base (518)..(518): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctggagactctcctgtgcagtctctgggttcgtcaggtggcgactacatgagctggggtccgccgaggctccgaggggaaggcctggagtgggatcgtctaacgtttatttacgtagtgggtcggtaaccccacgatactacacgagtactccgtagaacgggccgattcgacatctcgaaagaacgacaaattccaacggaaacactaatttgtaacttcttaacaaaattgaaaataaccgtgacgagcccggaaggacacgggccaagtgtattacngtggtgggctacttacgtcgacccgtggggcccggaaccgtgccgaccgtctaccccgcctaccgacgaccgg

SEQ ID NO: 419271 - DNA, 798 bp, Homo sapiens
  misc_feature: GZ8MTXP02JC2PW.21.78.H01.1.454.CMB.2.raw
  modified_base (265)..(265): a, c, t, g, unknown or other
  modified_base (299)..(299): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggtagttttggctgagcttgggttttccttgttgctatttacaaaaggtgtccagtgtgaggtgctaggttggtggagacgtgggaggaggtcttgatccgagccggtcgggggtcctgacgactctcctgtgcncgtctcgtgggttcgtcgagtcggcgactactanggacgcgtcggggtcccgaccgacgggtcctaccgggaagggggaacgggcccgtaggggaggtagggtacttaccgtacttaacgtttttaagtttagtaggttcgggtacggtaacccccaacgtaactacctaacgtacaacgtacctccggggtaggaaaccggggaccgtacttccaaccgtacttccaaccgtaaagaaacgaaccgtaacttacccggaaacgtaaaccaccgttaagtttataacttacttaaactaaagttacgtaaaaaccttacccggtaggaacggaaccgggaccggaaacggaccgaaccggacgtaagttacgttacgtttaagtgggttacgggtcggggtacttaacgtttaccggtaccccggtaccccgggggttaccgggggaccccggggttaaacccgtccggttaacccgtaccccgttaccccctacccccgtaccccgtaccccgtaacccgggtaacccccgg

SEQ ID NO: 419272 - DNA, 859 bp, Homo sapiens
  misc_feature: GZ8MTXP02IRJQY.21.78.H01.1.454.CMB.2.raw
  modified_base (313)..(313): a, c, t, g, unknown or other
  modified_base (685)..(685): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgcttatttcaaaggtgtccagtgtgaggtgcgagttggtggagacgtgggaggaggtcttgatccgaggccggtcgggggtccctgacgactctcctgtgctagtctcgtgggttcgtcgagtggcgactacagtgagcgtcgggtcccncgtacggcctaccgggaaggggaacgggtccgtaggggaggtagggtaacttcccgttacttaacgtttttaagtttaagttacggggttcgggttaacggttaacccccaacgtaacttaacctaaaccgaacgaacgtaaccgttcccggtaagggaaacggggtacccgtacttacccaacctaagttcccaaacgaaagaaaacggtaacctaaaccgttaccgaaaacggaaacctaccgttaatttacgtaaccttaccgttaaactaaaagttacggtaaaaacttaccggtagaaaaccgggacggaacccgggaacggaaccggaaccgggtaccctaaggttacgtttaaccgtttaacggnggtttaaggggtcggggttacctttaaacgtttttaccggtacccgggttaaccccggggtacccggggggtaaccccgggtaaacccggtttccggtacccccgttaaaccccggttccccccgtaaccccccgtaaccccggtacccccgtaaaccccggtaacccccgggg

SEQ ID NO: 419273 - DNA, 752 bp, Homo sapiens
  misc_feature: GZ8MTXP02HCBYR.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtcctgagactctcctgtgcagtctcgtgggttcgtcagtggcgactacatgagctcgggtccgccgaggctccgaggggacggcctggagtggatcgtctaacttatttataggtggtaggtaccccactatactacactaacgacctccggtaggaaacggggcctaattccaacctagtcctacaagaaacgaacaaacgttacccaaggtaaaccacgtaatttagttaacttaccttactaaaaattacggtaaaacttaacccgtaggaaggaacggaccggaaacgggaaccgaacccggggtaaccctaacgttaggtttaaacgtttaaccgttacgggtttaggggtacgggggtaacttaacgtttttaaccggttaccggtacccccggggttacggggggaacccccgggggttaaaccccggtcgggggttaaccccctaccccggggttaccccctacccccccgtacccccgttaccccgaaccccggtaaacccccgggg

SEQ ID NO: 419274 - DNA, 710 bp, Homo sapiens
  misc_feature: GZ8MTXP02JDAU8.21.78.H01.1.454.CMB.2.raw
  modified_base (689)..(689): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtggaggaggtcttgatccgagccgtgggggtcctgagactctcctgtgcagtctcgtgggttcgtcgagtggcgactacagtgagcgtgggtcccgccgtaggcctccgaaggggaacgggcccgtagggagtcgggatccttacgtaactttatttagtagggttcggttcggtaaccccctacgtaactaaccgtaaaccacgtaacgaccgtcccggtagggaaaacgggggccctaacgttccaaccctattccgtaccaaggtaaaaccgaactaaacgttacccgaaaggaaccaaactagtttacgtactaccttaactaaaatgaaacttaaccgtaggaacgagacccggaacggaccaaccggcctaagtacgttaacttacgtgggttcggtacggggtctaacgtttacgtacggtaccccggtgggggtaccccgtaccgtcggaccgtacccggtccctacccccncccgtacccaccgtaacccgg

SEQ ID NO: 419275 - DNA, 809 bp, Homo sapiens
  misc_feature: GZ8MTXP02IPEX8.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctattcaaaaggtgtccagtgtgaggtgcagttggtggagacgtgggaggaggcttgatccagccgtgggggtccctgagctctctgtgcagtctcgtgggttcgtcagtggcgactacagtgacgcgtgggtcccgccgtaggccgtaccgaaggggaacggggtcccgtagggtaaggtgggtacttccgttaccttaacttttacgtttaagttaggtcgggttacgggtaaccccctaactacgtaactaacaacgtacggaacccttcccggggtaggtaaaccgggggccccgtaactttacccgaacccgtacgtttaccctaacgaaacggaaaacggaacctaaacgttccccggaaaaggtaaaaccctaccttaagtttacgttaactaccttaacaaaattacgtaaaaccgttaaaccctgggaccgtaagggacccgaaaggaccgaccggacctaagttacgttaactttacgtggttacggggtcggggtacttaaacgtttttaccggacgggttacccccggggtacggggggtcccccgggttaaacccgttccggggtaccccgtaacccccggtttcccacccccccggtaacccccttaccggaaaacccccggtaacccgggg

SEQ ID NO: 419276 - DNA, 642 bp, Homo sapiens
  misc_feature: GZ8MTXP02FN9CF.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctctgggttcgtcagtggcgactacatgagcgtgggtccgccgaggctccgaggggaacggcctagggagtggatctactaactttatttagagtggtcggtaaccccactataactacacaagtacctccgggtagaaacggggcctattccaacctatctacaagaaacgacaaattaccaaggaaacactattagtaatacttacaaatagaaataaccgtagaagacgaccggaacggaacacgggacctagtacgtaattacgtggtaggtcggggtctaaacgttttacctaccgggtaccccggtacggggggaccccggggtaacccgtggttacccgaccgttccctacccccgaccctccccaacggtaaacccgg

SEQ ID NO: 419277 - DNA, 640 bp, Homo sapiens
  misc_feature: GZ8MTXP02GA39O.21.78.H01.1.454.CMB.2.raw
  modified_base (328)..(328): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaagtgtccagtgtgaggtgcagttggtggagacgtggaggaggcttgatccaggccgtgggggtccctgagactctcctgtgcagtctcgtgggttcgtcagtggcgactacagtgagcgtcggggtccgccgaggctccggagggaagggcctggngtggatctactactttatttagtaggtggtcgtacccactatactacacacgactccggtagaacggggcctattcacctatctacgaagaacgaactaattaccgaacgaacactagttatactacttaacaaaatagtaaactaaaccgtgaacgaacggacggtaacggaccgaccggacctagtagttacttacgtggtggtgggtacttacgtttaacgtccgtaccccgggtcgggggacccgggtaacccgttcggtacccgtaacccgtccctacccccgaccctacccgaacccgtaacccgg

SEQ ID NO: 419278 - DNA, 751 bp, Homo sapiens
  misc_feature: GZ8MTXP02FI3GN.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcagtggcgactacatgagcgtgggtccacgaggctccgaaggggaacgggcctgggagtggatccgtactaacgttttattttaaacgtaggttcggggttacggtaacccccaactaacttaaccttaaaccacgtaacggtaaccctcccggggttagggaaacggggcccgttaattcccgaacctaaacttcctacaaagaaaacggaactaaaactttacccgaaacggaaaccaactagtttaacgtacttaaccttaactaaaacttacggaaaacttaaccgtagaggaaacggaccggaacggaaacgaccggacctatagttaacttacgtagggtggttagggggtacttacgtttaaccgttaccggtacccccgggttcgggggacccccggggtaacccggtaacggtaccccgtaacccgttccccgtacccccaccccgttaccccgaacccgtaaaccccggg

SEQ ID NO: 419279 - DNA, 661 bp, Homo sapiens
  misc_feature: GZ8MTXP02GYYLJ.21.78.H01.1.454.CMB.2.raw
  modified_base (312)..(312): a, c, t, g, unknown or other
  modified_base (633)..(633): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgacggccggtcgggggtccctgagtacttctccgtgtcgctagtctcgtggttcgtcgaggtcggcgactacatgagcgtcgggtccncgaggcctaccggagggaacggccgtaggagtggtactccgtactactttagtttagtaggtggttacggtaaccccagtactaactacaacacggtaccgtccggtaggaaacgggccgtaactccaaccgtactcgaacaagaaacgaactaagttacccaaaggaactaacgtatttagtaacttacttaactaaaagtcgaaaactacgtagacgtacgacgacgacacggacagttagtatcgtcggtggcggtatactttaccggcggtacccggtcgggggaccggtaccgtcgggtaccctaccggttacccnccccgtacctaccgaacccggtaaccgg

SEQ ID NO: 419280 - DNA, 634 bp, Homo sapiens
  misc_feature: GZ8MTXP02JED3U.21.78.H01.1.454.CMB.2.raw
  modified_base (333)..(333): a, c, t, g, unknown or other
  modified_base (381)..(381): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttgggtggagacgtgggaggaggcttgatccgagccgtcgggggtccctggagactctcctgtgcagtctcgtgggttcgtcgaggtggcgactacatagcgtcggccgccaggctccgaggggacggccgtggagtgntctctactttattagtgtggtacggtaccacatacacacagacctcgngacggcgtatccactatcacgaagaacactaacttaccgaagtaaaccactagttacgtattactaactaaatacgaaacttaacctaggacgaccggacggaagaccgacggacctagtcgttaatacgtggtacgggttcgggacttagtttaccgtcggacccggttcgggggaacccggttcctacggggaaccctacccggttcccctacccccgtaaccctacccggaaccggaaccggttcccccg

SEQ ID NO: 419281 - DNA, 712 bp, Homo sapiens
  misc_feature: GZ8MTXP02HQ8OW.21.78.H01.1.454.CMB.2.raw
  modified_base (448)..(448): a, c, t, g, unknown or other
  modified_base (511)..(511): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgctaggttggtggagacgtggaggaggtcttgactccgaggccgtcgggggtccctggacgactctcctgtgctagtctcgtggttactcagtcggcgactacatgagcgtcgggtccgccgaggtccgtaccggaaggggaacggtccgtaggaggtggtacttcgttacctacgttttaatttagtagttggtacggtaccccataacttacctacactacggactccgtaggaaacgggtcctattccgaactntactacagtaaacggaactaaacttcccgaaagtaaactaccgtattacgtacttaccttaanaaaacgttagtaaacttaaacccgtagaaacgtaaccggaccgaaaggaccgtacggacctagtaacgtattacgtaggttcggtaggggttactacgttttaacgtaccggtacccggtacgggggaccccgggttaccgtaacggtcccgtaaccgttccccaccccgtacccccgtacccgtaaccggtaaaccccgg

SEQ ID NO: 419282 - DNA, 746 bp, Homo sapiens
  misc_feature: GZ8MTXP02F3U0V.21.78.H01.1.454.CMB.2.raw
  modified_base (326)..(326): a, c, t, g, unknown or other
  modified_base (498)..(498): a, c, t, g, unknown or other
  modified_base (518)..(518): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggtagttttggctgagcgtgggttttccttgttgcttatttcaaaaggtgtccagtgtgaggtgcgtagttggtggagacgtgggaggaggcttgatccaggccggtgggggtccctgacgacttctccgtgtcgctagttcgtcgttgggttcgtcgaggtcggacactacagtgacggtcgtcggggtcccnccgtaggacctcgggaaggggtaacgggtccgtaggggtagtgggactcttactacgttttaattacgtaggttcggtacggtacccctaatacgtactaacgacaacgactcggtaggaacggggcctacgttccacgtatctacgaaagtacaactactacgaagtaacncgttattacgtataccgtanaaaagttcgaaaacgtaaccgttggaacgtaaccgggaacggaaacggacgacggtacctaagttacggtaaactttacggtggtttacggggtacgggtactttaaaccggttttaacggtacccggaccccgggggttacgggggtaccccgggtaaaccgttccggttaaacccgtcccgtacccctacccccgttaaccgtccccgaaacggttaaccccgggg

SEQ ID NO: 419283 - DNA, 754 bp, Homo sapiens
  misc_feature: GZ8MTXP02HB5F8.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcaggttggtggagacgtgggaggaggtcttgatccaggccgtgggggtcctgagactctcctgtgctagtctcgtgggttcgtcgagtggcgtactacatggagtcgtcggtccgcgaggctaccggaggggacggtccgtagggagtggacttccgtataactttagtttagtaggtcgggttacgtaaccccctactaactacctaccacgtaaccggaccgtccgggtaacgggtaaccgggtaccgtaacttacccgacgtacttaccgaaccgaaaggaaaccgtaacctaacgttacccggaaagtaaacctacgtatttacgtaacttaccttaagaaaaggtactaaaccgtacgtagaaaccgtcgaaacccgaggacccgaccgtactaagttcgttaacgttacgtggggtaggtaccgggttacttaaacggttttcccggacccggttacccgggggacgggggtacccccgggttaaaccgtccggttaaccctacccggtttccccctaacccccggtaccccctaccggaaacccgtacccggg

SEQ ID NO: 419284 - DNA, 656 bp, Homo sapiens
  misc_feature: GZ8MTXP02IUQGT.21.78.H01.1.454.CMB.2.raw
  modified_base (360)..(360): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtcctgagactctcctgtgcagtctcgtgggttcgtcagtcggcgactacatgagcgtgggtccgccaggctccgaggggaacggccgtggagtggatctctacttattatgtggtcgtacccanatacacacagactcgtagacggcctattccacatctacaagaaacgactaaacttcccgaaaggaaaccacgtaatttacgtaattaccgttaacaaaattcggaaaacttaaacccgtagaaacggacggtacccgaagggaccaaccgggcctaagttcgtattaccgtggtggtcggggtacttacttttaccggttaccgaccccgggttacgggggaccccgggtaacccttcgggtcccctaacccggtcccctacccccgacccgttaccccgaaaccgtaaccccggg

SEQ ID NO: 419285 - DNA, 670 bp, Homo sapiens
  misc_feature: GZ8MTXP02FRCPH.21.78.H01.1.454.CMB.2.raw
  modified_base (298)..(298): a, c, t, g, unknown or other
  modified_base (406)..(406): a, c, t, g, unknown or other
  modified_base (411)..(411): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagctctcctgtgcagtctcgtgggttcgtcagtggcgactacatgagctagggtccncgaggcctccgaggggaacggcctggagtggatcctctactttattagtaggtggtacgtaccccactatactacacacgactccgtagacgggccgtattccactancctanagaaacgacaacttacgaagaacacgtatttagtactacttaacaaaatagtaaaactaccgtaggaacgtaccggaccggaaaggacccgtaccggacctaagtttacgtaagtttaccgtagggtttggtaccgggggtattaacggttttaccgtacggtaacccccggggttcggggaacccccgggggtaacctccgggtacccgtaccccgtacccgtccccccgtaacctacccccgaaccggtaaccccgg

SEQ ID NO: 419286 - DNA, 635 bp, Homo sapiens
  misc_feature: GZ8MTXP02FUDHM.21.78.H01.1.454.CMB.2.raw
  modified_base (304)..(304): a, c, t, g, unknown or other
  modified_base (350)..(350): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtccctgagactctcctgtgcagtctcgtgggttcgtcgagtggcgactacatgagcgtgggtcccgcnggcctccgaaggggaacggcctggagtggatcgtcactttatttanagtggtcggtacccacatactacacagactcggtgaaagggccgtattccaacatcctacaagaaacgactaaattcccaaggaacaactattagtatactaacaaatacgaaataaccgtgagacggaccgaacggacgacgctaatgtaattacgtagtcggtggggtactacgtttaccgtcggtaccccgggtcgggggaccccgggtaaaccggttccggtacccgtacccgtaccccgtacccccctaaccccgtcccctaaacccggtaaaccccggg

SEQ ID NO: 419287 - DNA, 726 bp, Homo sapiens
  misc_feature: GZ8MTXP02F34UW.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagactggaggaggcttgatccagccgtgggggtccctgagactctcctgtgcagtctcgtggttcgtcagtggcgactacagtgagcgtcggggtcccgccgaggtcctaccggaagggggaacggggcccgtaggggaggttggggtaacttccgttacgtaactttttaagttttaaggtaggttggggttacggtaaccccaacgtaattacctaacaacaacggtaccttccgggtagggaaaccggggcccggttaaacttcccgaaacctattccgtaccgaaagaaaacgaactaaacttcccgaaagggtaaaccactaagtttagtacttacttacaaaagttacgaaattaaacccgtggaaacgacggaccggaacgaaccgaccggacctagtagtaattacgtgttagggtcggggtacttacgtttaacgtcggaccccgttacgggggcccggtaaacccgtgggtacccaccggtccctacccccgtaccgacccaccgtaaaccccggg

SEQ ID NO: 419288 - DNA, 650 bp, Homo sapiens
  misc_feature: GZ8MTXP02JDTPC.21.78.H01.1.454.CMB.2.raw
  modified_base (377)..(377): a, c, t, g, unknown or other
  modified_base (416)..(416): a, c, t, g, unknown or other
  modified_base (426)..(426): a, c, t, g, unknown or other
  modified_base (462)..(462): a, c, t, g, unknown or other
  modified_base (469)..(469): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttacaaaaggtgtccagtgtgaggtgcagttggtggagactggaggaggcttgatccgagccgtgggggtccctgagactctcctgtgcagtctcgtgggttcgtcagtggcgtactacatgacgcgtgggtcccgccgaggcctaccgaaggggtaacggcccgtggaggtggactccgtacacttatttagtagtggtgtaccccanatactacacgacgactccgtagaaggggcctatccgacntctacagaanacaaacttccaaggaacactagttatatccttaaanaaagtanaaactactagaagacgaccgaaggaccgacggtacacgtagttaacgttagtggttcggttacgggtacttaacgtttaccgttaccggaccccgggttaccgggggacccggtaacccggtccggtacccgtaaccccgtccccgtacccccgtaccccgtacccgaaccggtaacccgg

SEQ ID NO: 419289 - DNA, 758 bp, Homo sapiens
  misc_feature: GZ8MTXP02F5E2Q.21.78.H01.1.454.CMB.2.raw
  modified_base (555)..(555): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttacaaaaggtgtccagtgtgaggtgctaggttggtggagacgtgggaggaggcttgatccaggccgtgggggtccctgacgactctcctgtgcagtctcgtgggttcgtcagtggcgactacagtggacgtcgtcgggtcccgccgaggcctccggaagggggaacggggtccgtaggggtaggtgggtactacctactaacttttaagttttaacgtaggggttacgggttacggtaaccccctaactaactaacctaacctaacgacgtaccgttccgggacggaaccggggtaccgtaactttacccgaacctactccgtacgaaagtaaacgaaacctaaacgttacccgaaagtaaacacttaagtttagtacttaccgtaanaaaagttataaaagtaacccgtggaacgacggaccgaaggaccgtacggccttaagtacgttatacggtggttacgggttcgggacttacgttttaccggcccggtaccccggggtacgggggaccccggtaaacccgttccggtacccctaacccccggtccctacccccccgtacccgtacccggaacccgtaaccccggg

SEQ ID NO: 419290 - DNA, 736 bp, Homo sapiens
  misc_feature: GZ8MTXP02HNC82.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagacgtgggaggaggtcttggatccaggccggtcgggggtccctgacgactctcctgtgctagtctcgttgggttcgtcgaggtggacgtactacagtggacggtccgtcggggtcccgccgagggcctaccggaaggggacgggccgtgggtacggtggactcgttactactttatttagtaggtcggtacggtaaccccacgtaactactaacacgacgactccgggtaggaacggtccgtacttaccgaaccatacctacaaagaaacgactaactacccgaaagaaaccatactttagtattacctaactaaaagtactaaacttaaaccgtagaacgaacgggaacccgaacggaaccgaccggtaacctagtttaccggttaaagttcggttaaggttcggggtacggggttacttaacgtttttacggtacccgggaccccgggtacgggggtacccccgggtaaccgttcgggaccctacccgtttcccccaccccgtacccccgtaaccgtaaccgaaccccggg

SEQ ID NO: 419291 - DNA, 791 bp, Homo sapiens
  misc_feature: GZ8MTXP02FJLA2.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtggaggtgctaggttggtggagacgtgggaggaggcttgatccgagccggtgggggtccctgagactctccgtgtgcagtctcgtgggttcgtcaggtcggcgactacgagtggagcgtacgggtccgaccgacggccgtaccggaggggaacggccgtgggaggtggactcctctaacttttaagtttaagtaggttcgggttacggtaacccccaactaacttaaaccgtaaccaacgaacggtaacccgttaccggggtacggggaaaaccgggggtcccgttaacttacccaaacctactaccgtacgaaaacgtaaaacgaacctaaaacttacccggaaaggtaaaccaacctaagtttacgttaacttaccttaactaaaagttacgtaaaacttaaacccgtaggtaacgaaccgggaaccgaaacggaaccgaacggtaccgtaagttacgttaactttacgtggtacggttacggggtacttaaacgttttaccgtaccgggtaccccgggtacgggggaccccggggtaaccctcgggtaccccgtacccgtaccccgacccccttaaccccgacccgaaacccgtaacccggg

SEQ ID NO: 419292 - DNA, 822 bp, Homo sapiens
  misc_feature: GZ8MTXP02G3WD3.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggtagttttggctgagtcgttgggttttccttgttgcttatttacaaaaggtgtccagtgtggaggtgctaggttggtggagacgtgggaggaggtcttgactccgacggtccgggtcgggggtccctggacgtaccttcctccgtgtgctagttctcgttgggttcgcgtaggtcggacgaactacgagtggacggtccgtcggggtccccgccgacgggtccgtaccgggaagggggaaacggggtccgtagggaggttcgggtattccgttacttaactttaagttttaagttagggttacgggttacggtaaacccctaaccgtaattaaccgttaaaccaaccgtaacgtacccgttccggggttaacgggaaaccgggggtcccgttaacttacccgacctaagttaccctaacgaaacggaaacggtaaactaaacgtttacccgaaaggaaaacctacctaagtttaagtacttacttaacctaaaatgtaaaactaaccgagaacggacgaacgacggtaccgacggactaacgtagttaacgtacgttggtacggttacggggtactttaaacgtttcccgtaccggggtaccccgggtacgggggtaccccggttaacggtccggtaacccgtacccgttccccaacccccgtaccccgtacccgaaccgtaaccccggg

SEQ ID NO: 419293 - DNA, 720 bp, Homo sapiens
  misc_feature: GZ8MTXP02IZRYI.21.78.H01.1.454.CMB.2.raw
  modified_base (245)..(245): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgcttatttcaaaaggtgtccagtgtgaggtgctagttggtggagacgtggaggaggcttgatccagccgtgggggtcctganactctcctgtgcagtctcgtggttcgtcgaggtggcgtactacatggagcgtcgggtccgccgacggctccggaggggaacggtccgtggtacggtggtactcgttctactttaagtttagtaggtcgggttacggtaacccctactaactaactacacacgtacctccgggtaggaacgggtaccgtacgttacccaactacttactaccgaaagtaaacgtaaacctaaaccgttcccgaaaggaaacctacgttagttacgtaattaccttaaagaaaagtaacgtaaaacttaccgagaaccggtaggaccccggaagtacccgacggtacctaagtgttactacggtggtcgggtacgggacctttgtttaaaccggccggtaccccggggtaacgggggtcccggtaaacgtcggggtaacccctcgggtacccccttacccgaccccttaccgaaacggttaccccgg

SEQ ID NO: 419294 - DNA, 710 bp, Homo sapiens
  misc_feature: GZ8MTXP02JW02R.21.78.H01.1.454.CMB.2.raw
  modified_base (510)..(510): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtgagacgtggaggaggcttgactccgagccgtgggggtccctgagactctctgtgctagtctcgtgggttcgtcgaggtggcgtactacagtgagcgtcgggtccaccgaggcctacggagggaacggcgtaggagtggatcctagtactttagttagtaggtggtacggtaacccctactaacgtacctaacaccgtaacgactacccgggtagggaaacgggtcccgtattcccaactactactacgaaagaaacgtactaaacgtacccaaagggtaaacacgtactttacgtaactaccgtttaaaanaaagtacgtaaacgtacgtagaacggacgaaccgaacgaaccgacgtactagttacgttaacttggtacggttacgggtacggtaactttaccgttaccgggtacccgggtacccgggggtaccgggggtaacccggtaccgtcccggtacccgtaccccgtaccccgtaccccgaccgtaccccgtaacccgaacccgg

SEQ ID NO: 419295 - DNA, 829 bp, Homo sapiens
  misc_feature: GZ8MTXP02GZTJE.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgctatttcaaaaggtgtccagtgtgaggtgctagttggtggagacgtggaggaggtcttgactccgagccgtcgggggtccctgacgactctcgtgtgctagtctcgtggttcgtcaggtgccgatacgatgacgtcgtcgggtcccgccgaggtcccgtaccggaaggggaacgggcccgtagggtacggtgggtaacttccgttacctaacttttagtttaacgttagggtcgggttaccggtaacccctaactaacttaacctaaccaacgtacggaacccgttcccgggtacgggaaacggggcccggtaactttacccgaacctaacgttcccctaaagaacgggtaaaactaaccgttaaacgttacccgaaaaggtaaacctaccttaagtttacggtacttaaccctttaaaacaaaacgttaacgtaaaaaccttaccggtaaggaaccggaaccgggaacccgtaaacggaacccgtaaccggtaacgtaagtttaagttaacgttacggttgggttacggggtacggttaactttaaccggtttaccggtaccccgggtaccccgggggtacgggggtaccccggttaacccgtccggtaccccgtaccccgtccccctacccccgtaacccctacccggaaacccggtccccgg

SEQ ID NO: 419296 - DNA, 771 bp, Homo sapiens
  misc_feature: GZ8MTXP02FSY2C.21.78.H01.1.454.CMB.2.raw
  modified_base (309)..(309): a, c, t, g, unknown or other
tcagtcgtcgctcgcacgaccggtgctcgatttagtgtgagtagtttgggtttgggggggagaggagcccagcactgggattccgaggtgtttccaattcggtgatcagcactgaacacagaggactcaccatggagttttggctgagctgggttttccttgttgctatttacaaaggtgtccagtgtgaggtgctagttggtggagacgtggaggaggcttgatccagccgtggggtcctgagactctcctgtgctagtctcgtgggttcgtcgaggtcggacgactacagtgagtcgtcgggtcccnccgaggcctcggaggggacggtccgtggaggtcggtattccgtactaacgttttaagtttagtaggttgggtacgtaacccctaactaactactaacgacgaacgtacccgtccgggtaggaacggggtacccgtaacttccaacctatacctacgaagtaaacgaaccgtaaacttaccgaaacggaaacaccgttaagtttaacgtaacttaccgtaaactaaaagtacgtaaaaacttaaccgtaggaaacgaccgggaacccgaaacggacgtacccgggtacctaaagtttacgttaaacgtttcggtacgggttaggtacggggttactttaaccggttttacggtaccccgggtaccccgggtaccggggggaccccggttaaacccgcggttacccccgtacccgttacccccgtaccccccgtaaccgttaacccggacccggtaaaccccgg

SEQ ID NO: 419297 - DNA, 842 bp, Homo sapiens
  misc_feature: GZ8MTXP02GUJ8D.21.78.H01.1.454.CMB.2.raw
  modified_base (268)..(268): a, c, t, g, unknown or other
  modified_base (319)..(319): a, c, t, g, unknown or other
  modified_base (787)..(787): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgcttatttacaaaggtgtccagtgtgaggtgcaggttgggtggagacgtgggaggaggtcttgactccgacggccggtcgggggtccctgacgcctcctcctgngcagtctcgtgggttctgagtggcgactacagtgacgtcggtcgggtaccnccgaggcctaccgggaagggggaacggccgtaggggaggtcggtacttccttcttaacgttttaagttttagtaggttcggggttacgtaaacccctactaacttaacctaaaccgactaacggtacccgttcccgggtagggtaaccgggggaacccttaattacccaacccgtaagttacccctaagaaaacgaaaacgtaacttaaaacgttacccggaaaagggtaaaccccaacttaagttttaacggttaaacttaccttaaaactaaaacgtacgtaaaaaaccgtttcccgaaaggggaccaacggggacccgaaacgggaaccggtacccggtaaaccgttagttaccgtttaaagtaccggttgggtagggttaacggggtactttacgtttaccggttaacccggtccccgggggtaccgggggtaccccggggttaaaccctcgggttaacccccnccccggtttaccccacccccccgtaacccgacccccgtaaaccggtaacccccgg

SEQ ID NO: 419298 - DNA, 636 bp, Homo sapiens
  misc_feature: GZ8MTXP02IGY4O.21.78.H01.1.454.CMB.2.raw
  modified_base (305)..(305): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtccctgagactctcctgtgcagtctcgtgggttcgtcaggtggcgtactacagtgagtcgtggggtccnccgagggcctccgagggaacggcctaggagtgggactcgtactacttatttacgtagtggtacgtaccccatatactacacacgaccttccggtaggaacgggtccgtattccgaacctatctacaagacgaacaacttacgaagacactaattgtatcttacaaatagaaacttaaccgtagaagagaccgaggaacgacgacctagttagtaacttacgtgtaggtcggggacttattttaaccgtcggtacccggtccgggggtaccgggtacccgtccggttaccaaccggtccctaccccctacccgttaccaacggtaaccccgg

SEQ ID NO: 419299 - DNA, 774 bp, Homo sapiens
  misc_feature: GZ8MTXP02FX499.21.78.H01.1.454.CMB.2.raw
  modified_base (262)..(262): a, c, t, g, unknown or other
  modified_base (295)..(295): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcgtagttggtggagacgtgggaggaggcttgatccaggccggtgggggtccctgacgactctctgtgcngtctcgtgggttcgtcgagtggcactacagtgngtccgtcggggtcccgccgacggctaccggaaggggaacggccgtggaggtggtactctactactttattagtagtggtacgtacccaactactaacgtaacacgaacgtacgtcccgggtaggaaacggggtacctaactttcccgaactacgttactaacgtaacggtaaacgtaaactaaacttaccgaaacggaaacaacttaattacgtaacttacgtaactaaaagtaacgtaaacgttaaacctaggtacgaaacggaccggaacggaacgtaccggaacctaagttacgttaacgttaacgtggttagggtacgggggtacctttaaacggttttacccgttaaccggggtcccccggttaaacgggggggtcccccgggtaaaccccggttaaccggtacccggtaaacccccggttcccccgtaccccccggtaccccctaaccccgggtaacccgtaaacccccgggg

SEQ ID NO: 419300 - DNA, 666 bp, Homo sapiens
  misc_feature: GZ8MTXP02JHDZ7.21.78.H01.1.454.CMB.2.raw
  modified_base (296)..(296): a, c, t, g, unknown or other
  modified_base (321)..(321): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttacaaaaggtgtccagtgtgaggtgcgagttggtggagacgtgggagggaggcttgactccgaggccggtgggggtccctggagactctcctgtgcgtacgtctcgttggttcgtctagtggcgactantgacgcgtcgggtccgcgaggtccncggagggacgggtcgtggagtggactcgtacgttactttagtttagtaggtggtacggtaaccccactaactaactacaacaacggtaccgtaccgggtagggaaacgggtccgtacgttaccaactactacctacgaagtaaacgaactaaacttccgaaagaacacttaagttcttaatacctaataaattaaagaaacttaaacgtaggacgacggacgaacgacgacgactagtgtaactggtggtggtacgggtacttaacggttcgtaccggcccgggtacggggacccggtaccgtcggtaccctaccggtccctacccgacctacccgacgacccgg

SEQ ID NO: 419301 - DNA, 624 bp, Homo sapiens
  misc_feature: GZ8MTXP02JDS6D.21.78.H01.1.454.CMB.2.raw
  modified_base (425)..(425): a, c, t, g, unknown or other
  modified_base (463)..(463): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgacgtacatgagcgtgggtccgcgaggctccgagggaacggccgtggagtggatcgtctactttatttactaggtggtcgtaccccagactactacacaacgactccggtagaaacggggccgtattccacctagtctacaggaanactaaattcccaagaaacactagtttactatacttaanaaagtagtaaactacgtagacgacggaccgaagaccgacgactagttacgtagttacgtggtacggtacggtacttaacgttacgtccggtacccggtacgggggacccggtacgtccggtccgtacccgtccctaccccgtaccctaccgaaccgtacgg

SEQ ID NO: 419302 - DNA, 791 bp, Homo sapiens
  misc_feature: GZ8MTXP02IT2NY.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtcgggggtccctgagactctcctgtgcagtctcgtgggttcgtcaggtcggcgaactacatggagccgtcgggtcccgccgaggtccctccgggaaggggaacgggtcccgtagggtacggtgggtactttcccgtaccttaaccgtttttaagtttaacgttacgggttgggtttaccggtaaccccccgtaactaacgttacctaaaccgtaacctaacggtacccgttcccgggttaacgggaaaccgggggtacccggttaactttccccgaaccgttaaccttccgtaaaccgaaggtaaaaccctaaaccgtaaacgtttcccggaaaacggtaaacaccgttaagttttacgtaacttaccgtttaacaaaagttccgtaaaactaaccgtagaacgaacgggaccgaacggtaccacggtacctaagtgttaactcgtgtcgggtacggtacttacgtttaccgtccggaccccggttacggggggccccggttaaccgtcggtacccgtaccccgtaccctacccccgaccctaccggacccgtaaacccggg

SEQ ID NO: 419303 - DNA, 678 bp, Homo sapiens
  misc_feature: GZ8MTXP02IXJ0A.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtcgggggtccctgagactctcctgtgcagtctcgtggttcgtcagtggcgactacatgacgcgtcgggtccgccgaggcctaccggaaggggaacggggtccctaggggaggtgggattccgtactactttagtttataggttggtacggtaaccccacgtaatacctaacacgacgtacctccgggtaggaacggggcccgtacttaccaccacttcctacgaaagaaacgaactaaacttaccgaaagaacctactatttacgtaacttaccttaactaaaatgtaaaactaccgtagaacgtacggaccgaaggacgacggacctaagttgttaactcgtaggtcggtagggtacttactttacggtccgtaccccggtacgggggccccggtaccttgggacccctccggtaccctcccccgacccgtcccgaaccggtaacccgg

SEQ ID NO: 419304 - DNA, 643 bp, Homo sapiens
  misc_feature: GZ8MTXP02H52R8.21.78.H01.1.454.CMB.2.raw
  modified_base (327)..(327): a, c, t, g, unknown or other
  modified_base (339)..(339): a, c, t, g, unknown or other
  modified_base (419)..(419): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccaggccgtgggggtcctgacgactctcctgtgcagtctcgttgggttcgtcgaggtggcgactacatgagcgtcggccgccgaggcctccggaagggaggccnggagtggatctntacttattaatggtgtacgtacccactaactactacactaagacctcgtaagggaaaggtccgtatacaccatcacgaanaacgacaataccaagaaacactaattgtattactaataaaatacgaaattaactagaaagacggaaccgaacggacacggactaagtgtaagttacgtgtcgggtaggggttccttaaagttttccgaccgttaccccggggaccgggggtacccgggtaacccgtcggtaccgtaaacccggtcccctacccccggtaaccccacccgaaacccgtaacccgg

SEQ ID NO: 419305 - DNA, 777 bp, Homo sapiens
  misc_feature: GZ8MTXP02JYE1J.21.78.H01.1.454.CMB.2.raw
  modified_base (335)..(335): a, c, t, g, unknown or other
  modified_base (365)..(365): a, c, t, g, unknown or other
  modified_base (642)..(642): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgcttatttacaaaaggtgtccagtgtgaggtgctagttggtggagacgtgggaggaggtcttgactccgaggccggttcggggggtccctggacgtactcctccgtgtgctagttcctcggttgggttcgtacgaggtcggacgtactatactggagtcggtcgggtaccncgtacggctacggaggggacggtcgtaggnggtacgacttctactaactttattaagttaggtggtacgtaaccccactactaactacacgtaacgacgtccgggtagaacggggtcctacgttaccacgtacttcgggtaaacaaagtaaacgtaacgtaaacgttaccgaaaaggtaaacctaaccgttagtttaacgttaaccttacttaaacgtaaaaacgttagaaaaaccttacggtaaggaaccgggtacgggaacccgaacggaacggaaccgtcgttaagtaacgttacgtttaacgnggggttaaccgggtggttaacctttcgtttaaaccgggccgggtacccccgggaccgggggtaacccgtaaccggtccggtaccctaccccggtacccctaacccccgcccgttaaccgaaccggttacccccgg

SEQ ID NO: 419306 - DNA, 725 bp, Homo sapiens
  misc_feature: GZ8MTXP02JGO14.21.78.H01.1.454.CMB.2.raw
  modified_base (300)..(300): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaggtgtccagtgtgaggtgctagttggtggagacgtggaggaggcttgactccgacggccggtcgggggtccctgagactctccgtgtgctagtcctcgtgggttcgtcgtaggtcggcgtactacgngtgacggtcgtcgggtcccgccgacggccgtaccggaaggggtaacgggtccgtagggacggtaggtactcctacgttactttaagtttagttagggtcggtacgtacccctactactaactacaacgacgtaccgtccgggtacggaaccggggcctacgttcccaactactcctacgaagaaacgactaaccttaccgaaagaactacgtattagtactctaaacaataagtaaactaacgtagaagaccggaccgaacggaccacggactaagttgtaactacgtgggtggtacgggttactacgtttaccgtacccggtaccccggggtacgggggtacccccggggtaaacccgttcggaccccgttacccccggtcccccaccccccgtaacccgtaccccgtaacccggtaaccccgg

SEQ ID NO: 419307 - DNA, 857 bp, Homo sapiens
  misc_feature: GZ8MTXP02H1U3J.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgctatttcaaaaggtgtccagtgtgaggtgcagttggtggagacgtgggaggaggcttgatccgacggtccgtgggggtccctgagactctcctgtgcagtctcgtggttcgtcaggtggacgactacatgagcgtcgggtccgaccgaggcctccggaaggggtaacgggccctagggagtagggtactccgttactaacgtttaacgtttaagtaggtcggttacggtaacccctaactaacgttaacctaacaacgtaacgtaaccgttccgggtaagggaaacgggtcccgtaactttacccgaaccctaattacccgtaacgaaaggaaaacgtaaaccctaaacgtttaacccgaaaacgggtaaaacctaaccgttaagttttaacgtaaaccgtttaccttaaaaccgtaaaaagtttacggtaaaaacctttaaacccggtaggtaaacgggaccggaacccgggaaacggtaaccgaaccgggtaccctaaagtttacggttaaacgtttaacggttcggttaggggttacgggggttaaacctttaaacggtttttaacccgtaccggggttacccccgggtttacggggggaacccccgggttacccgttaaccggggtaccctaaaccccgggttccccctaacccccgtaccccgttacccgaaacccggtaaccccggg

SEQ ID NO: 419308 - DNA, 782 bp, Homo sapiens
  misc_feature: GZ8MTXP02GJD10.21.78.H01.1.454.CMB.2.raw
  modified_base (300)..(300): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaggtgtccagtgtgaggtgctagttggtggagacgtgggaggaggcttgatccgagccgtgggggtcctgagactctctgtgcagtctcgtggttctcgagtggcgactacatgagcgtcgggtccncgaggcctcgaggggaggccgtggagtggactctctactttattagtaggtggtacggtaccccaacgtataaccgtacacgaacggtaccgtaccgggtaggaaaccggggtcctaacgttcccaaacctattcctaacgaaagaaacgtaaaccgtaaacttaccgaaacggaaaccaaccttagtttaacgtaacttacccttaactaaaattaggaaaaaccttaaaacccggttaggaaaacggtaaccgggaaacccgggtaacgggaaacccgaaccggggtaaccctaaagttaccggttaaagtttaacccggttagggttcggggtacggggtactttaacgttttaaccggttacccggggtaccccgggtaccgggggggtaacccccgggtaaacccggttcggtaaccccgtacccggttacccccgacccccctaccccgttaccccgaacccggtaaaccccgggg

SEQ ID NO: 419309 - DNA, 678 bp, Homo sapiens
  misc_feature: GZ8MTXP02G3MW7.21.78.H01.1.454.CMB.2.raw
  modified_base (284)..(284): a, c, t, g, unknown or other
  modified_base (326)..(326): a, c, t, g, unknown or other
  modified_base (443)..(443): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtcctgagactctcctgtgcagtctcgtggttcgtcagtggcgactacntgagcgtcgggtccgccgaggctccggagggacggccgtggngtggatctactactttagtttacgtaggtggttacggtacccctacgtactaacctaacactaacgaaccgtccggtaggaacggggtacccgtacgttacccacgtactccgtaanaaacggtaacgaaactaacgttacgaaacgtaacaaccgtattagttaactaccttaataaaatcgtaaaactaccgttagaacgacggaccgtaacgacgaccgactattacgtaacgtagtaggtggtcgggtacttactttaccggtcggaccccggtcggggtacccgggtaaccgtcggtcccgtaaccccgttcccaccccgtacccgtacccgaacccgtaacccggg

SEQ ID NO: 419310 - DNA, 696 bp, Homo sapiens
  misc_feature: GZ8MTXP02GN1W0.21.78.H01.1.454.CMB.2.raw
  modified_base (260)..(260): a, c, t, g, unknown or other
  modified_base (578)..(578): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttacaaaaggtgtccagtgtgaggtgcaggttggtggagacgtggaggaggcttgatccgagccgtcgggggtcctgagactctcctgtgcngtctcgtggttctcaggtcgcgactacatgagtcgtcgggtccgaccgaggcctaccggaaggggaacggccgtaggagtggactctactaactttatttagtaggtggtacgaccccgaactactaacctacacgtaacgtactccgggtagaacggggacctacgtaccaacctatcctaacgaaagtaaacgaactaaacgttacccgaaaagaaacctattaagtttacgtaacttactaaactaaaattcgaaaaactttaccgagaacgacggaccgaaaggtaccgacggcctaaagtcgtaagtttacgnggttacgggtgggaactttacgtttacggtaccggacccgggttacgggggccccggttaaccgtcggtacccgacccgttcccctaccccctacccgtaccgaaccggaaccccggg

SEQ ID NO: 419311 - DNA, 680 bp, Homo sapiens
  misc_feature: GZ8MTXP02FIVMN.21.78.H01.1.454.CMB.2.raw
  modified_base (257)..(257): a, c, t, g, unknown or other
  modified_base (305)..(305): a, c, t, g, unknown or other
  modified_base (453)..(453): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccgagccgtgggggtcctgagactctctgtgcngtctcgtgggttcgtcaggtggcgaactacagtgagcgtcgggtcccnccgtaggcctaccggaaggggaaacggtccgtagggaggtggtactccttcaacgttttatttaagtagtacgggttcggtaacccccactaatactaacacacgactccggagaacggggccgtatccacgtactctacgtagaaanactaacttcccgaagaaaccactaagttagttaactacgttaactaaaagtagtaaactaacgtagacgaacggacgaacgacgaccgacagtgttacgtacgtaggtggtagggtacttaacgtttaccgtaccggtacccccgggtcgggggaccccgggtaaccggtcgtacccgtacccgttccccgtacccccgtacccctaccccgaccgtaaccccgggg

SEQ ID NO: 419312 - DNA, 757 bp, Homo sapiens
  misc_feature: GZ8MTXP02FLPZU.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttacaaaggtgtccagtgtgaggtgcagttggtggagacgtggaggaggcttgatccgaggccgtgggggtccctgagacttctcctgtgcagtctcgtgggttcgtcgaggtggacgactacgagtggacgtcgtcggggtcccgccgagggccgtccggaggggaacgggccgtggagtggactctactacgtttatttagtaggtcggttacgaaccccactataactacacgtacgtacgtccggtaagggaacggggtcctacttaccaaccgtactcctaacgaacgaaaacgtaaaccgtaaaacttacccgaaaaggtaaacctaactaagtttacgttaacttaccttaaactaaaagttaaacggtaaaacctaaaccgtaggtaaacggaacggaaccggaacggaacgacccgggacttaagttagttaacgtttacgtaggttcgggtcggggtactttaacggtttaccgttaccgggtaaccccggggtcgggggtaacccccgggtaaccggttccggtaccctaaccccggttccccgtacccccgacccgtacccgaacccggtaacccggg

SEQ ID NO: 419313 - DNA, 616 bp, Homo sapiens
  misc_feature: GZ8MTXP02FSI4H.21.78.H01.1.454.CMB.2.raw
  modified_base (298)..(298): a, c, t, g, unknown or other
  modified_base (447)..(447): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtccctgagactctcctgtgcagtctcgtgggttcgtcagtggcgactacatgagctgggtcccncaggctccgagggaggcctggagtggatctcacttatttatagtggtcgtaccccactatactacacgaagactccgagacggggccattccacactcacaagaacacaacttacccaaggtaacactaattgtaatctacaaaagtanaaagtaacctggaacgacggtccgaaggacgaccggacctagttactaacttacgtcggtaggtcgggtacttagtttaccttacggtccccgtacgggggcccggtaaacccgtcggggtaccaccccggttaccctcccccgtaaccctcccgaaccgtaacccggg

SEQ ID NO: 419314 - DNA, 914 bp, Homo sapiens
  misc_feature: GZ8MTXP02FG5HW.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcaggttggtggagactggaggaggcttgatccgagccggtgggggtccctgagactctcctgtgcagtcttcgtgggttcgtcgagtggcgactacagtgacgcgtcggggtcccgccgaggcctccggaaggggaacgggccgtgggaagtgggacttcgtactaacgtttagttttaacgtaggtcgggttacggtaaccccctaacgtaactaacctaacctaacgacgtaacccgttcccgggtaacgggaaaacgggggtcccgtaactttacccgaaccctaatttcccgaacctaaagggaaaacccgtaaaccgtaaaactttaccccgaaaaggggtaaaacccaactaaacgttttagttaaacttaccctttaaacaaaaaacgtttcgtaaaaacgttaaaccccggttaaggaacgggaaacgggtaccccggaaaacggggtaaacccgacccggggtaaccctaaacgttaggttaaacgttttaccggtagggttacggggttaccgggggtaccttttaaaaccggttttaacccggtttaccggggtaaccccccccgggggtttacgggggggtaaccccccgggggtaaaaaccccccggtttccggggttaaaccccgttacccccccggttacccccgtaacccccccccggtaacccccgttaaccccccggtaaaccccggggtaaaaccccccggggg

SEQ ID NO: 419315 - DNA, 768 bp, Homo sapiens
  misc_feature: GZ8MTXP02HGCU9.21.78.H01.1.454.CMB.2.raw
  modified_base (273)..(273): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggagggaggcttgatccaggccgtgggggtccctgacgactcctctgtgcagtctcgtgggttcncaggtggcgactacatgacgtcgtcgggtccgaccgtaggcctaccggaggggaacgggcccgttgggaaggtcgggtaattcccgttacgtaaaccttttacgttttaagtagggttcgggttacggttaacccccgaactaacttaacccgtaacctaacgaaccggttaccgtccccggggtaggaaaacgggggtccccgtaaatttcccgacctaaattccgtaaccgaagaaaacgttaccaaacggttccccaaaggggaaacctactagtttacggtaaacttaccttaacgaaaatttcgaaaacttaaccgtgaaacgtaccgaccggaacggaaccacgggacctaaggttagtaagttaaccgtggttccgggtaggtacttacgtttaacggtccgggtacccccggtagggggtaccccggtaacccgtcgggttaccaccccggtaccctaccccaccccggtacctaaaccggcccggg

SEQ ID NO: 419316 - DNA, 633 bp, Homo sapiens
  misc_feature: GZ8MTXP02IIJ1Y.21.78.H01.1.454.CMB.2.raw
  modified_base (333)..(333): a, c, t, g, unknown or other
  modified_base (474)..(474): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgcttatttacaaaaggtgtccagtgtgaggtgcgagttggtggagacgtgggaggagcttgatccagccgtgggggtcctgagctctctgtgcagtctcgtggttcgtcgagtggcgactactagtgacgtcgtcggtcccgccgaggcctcggagggacggccgtaggngtaggctctactactttattacgtggtggtacgtaccgactactactacacgacgacctcggacgaacgggcctacttccactactactaccgaagaactaacgtaactacgaagaacacttagttagtaacttacctaanaaacgttcgtaaaatacgtagacgacgtaacccgagaaccgtcgactagtcttaagtacgtggtacgtacggtcttacgtttccgaaccggcccggtaccggggtaccggtaccgtcggtcccaccgttcccacccctacccgtaccgaccgtacccgg

SEQ ID NO: 419317 - DNA, 920 bp, Homo sapiens
  misc_feature: GZ8MTXP02H6MU0.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggagggaggcttgatccagccgtgggggtccctgagactctcctgtgcagtctcgttgggttcgtcagtggcgactacatgacgctcggggtcccgccagggcctaccggaggggaacgggcccgtgggacgtgggtacttccgtactaactttaattttaagtagggttagggttacggtttaaccccaacgtaaacttaaaccttaaccgaacgtaaaccggtacccgtttaccccgggggtagggaaaacccgggggtacccccggttaaacctttaccccgtaacccgtaaactttcccgttaaacccgtaaaggaaaaacccggtaaacctaaaaacgttttacccccgaaaagggggttaaaaccccaaacgtttaaacgtttacggttaaactttacccgtttaacgtaaaaaacctttaaaggtaaaacccgtttaaaaaccccgttggggtaaaaccggtaaacgggggaacccccggtaaaacgggggaacccgtaaacccggggaaccccttaaacgtttaaggttaaacgtttaccggttagggtttacgggggtacggggttaaccgttaaaccgtttttaacccggttaccggtacccccgggggtaccgggggtcccggggtaaaccccgtcggtaccccgtaaccccggttcccctacccccggtacccttacccccgaaccggaaaccccgggg

SEQ ID NO: 419318 - DNA, 638 bp, Homo sapiens
  misc_feature: GZ8MTXP02GACQT.21.78.H01.1.454.CMB.2.raw
  modified_base (299)..(299): a, c, t, g, unknown or other
  modified_base (362)..(362): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctcctgtgcagtctcgtgggttcgtcaggtggcgactacagtgagcgtgggtccnccgaggctccgagggaacggcctggagtggatctcactttattacgtagtggtagtacccacntactacacagactccgtgaacggccgatcgacatctagagtaacgacaaagttccaaggaaacacgtaattgtaatcttaacaaattagaaattaaccctggaagacgacggaacggacgaccggacctattacgtaatttaccgtaggttcggtacggggtacttaacgttttacgttaaccgggaccccggttacgggggcccgggggtaaacccgtggtaccctaacccggtcccgtaccccccgtaccctaccccgaacccgtaaacccggg

SEQ ID NO: 419319 - DNA, 700 bp, Homo sapiens
  misc_feature: GZ8MTXP02HDVT2.21.78.H01.1.454.CMB.2.raw
  modified_base (614)..(614): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtgggggtccctgagactctcctgtgcagtctcgtgggttcgtcgagtggcgactacatgagcgtcgggtccgccgaggcctccggaaggggtaacggcccgtagggaggttcggacttccgttacgtaactttagtttaagttaggtgggttacggtaacccctaacgtaactacctaacaacgaacgtaccgttccggtacggaaacggggtaccgtaacttaccgaacctattacctaacgaagaaaccgaactaaacgttaaccgaaagggtaaacctaccgtaatttacgtaacttaccttaaagaaatacgtaaacttaaccgtagaacggacgacccggaagaccaccggtacagtacgttatacgtgtggacgggtnttacgtttcgaccggtacccggtcgggggacccggtaacctggtcccacccggttcccaccccgtacccgtaccgaccgaacccgg

SEQ ID NO: 419320 - DNA, 658 bp, Homo sapiens
  misc_feature: GZ8MTXP02H5ELQ.21.78.H01.1.454.CMB.2.raw
  modified_base (409)..(409): a, c, t, g, unknown or other
  modified_base (420)..(420): a, c, t, g, unknown or other
  modified_base (440)..(440): a, c, t, g, unknown or other
tcagtcgtcgctcgcacgaccggtgctcgatttagtgtgagtagtttgggttttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtggggggtccctgagactctcctgtgcagtctcgtgggttcgtcagtggcgactacatgagctgggtcccgccaggctccgaaggggacgggcctggacgtgggactcgtctaactttatttataggtggtcgtacccactataactacacagactccgtagaacggccgacttccaacntctacaagaanacaactccaaggaaacctanatttcgtaatccttaagaaaactggaaataaacccgttagaacgaggaccgacggaactacggacctaagtgtaattacgtggttggtacggggtatacgttttaactaccgggtacccccggtacggggggtacccggggaaacccccgttggggacccctaacccggtttcccccaccccctaacccccgttaccgaaaacccccgtaacccgggg

SEQ ID NO: 419321 - DNA, 785 bp, Homo sapiens
  misc_feature: GZ8MTXP02I8TRI.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggagcttgatccgagccgtgggggtccctgagactctcctgtgcagttctcgtgggttcgtcgagtgcgactacgatgagctgggtccgccaggctaccggagggaaggccctaggagtgggaacttcgtactaacgtttagtttaacgtacggttgggtacgtaacccccgtaccgtaacttaaccgtaaaccgacgtaacgtaacccggtttccccgggaaaggggtaaacccggggtacccgttaccttaacccgaaacccgtaaacgtttccccaaagaaaacggtaaaaacggaaaacccctttgaaaaccgtaaacccgtaaaccgacaaacgtaacgtaacgttacgttaacgttaaacgttaaacgtaaacgtaaacgtaaacgtaaccgaacggacgaacggaccggaacggaaccgtaccgtacgtacgtacgttacgttacgtacgggtacggtacggtaccgttacgttacccgtacccgggtacccgggtacccgggtaacccgggtacccggtacccggtacccgtaccccgtaccccgtaccccgtaccccgtacccg

SEQ ID NO: 419322 - DNA, 852 bp, Homo sapiens
  misc_feature: GZ8MTXP02FPFT1.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttacaaaggtgtccagtgtgaggtgcagttggtggagactggaggaggcttgatccagccgtgggggtccctgagactctcctgtgcagtctcgtgggttcgtcaggtggcgactacatgagcgtcggggtcccgaccgagggcctaccggaagggggaaacggggtcccgtaggggaggttcgggattcctactaacttttaattttaagtaggttggggtacggtaaccccccaacgtaactaacctaaccaaccaacggtaccttccccgggtagggaaaccgggggacccgtaactttacccgaaccctaattcccttaaccgaaacggtaaaacggtaaaccctaaaacctttaccccggaaagggtaaaacccaaccttaaagttttacgtttaaactttacctttaaaccgtaaaaaacgttaaacggtaaaaacttaaaccccgtaggaaaccgggaaacgggaacccggaaccgggaaccgaaccgggtaaccctaagttagttaaactttacgtgggttagggttcgggggtacttaaacgttttaaccgttaccgggtacccccggggtaccggggggacccccgggggtaaaccccggttcgggtaccccgtacccccggttacccctacccccccgaacccccgtaacccccgaacccggaaaccccgggg

SEQ ID NO: 419323 - DNA, 636 bp, Homo sapiens
  misc_feature: GZ8MTXP02HYJJY.21.78.H01.1.454.CMB.2.raw
  modified_base (256)..(256): a, c, t, g, unknown or other
  modified_base (286)..(286): a, c, t, g, unknown or other
  modified_base (463)..(463): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagccgtgggggtccctgagactctcctgtgcngtctcgtgggttcgtcaggtggcgactacntgagcgtcgggtccgcgaggcctaccggaggggaacggccgtggagtggactctctactttattagtaggtggtacggtaccccatactacacacagacctcggtaggaacgggcctacttccacctatcctacgaagaacgactaatacccgaagtaacactattgaacttctaanaaatgaaacttaccgtagagtacgaccgagaccgacggtacagttagtaactacgtaggtcggtacgggtacttaacgtttccgtaccggccccggtacgggggacccccggtaccgtcggtcccctaacccggtcccctacccccgtacccctccgtaaccggaaccccggg

SEQ ID NO: 419324 - DNA, 728 bp, Homo sapiens
  misc_feature: GZ8MTXP02JVYJC.21.78.H01.1.454.CMB.2.raw
  modified_base (532)..(532): a, c, t, g, unknown or other
  modified_base (612)..(612): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttacaaaaggtgtccagtgtgaggtgcaggttggtggagacgtggaggaggcttgatccgaggtccggtcgggggtccctggacgactctcctgtgctagtcgtcgttgggttcgtcgaggtggacgtactacagtgagtcgtcgggtcccgccgtaggcctaccggaggggacggccgtaggacgtggactctactactttatttaagtaggtcggttacgtaaccccgataactactaacctaacgacgacgttccggtagggaaacggggccgtagttaccaacctactactacgaaagtaaagtacctaaacgttaccgaaaggaaaccctaatagtttatacttaccgttaagaaaaagtnaaaacgttaccaggaacgacgggaccgaacggtaccgaacgggtactagttagtaacgttatggggttcggtacggggtnttaaacgtttcggttaacccgggcccggggttaaacgggggtccccggtaaccgttcgggtaccctaacccgggttccctaccccccgacccgtttaccgaaacccgaaccccggg

SEQ ID NO: 419325 - DNA, 659 bp, Homo sapiens
  misc_feature: GZ8MTXP02F6P36.21.78.H01.1.454.CMB.2.raw
  modified_base (273)..(273): a, c, t, g, unknown or other
  modified_base (328)..(328): a, c, t, g, unknown or other
  modified_base (356)..(356): a, c, t, g, unknown or other
  modified_base (369)..(369): a, c, t, g, unknown or other
  modified_base (378)..(378): a, c, t, g, unknown or other
tcagtcgtcgctcgcacgaccggtgctcgatttagtgtgagtagtttggggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtggggggtccctgagctctcctgtgcagtctcgtgggttacgtnagtggcgactacatgagcttgggccaccaggctcgagggaggctggagtggatcnctacttattagagtggtagtacccccanactactacacganacctccggngaacgggccgtaattccaactattacctcgaagaaacgaacaacgttaccaaggaaaccactaggttaactatacctttaaactaaatagaaactacgtagacgacgaccggaacgtacgacgtacgtacgttagttacgttacgtaggtcgggtacgggtacttaacgtttaccggttaccggtacccggggtaccgggggtaacccggggtaacccggtaaccggtacccgtacccgtaccccgtaccccgtaccccgtacccgtaacccgtaacccgg

SEQ ID NO: 419326 - DNA, 625 bp, Homo sapiens
  misc_feature: GZ8MTXP02FVF12.21.78.H01.1.454.CMB.2.raw
  modified_base (383)..(383): a, c, t, g, unknown or other
  modified_base (397)..(397): a, c, t, g, unknown or other
  modified_base (401)..(401): a, c, t, g, unknown or other
  modified_base (405)..(405): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccaggccgtgggggtccctgagactctcctgtgcagtctcgtgggttcgtcagtggcgactacatgagcgtgggtccgcgaggctccgaggggacggccgtggagtggactctcactttattacgtagtggtcgtaacccacatactacacagactccgngaacggctatcacntcanaganacaatcaagaacactattgtatactacaaaatgaaataacctagacgacgacggaacggaccgaacggcctaagttacgtaacgttacgttggtaggttacgggggtctaacgtttaccgttaccggtacccccggtacgggggaccccggggtaacccgtccgggtaccgtacccggtcccaccccccgtacccgtaccccgaaacccgtaaacccggg

SEQ ID NO: 419327 - DNA, 637 bp, Homo sapiens
  misc_feature: GZ8MTXP02G4OWX.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcaggttggtggagactggaggaggcttgatccagccgtgggggtccctgagactctcctgtgctagtctcgtggttcgtcgaggtggacgactacatgagcgtcgggtccgccgaggcgtccggaggggaacggccgtggaggtggactctactactttatttagtaggtggtacggtaaccccactatactacactagactcggtgaacgggcgacttcacatctacagaaactaacaactaccgaagaacactattagtactacttaacaaatacgtaaactaacgtgaacgacggacgaacggacacggtacagttagttattacgtggttacggtggggtacttacgtttaccgttacccggacccggggtcgggggacccgggtaaccgtcggtaccgtaccccgtccctacccccacccgtacccgaaccgtaaccccgg

SEQ ID NO: 419328 - DNA, 694 bp, Homo sapiens
  misc_feature: GZ8MTXP02F3ERL.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagccgtgggggtccctgagactctctgtgcagtctcgtgggttcgtcgaggtggcgacgtacatgagtcgtgggtccgccgaggcctaccggaaggggaacgggtccgtgggaaggtggacgttctacttaactttaagtttagtaggttgggtacggtacccctaactataacctaactaccgaataccgtccggtaggaaaccggggaccgttacgttacaaccatactcgaaagaacgaaaccaaacgttccaaagggaaaaccactaagtttacgtaattaccctaactaaaatagtaaaactaacctggaaacgacggaccgtaaagacgacggacctaagtcgtaattacgaggttcggagggtacttacgtttaccgttcgggacccccgtagggggcccccgtaaccgtggtaccccctacgtaccccctaccccgaaccctccgaaacccgtaacccggg

SEQ ID NO: 419329 - DNA, 699 bp, Homo sapiens
  misc_feature: GZ8MTXP02HCB6R.21.78.H01.1.454.CMB.2.raw
  modified_base (307)..(307): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccagccgtggggggtccctgagactctcctgtgcagtctcgttcgggttcgtcgaggtggcgactacatggagcgtggggtccnccgtaggcctccgaggggaaggtcctagggagtggatctctactttattatggtggtgacccatatactacacagactcggagaacgggcctattcacgatctacaagaacgacaattcccgaaggaaactactaagtttcgtaaacttaccttaacaaaagtacgaaaactttaaaccgaggaacgaacggacccgaagggaacccacggggacctagttacgttaagtttaaccgtgggtaggggtacggggtactttaaacggtttacccgtaccgggtacccccggggttacggggggaccccggggttaaacccgtcggggttaccccgaccccgggttacccctaccccccgaaccccgttacccgaaacccggtaaacccccggg

SEQ ID NO: 419330 - DNA, 753 bp, Homo sapiens
  misc_feature: GZ8MTXP02FQBXR.21.78.H01.1.454.CMB.2.raw
  modified_base (280)..(280): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctgagactctctgtgcagtctctgggttcgtcagtgcgactacntgagcgtgggtccgccaggctccgaggggacggcctaggagtggatcgtctactttattagtaggtggtacggtaccccatactaacaacacacgacctccgggtagaaacggggcctattccaacctaattcctaacgaagaaaacgtaccaaaactttcccgaaaggtaaaccacctagtttagtaacttacctaacgggtaaaagttaccgtaaaagtttaaaacccccgtaggaaaccgtaaccgggaaacccggtaaaccgggaaacccgttaacccggtaccttaagtttaacggtttaaacgttacggtaggttacggggtacgggtaacctttaacggtttaccgtacccggggtacccccggggttacgggggaacccccgggtaaccgtccgggttaacccccgtacccccggttacccccgtaccccccgtaaccccgtaccccggtaaacccggtacccgg

SEQ ID NO: 419331 - DNA, 747 bp, Homo sapiens
  misc_feature: GZ8MTXP02IJBFD.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgctatttcaaaaggtgtccagtgtgaggtgcgtaggttggtggagacgtggaggaggtcttgactccgacgtccggtcgggggtcctggacgtactctcgtgtcgctacgtcgtcgttggttcgtcgtaggtggcgtaactacagtagacgtcgtcgggtccgaccgaggccgtaccggaaggggtacggccgtaggacggtaggactttacccgtacgttaaacttttaagtttaagtaggttacgggttacgtaaccccaaactaacgtacgtaaccaacgtaccgtaccgtaccggtagggaaacgggaccgttacttacccgtaacctaattcctaacgtaaagaaaacgtaactaaacgtaccgaaaacggtaactaactattaagttacttacttaacgtaaaagtacgtaaacttaacgtaagacgacgtaacccggagaaccgacggtacacgttagtatacgtggtcgggtacggtacttactttaacgtcccggtacccgggtaccggggtaccgtaccggtaaccgtacccgacccgtaccctacccgacccctaacgacccggtaacccgg

SEQ ID NO: 419332 - DNA, 743 bp, Homo sapiens
  misc_feature: GZ8MTXP02F086U.21.78.H01.1.454.CMB.2.raw
  modified_base (308)..(308): a, c, t, g, unknown or other
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgctagttggtggagacgtgggaggaggcttgatccaggccgtgggggtccctggacgtactctcctgtgcgagtctcgtgggttcgtcgagtggcgactacagtgagcgtgggtcccnccgaggcctaccggaaggggaacggccgtagggagtgggacttctctaactttattacgtaggtcggtggtaaccccacgtataactacacgtacgacgtccggtacgaaacgggggtcctaacgttaccgtaacctagtcctacgaacgtaaacgaactaaacgttacccgaaagggtaaccaacgtaacgtttacgtacttaccttaacgtaaaacgttaacgaaaacttaaaccgtacgtaaacggtaaccgggaaccggtaacggaaccgaccgggaccgtaagtacgttaagttaacgtggtacggttacgggggtaccttacgtttaccgtacgggtaccccggttacgggggaccccgggtaaaccgtcggttacccgtacccggttacccccgtcccctaccccgttacccgaccggtaaaccccgg

SEQ ID NO: 419333 - DNA, 715 bp, Homo sapiens
  misc_feature: GZ8MTXP02I6UT3.21.78.H01.1.454.CMB.2.raw
  modified_base (293)..(293): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgcttatttcaaaaggtgtccagtgtgaggtgctagttggtggagacgtggaggaggcttgactccaggccgtcgggggtccctgacgactctcctgtgcagtcgtcgtgggttcgtcaggtggcgactacntgagtcgtcgggtcccgccaggtcctccggaagggaacgggccgtagggaggtggacttccgtctaactttattagtagtgggtagtaccccagtatactaccacgagccgtccggtgaacgggcctagttaccaccctagtctacgaagaacgactaaacgttacccaagggtaaacactagtttcgtaacttacttacaaaagttggtaaactaaccgttagaacgacggaccgacgggaccacgggacctagttacggtaactttacggtggttagggtacggggtacttaacggttttaccggtaccggttaccccgggtacggggggaccccggttaacccggttcggtaaccccgtacccggttcccccgtaaccccccgtaccccgttaccggtaaacccccggtaaccccgggg

SEQ ID NO: 419334 - DNA, 818 bp, Homo sapiens
  misc_feature: GZ8MTXP02FJ4R2.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttacaaaaggtgtccagtgtgaggtgcaggttggtggagacgtggaggaggtcttagactaccgacggccggtcgggggtccctgagaccttctcctgtgcgtagttccgttcggttcgggttccgtcgtaggtcggcgaacctacagtggacggtccggtcggggtcccgccgaacgggtcctaccgggaagggaacggggccgtagggtagtggactcctacgtaacttttagtttagaggttcgggtacgtaacccctaactaactaacgtaacaacgtaaccgtacgtaccgggtagggaaacgggtaccgtactaccaccctatacctacgaaagtaaacgtaaacctaaacgttacccgaaacggtaaacacttaagtttacgttacttaaaccgttaataaaaagtacgtaaaacgttaacccgaggtaaggaaccgggtaaccgaaccgggaaccgacccgggtaactaaagtttacgtaacgttttacggaggttcgggtacggggtactttaaccgggtttacccgtaccgggtacccccgggggttacgggggacccccggggttaaaccggcccggttaccgtaccccgttcccccgtaaccccctacccggtaacccgtaaccccggaaaccccggg

SEQ ID NO: 419335 - DNA, 687 bp, Homo sapiens
  misc_feature: GZ8MTXP02I8GJ4.21.78.H01.1.454.CMB.2.raw
  modified_base (301)..(301): a, c, t, g, unknown or other
  modified_base (328)..(328): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagactgggaggaggcttgatccagccggtgggggtccctgagactctcctgtgcagtctcgtgggttcgtcgagtggcgactacagtgagcgtggtccncgaggctccggaggggacggccgtggnggtgtatctctactttattataggtggtacgtaccactactactacacacgtacctccggtaggaacggggtacctacttaccaacctatctacaacgtaaacgactaaactccgaagaaactcgtatttacgtacttataactaaaagtacgaaactaacccgtgaacgacggaaccgacggaactaccggacctaattgttacgttagttggtacggggttgggtacctttagttttacccggtacccggtaccccgggggtaacggggggtccccgggttaacccgttcgggtaaccccgtaccccgttcccccgtacccccttaccccggacccgaaaccccggtaaaccccggg

SEQ ID NO: 419336 - DNA, 730 bp, Homo sapiens
  misc_feature: GZ8MTXP02IPCTL.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagccgtgggggtccctgagactctcctgtgcagtctcgtgggttcgtcgaggtggcactacatggagcgtcgggtcccgccgagggcctaccggaggggaacggggccgtggaggtggacttccgtactacctttaatttagtaaggttgggtacggtaaccccactatactaacacaagtaccttccggagggaaacgggaccgtactttaccgaacctacttcctacgaaacgaaacgaactaataccgaagaaacacgtattgtaactacttaacaaatagtaaactaacttacgaggaacgaccggaacggaaccgacggacctaagttacgttaacgtttacgtgggttacggttacgggggtaccttaacgttttaccggttcccggtacccccggggtacggggggttacccccggggaaacccgttcgggtaccccgttaccccggtacccccgttacccccctaacccccgtaccccgaacccggtaacccccggg

SEQ ID NO: 419337 - DNA, 832 bp, Homo sapiens
  misc_feature: GZ8MTXP02F24YM.21.78.H01.1.454.CMB.2.raw
  modified_base (257)..(257): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgctatttcaaaggtgtccagtgtgaggtgcagttggtggagacgtggaggaggcttgatccgagccggtgggggtccctgagactctcctgtgcngtctcgtgggttcgtcgagtggcgactacagtgagcgtcggggtcccgccgacggcctaccggaaggggaacgggccgtaggggaggtgggacttccgtactaacttttaagtttaagtaggtagggttcggtaaccccaactaactaaccgtaactaacgtaacgtaaccgtccgggttaggaaaacggggtccgtaacttaccaacctaacttccctaacgaaaagaaaacgaaactaaaccgtttacccaaacgggtaaactaaccgtaatttacgttaacttacctttaacctaaaagttaacgtaaaaccgttaaaccctaggaaccggaacgggacccggaaacggaccgaacgggtaccctaagttagtaacgtttaacggtgggttaggggtacgggggtactttaacggttttaaacccggttacccgggtaacccccgggggttaccgggggggtacccccgggggtaaaaccccggttccggggtaacccccgtaaacccccggttcccccgtacccccccccgttaacccctaacccccggaaacccggtaaacccccggggg

SEQ ID NO: 419338 - DNA, 624 bp, Homo sapiens
  misc_feature: GZ8MTXP02IWTBP.21.78.H01.1.454.CMB.2.raw
tcagtcgtcgctcgcacgaccggtgctcgatttagtgtgagtagtttgggtttgggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactgggaggaggcttgatccagcctggggggtccctgagactctcctgtgcagtctctgggttcgtcagtggcgactacatgagctgggtccgccaggctccagggaaggcctggagtggatctctactttatttactagtggtgtaccccacatactacacagactccgtgaagggccgattcacatctcagaagacaattcccaagaaacacatttcgtaatcttactaaaatgaaaattaaccgtgaaggtagacccgaaggacgaaccgggccaatcggttaatttaacctggttacggttagggggcctaagttttaccgttacggtacccccgttacgggggcccgggggaaaacccccttgggacccgtacccggttaccgtcccccaaaccccttcccgaaccccgaaacggg

SEQ ID NO: 419339 - DNA, 702 bp, Homo sapiens
  misc_feature: GZ8MTXP02GAM39.21.78.H01.1.454.CMB.2.raw
  modified_base (525)..(525): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggtagttttggctgagcttgggttttccttgttgcttatttacgaaaaggtgtccagtgtgaggtgcgtaggttggtggagacgtgggaggaggtcttgactccgagtccggtcgggggtcctgagtcctctccgtgtcgctacgtcgtcgtcgggttcgtcgtaggtcgacgtaactagagtcgacgtcggtcgggcccgtcgacggccgtacgggaggggacggccgtagggagtaggacttcgtacttacgtttaagtttaagtggttacggtacgtaacccaactactacacacgacgtacgtcggtagaccgggtacctagtaccaacgtctacgaacaagaactaactaacgtacgaaagtaaccattattacgtacctattaaaanaaataacgtaactacgtagacgacgacgaacgtccgaacgtatagttagtacgtagtacggtacggtacgttacgttaccggttaccggtacccgggtaccggggtaccgggtacccggtaaccgtccgtacccgtaaccccgtcccgtacccccaccggtaacccgacccgtaccg

SEQ ID NO: 419340 - DNA, 713 bp, Homo sapiens
  misc_feature: GZ8MTXP02HWP13.21.78.H01.1.454.CMB.2.raw
  modified_base (300)..(300): a, c, t, g, unknown or other
  modified_base (472)..(472): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagcttgggttttccttgttgcttatttcaaaaggtgtccagtgtgaggtgcagttggtgagactggaggaggcttgatccagcgtgggggtcctgagactctcctgtgcagtctcgttgggttcgtcgagtggacgactacatgagcgtgggccnccgaggcctaccggaagggtaacggccgtaggaggtggactctacgtaacttaatttaataggtggtcggtaacccacgaattacctaacacagactccggtaaggaacgggccgtattccgaactagtcctaacaagaaagaacaacttcccgaaagtaaaccatacgttntaaacttcttaactaaaaagtgtaaaactaaccgtagacgacggaccggtaaaggaacccgtaccgggaccctaaagttacggtttaacttaaccgtaggttgggtacggggtactttaaacgtttaccgtaccggacccccggggttacgggggacccccgggtaaacccgttcggggtaccctaaccccggttcccctacccccggaacccccttaccggaaacccgtaaccccggggg

SEQ ID NO: 419341 - DNA, 731 bp, Homo sapiens
  misc_feature: GZ8MTXP02HWYAM.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagcttgggttttccttgttgctatttcaaaaggtgtccagtgtgaggtgctagttggtggagacgtggaggaggcttgactccgacggtccggtcgggggtccctgacgtactcctcctgtgctagtctcgtgggttcgtcgagtggcgactacatgagccgtcgggtccgccgaggcctaccggaggggaacggccgtggagtggactcgtactacgtttattagtaggtggtaccgtacccaactacgtaccaacacgacgtacgttccggagggaaaccgggtccgtactttaccgaccctaatccctacgaaagaaacgtaacctaaagttacccgaaaggtaaaccaaccgttaattacgtaacttaccttaacgtaaaatacgtaaaacttaaccgtaagacggtaacgacccggaacggaccgaccggacctagttacgttaaacgttcgttagggtcgtacgggggttacttaacgtttacgttacccggtaccccgggtacgggggaccccggtaaccgtccggtaccctaacccgtccccctaccccggtacccctacccgaaccgtaacccccggg

SEQ ID NO: 419342 - DNA, 948 bp, Homo sapiens
  misc_feature: GZ8MTXP02INKOE.21.78.H01.1.454.CMB.2.raw
tcagtcgtcgctcgcacgaccggtgctcgatttagtgtgagtagtttgggtttggggggagaggagcccagcactgggattccgaggtgtttccattcggtgatcagcactgaacacagaggactcaccatggagttttggctgagctgggttttccttgttgcttatttcaaaggtgtccagtgtgaggtgctaggttggtggagacgtgggaggaggtcttgactccgacggccggttcggggggtccctaggacgtaccttcctccgtggtcgtctaggttccgttcggttcgggttccgtcgacggttggccgtactacagtgaacggtccgtcggggtccccgccgacgggaccgtccgggaaagggggaccggggtccggtaggggtaaggtacgggtacttcccgttaacgttactttttaagttttaagttacgggttcgggttaacggtaaccccctaacgtactttaaaccgtaaacacgtaaaccggttacccttccggggtacgggaaacgggtacccgtattacccgaacctacgtacctaacgaaagtaaacgtaacctaaacgttacccgaaacggtaaactaaccttaagtttaagtttaacctttaacctttaaacgtaaaaacgtttaaacgtaaaaccgtttaaaaccgttaacgtaaaccgggaccgggttaaaccccgggaacgggtaaaacccggtaacccgggtaacccgttaaaggtttacggttttaaacgtttacggttaacggggtttcggggtacggggtttaccgtttaaccggtttttaaaccgggtacccgggtttaccccgggggtaacccgggggttacccccgggggttaaacccgggttcccggttaccccggtaccccgttacccccgtacccccgttaacccccgacccgtaaaccccggtaaaccccggg

SEQ ID NO: 419343 - DNA, 814 bp, Homo sapiens
  misc_feature: GZ8MTXP02JOZU0.21.78.H01.1.454.CMB.2.raw
  modified_base (509)..(509): a, c, t, g, unknown or other
tcagtcgtcgctcgcacgaccggtgctcgatttagtgtgagtagtttgggtttggggggagaggagcccagcactgggattccgaggtgtttccattcggtgatcagcactgaacacagaggactcaccatggtagttttggctgagtcgttgggttttccttgttgcttatttacaaaggtgtccagtgtgaggtgcgtagttggtggagacgtgggaggaggtcttgactccgacggtccggtcgggggttccctggacgtaccttctccgtgtcgctagttctcggttgggttcgtcgtaggtcgaccgtactactagtcgacggcgttcgggcccgaccgtacggccctacggggaaggggacgggtcccgtgggtaacggtggtaacgtttcctaacgtttacgtttaatttagtacggtagggttacgtaacccccagtaacctacaacctacgaacgttacgtccgggtaaggtaaccgggacccttacgtaccgtaaaccncgttaaccgtaaccgaaacgtaaacgtaactaaacgttaccgaaacggtaaactacgtaacgtttacgttaacttaccttaaacgtaaagtaactaaaccgtaacgtaaggaacgaaccgggaaccgaacggaaccgacggtaccttaagtagttaaccgttaagtcggttacggtacggttacgttaccggtttaccggtacccgggtaccccgggtaccgggggtaaccccggttaccggtaaccgtaccccggtaccccgtacccacccccgtaccccgtaccccggacccgtaaccccggg

SEQ ID NO: 419344 - DNA, 845 bp, Homo sapiens
  misc_feature: GZ8MTXP02FF22D.21.78.H01.1.454.CMB.2.raw
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagccgtgggggtccctggagactctcctgtgcagtctgtgggtttcgtcagtggcgaactacagtgagcgtcgggtccgccgaggcctccgaaggggaacgggcctgggaggtggaatccgtctacgtttaatttagaaggttcgggttacggaacccccactaataccttaacaacgtaacgaacgttcccggaagggaaaaccgggggtccgtaaagtttacccaaacctacttaccgttacgaaacgggtaaacgaaacctaaacgtttacccgaaaagggtaaaccaaacttaaagtttacggttaacttacctttaaaccgtaaaaattacggaaaaactttaaaccccgtaggtaaacggaaccgggaacccgaaaccggggaaccgttaacccggggaaccctaacgtttagggttaaacttttaacccggtaacggttcggggttacgggggaacctttaacgttttaaaccgggttcccggtaacccccgggtttaccggggggacccccggggttaaaaccccggttccggggttaacccccgtacccccgggtttaacccccccgtaccccccgtaacccccgtaaccccggtaaacccggtaaacccgg

SEQ ID NO: 419345 - DNA, 722 bp, Homo sapiens
  misc_feature: GZ8MTXP02GUN3Y.21.78.H01.1.454.CMB.2.raw
  modified_base (265)..(265): a, c, t, g, unknown or other
  modified_base (282)..(282): a, c, t, g, unknown or other
  modified_base (342)..(342): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggtcttgatccgacggccggtcgggggtcctgacgtacctctctgtgcngtctcgtggttcgtcgngtcgcactacagtgagtcgtcgggtccaccgaggcctaccgggaggggacgggcgtaggnggtggtactccgtactaatttattagtaggtggttacgaacccctactactacctacgactacgtaccgtccgggtagaacgggtaccgtactaccaacgacttcacaaacgaacgtactaacgttaccgaaagtaaacctacgttaattgtaaccttacgtaaactaaaacgtcttaaaacgtaaccgtagaacgtaccggaccggaacgtacccgaccgggtactaaggtttacgtaagtttaccggtaggttacgggttacgggactttaaccggtttaccgacccggggttaccccggggaccgggggtacccgtacccgttccggccctaccccggttcccacccccgtaaacctcccggaaaacccgtccccgg

SEQ ID NO: 419346 - DNA, 624 bp, Homo sapiens
  misc_feature: GZ8MTXP02IKUFK.21.78.H01.1.454.CMB.2.raw
  modified_base (459)..(459): a, c, t, g, unknown or other
  modified_base (466)..(466): a, c, t, g, unknown or other
  modified_base (479)..(479): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtgggaggaggcttgatccagccgtgggggtccctgagactctcctgtgcagtctcgtgggttctcagtggcgactacatgagcgtgggtccgccgaggctccgaggggaaggcctagggagtggactcgtctacgttatttagagtggtggtacccactatactacacaagacctccggtgaaacggggcctaattcccaaccattcaccaagaacgtacaaacttcccaaggaacactattatatcctanaaagtanaaactaacctganacggacagggacacgggaccagttatacgttatagtggtacggggctacgttttacgtccgaccccggttcggggaccgggtaaccccgtgggttcccaaccggttccctacccccgtaccccgttaccaacccgttaacccggg

SEQ ID NO: 419347 - DNA, 814 bp, Homo sapiens
  misc_feature: GZ8MTXP02HOF3L.21.78.H01.1.454.CMB.2.raw
  modified_base (363)..(363): a, c, t, g, unknown or other
  modified_base (763)..(763): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggtagttttggctgagtcttgggttttccttgttgtcttatttacgaaaaggtgtccagtgtgacggtgcgtaggttgggtaggacgacggtgggaggaggtcttagacgtaccgtacggtcccgggttcggggggtaccctggaacgtcctcctccgtgtacgcgtacgtcgttcggttgggttccgtagtcggtcggacgtaacttcgagtggagtcgtcgggtacccncgacggtctaccgggaggggtaacggtccggtagggagtcggtctcgttactaagtttaagtttaggtggtacggttccgtaaccctactaactactacgtaacgaccgtacgtcggggacggtaccggtacttactacccgactatacgacgtaaagaaacgtacctaacgttaacccgaacggtaaactaccttagtttaactcttacttaaacgtaaagtaaccgtaacgtttaaaaccgtagggaacgacccgggaaacggaacgttaaccccgggagaccgttagttaagttaccgttagtaacgggggtttggacggggttacttaaccggggttaccttaccccgggcccgggggttacccgggggtaaccccgttaacggtccccgggtacncccccggttaaacccgcccctaccccggtaccccggtaaacggtcccccgg

SEQ ID NO: 419348 - DNA, 637 bp, Homo sapiens
  misc_feature: GZ8MTXP02FVOMR.21.78.H01.1.454.CMB.2.raw
  modified_base (281)..(281): a, c, t, g, unknown or other
  modified_base (288)..(288): a, c, t, g, unknown or other
  modified_base (430)..(430): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggtttttcttgttgctattttcaaaaaggtgtccagtgtgaggtgcagttggtggagactggaggaggcttgatccagccgtgggggtccctagagactcgtcctagtgcagtctcgtggttcgtcagtgngactaanatgagcgtggccacgagctacgagggagcgtggaagtacggacttcatacttaagttagtacggtggtacggtaaccaacacttaacgaacacgtaacggaactcgtagaacgggacctactccgaactatacagacgaaanaacaaacgtacgaacgaacaacgtaacgttatatactaactaaacgtaagtaaacgtaacgtagacgacgacgacgaacgacgaccgacgtagtagtaacgtacgtacgtcggtacgtacgttacttacgtaccgtaccgggtaccgggtaaccggtaacgtaccgtaccgtaccctaccccgaaccccgtacccgacccgaaccgg

SEQ ID NO: 419349 - DNA, 855 bp, Homo sapiens
  misc_feature: GZ8MTXP02HLG2G.21.78.H01.1.454.CMB.2.raw
  modified_base (287)..(287): a, c, t, g, unknown or other
  modified_base (321)..(321): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggtagttttggctgagtcttgggttttccttgttgcttatttacaaaaggtgtccagtgtgaggtgcagttggtgagacgtggaggagtctgactcgacggtccggtcgggggtcctggagtactcctccgtgtacgctagtcgtcgtcgggttntcgaggtggcaactacatggacgcgtcgggtccnccgacggtcctaccggaggggaacggccgtaggacgtaggactctaccttaactttaagttagtaggttacgggttacgtacccctaactacgtaactaccgaacgtaaccgtaccgtccgggaagggaacggtaccgtaccttaccgaacctattccaaacgtaaacgtaaacgtaacgtaaacctaccgaaaacgggtaactaaccgttattaacggttaaccttaaccttaaaactaaaacgttaacgttaaaacgttaaaccggtaacggtaaaggtacccggggaaaccggaaccggaaacccggtaacccgtaacccgtaaagttaacgttacgttaaacgttcgggtttaggggtacggggttaccgtttaaaaccggtttccgggttaaccccgggtaccccgggggtaccgggggttaaccccggggtaaccccgggttaacccggttaaaccccgtcccccggttacccccgtacccccccgtacccccgtaaaccccggtaaaccccggttaaacccccgggg

SEQ ID NO: 419350 - DNA, 806 bp, Homo sapiens
  misc_feature: GZ8MTXP02GTYXC.21.78.H01.1.454.CMB.2.raw
  modified_base (305)..(305): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagacgtggaggaggcttgatccgagccgtgggggtcctgagactctctgtgcagtctcgttggttcgtcgagtcggcgactacgagtgagtcgtagggtccnccgaaggctacgagggaaggcctaggagtggactctacgtactttattagtaggtacggtcggtaccccaacgtagttaactaacacgacgtacgttccggtaggaaacgggtccgtatttcccacgtactactaccgaagaaaccgaacgtaaacgttccgaaaggtaaacccaacgttacgtttaagtaaaccttaccttaaacgtaaaacgttacgtaaaaaccgttaaaccgttaaggaaaaccgggttacgggacccgggaaaacccggttaacccggaacccggtacccgtaaagttacggtttaaacgtttaaacgggtccggtttaggggttacgggggttacctttaaaacggttttcccgttaaaccggggtaacccccgggttaccggggggtaaccccggtaaccccggttaacggggttaaccccacccccggtttaacccgaccccccgaaaccccgtttaccccggaaaccccggtaaacccccgg

SEQ ID NO: 419351 - DNA, 767 bp, Homo sapiens
  misc_feature: GZ8MTXP02FILZN.21.78.H01.1.454.CMB.2.raw
  modified_base (286)..(286): a, c, t, g, unknown or other
  modified_base (299)..(299): a, c, t, g, unknown or other
  modified_base (308)..(308): a, c, t, g, unknown or other
tcagtcgtcgctcgcacgaccggtgctcgatttagtgtgagtagtttgggtttgggggggagaggagcccagcactgggattccgaggtgtttccattcggtgatcagcactgaacacagaggactcaccatggagttttggctgagctgggttttccttgttgctatttcaaaaggtgtccagtgtgaggtgcagttggtggagactggacggaggcttgatccagccgtgggggtcctgagactctcctgtgcagtctctgggttcgtcgagtggcgactacangagcgtgggtccnccgaggccnccgagggaacgggcctggagtggaatcgtacaacttttatttataggtggttacggtaccccgtactacgtaactaccgaactacgaccgtccgggtaggaaaccgggggtcctaattaccctaccgactaccgttacaagtaaaccgtacgaaaactttcccgaaagggtaaacctaaccaggtttacttagtactttaccgaaaatttgaaaaacgttacccgtagacgaaacggggacccgaggaacccgtaacgggcccctaaaagttccggttatttaaacgggtcgttggggtacgggggtacctaaacggtttttacttacccgggggtaaacccccgttcggggggtacccccgggggtaaaacccgttaacgggggttaaccccctccccggggttaccttttaccccccccggtacgtaccccccggaaaacgtttaaacccccggggg

SEQ ID NO: 419352 - DNA, 574 bp, Homo sapiens
  misc_feature: GZ8MTXP01DOLFF.3.26.C04.1.454.CMB.2.raw
  modified_base (422)..(422): a, c, t, g, unknown or other
  modified_base (499)..(499): a, c, t, g, unknown or other
tcagagacgcactccacgaccggtgctcgatttagtctagcgactttgggtttgggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccattcacaatctccagagacaactccaaagaacacggtctatctgcaaatgagcagcctgcgagctgaggacaccgtcttctttatactgtcgcgagtagtcgtgggggtcgactaacggagttacgtggttacttcgattcgtcggtcggggccgtggcctaccgtgctgtactgtcctccncacgtccctacccaaccgggaacgggcccctagttcccggttccctccccgtggccctcccgtgcctcccgagggcncccacccgttccgagcgcaacgcggcccggcccgtgggcctaacggcccgtagggttacaacggttccttaaccg

SEQ ID NO: 419353 - DNA, 586 bp, Homo sapiens
  misc_feature: GZ8MTXP01B8641.3.26.C04.1.454.CMB.2.raw
tcagagacgcactccacgaccggtgctcgatttagtctagcgactttgggtttgggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaaagtaaacgtactacacagattccgtgcagggccattcacaatctccagagacaactcaagaacacggtctatctgcaaatgagcagcctgcgagctgaggacaccgcttctttatactgtcgcgagagtcgtgggggtgctggagtactgggtacttcgattctcgtgggggccgtggccacccgtgctgacttcgtctcctcacgccctaccaccggaacggggcccctacgttcccgggtcccttccccccgtggcccgtccccgtggccctcccgacgggacgccaacccgttccggacgacgccgacgacgggcccggccccgttgggggcccttcggcccggttgggttaccgaaacgggttcctttaacccgg

SEQ ID NO: 419354 - DNA, 531 bp, Homo sapiens
  misc_feature: GZ8MTXP01EYJOB.3.26.C04.1.454.CMB.2.raw
  modified_base (315)..(315): a, c, t, g, unknown or other
  modified_base (444)..(444): a, c, t, g, unknown or other
tcagagacgcactccacgaccggtgctcgatttagtctagcgactttgggtttgggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaaataaaacgtactacacagattccgtgcagggccattcacaatctccagagacaactccaagaacacggtctatctgcaaatgagcagcctgcgagctgaggacaccgnttctttatactgtcgcgagagtcgtgggggtgctaacgagtactggtacttcgatctcgtggggcgtggcacctgctgactgtctcctcacgcctccaccgaacgggcccagtccggtccttcccccgnggccgccctgcctccgaggcgcaccttccgagacgcacacgccggcccgtggggctcggcccgtggttacaacgggttccttaaccg

SEQ ID NO: 419355 - DNA, 532 bp, Homo sapiens
  misc_feature: GZ8MTXP01ESCQ4.3.26.C04.1.454.CMB.2.raw
  modified_base (491)..(491): a, c, t, g, unknown or other
tcagagacgcactccacgaccggtgctcgatttagtctagcgactttgggtttgggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaaagaacacggtctaatctgacaaatgagcagcctgcgagctgaggacaccgcttctttatactgtcgcgagtagtcgtgggggtgctaacgagtactggtacttcgatctcgtggggccgtggcacctgctgactgtctcctcacgcctccaaccgaacgggccccagtccggtccttccccgtggccgccctgcctccgaggcgccaccttccgagcgcacgngccggccgtgggctcgcccgtggttacaacggttctaaccg

SEQ ID NO: 419356 - DNA, 549 bp, Homo sapiens
  misc_feature: GZ8MTXP01AU6VP.3.26.C04.1.454.CMB.2.raw
  modified_base (456)..(456): a, c, t, g, unknown or other
tcagagacgcactccacgaccggtgctcgatttagtctagcgactttgggtttgggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaaagtaaaacgtactacacagattccgtgcagggccattcacaatctccagagacaactccaaagaacacggtctatctgacaaatgagcagcctgcgagctgagacaccgctctttatactgtcgcgagagtcgtggggtgctaacgagtactgggttacttcgatcgtcgtcggggccgtggccacccgtgctgactcgtctccgtcacgcctcccaccggaacgggcccagtccggtccttcccccgnggccgcccgtcgccctccgacggcgccaacccgttccggacgacgcacgcggccgcccgtgggctcgcgtcggttacgaacggttcgtaaccg

SEQ ID NO: 419357 - DNA, 554 bp, Homo sapiens
  misc_feature: GZ8MTXP01CIBJ6.3.26.C04.1.454.CMB.2.raw
  modified_base (501)..(501): a, c, t, g, unknown or other
tcagagacgcactccacgaccggtgctcgatttagtctagcgactttgggtttgggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaaagtaaacgtactacacagattccgtgcagggccgattcacaatctccagagacaactccaagaacacggtctatctgacaaatgagcagcctgcgagctgaggacaccgcttctttatactgtcgcgagagtcgtggggtgctgagtactgggtactcgatctcgtgggcgtggcaccgtgctgactgtcctcctcacgcctacccaaccggaacggggcccctacgtcccggttcccttcccccgtggcccgtcccctgccctccgacggcgccctaacccgcgacgcgaccncgacggcccggcccgtggggcctcggccgtggttccaaacggttccttaaccg

SEQ ID NO: 419358 - DNA, 555 bp, Homo sapiens
  misc_feature: GZ8MTXP01EV2CZ.3.26.C04.1.454.CMB.2.raw
  modified_base (306)..(306): a, c, t, g, unknown or other
  modified_base (323)..(323): a, c, t, g, unknown or other
  modified_base (425)..(425): a, c, t, g, unknown or other
  modified_base (464)..(464): a, c, t, g, unknown or other
  modified_base (469)..(469): a, c, t, g, unknown or other
tcagagacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctgggagtggggtggcacttatatcatatgatggaaagtaaaacgtactacacagattccgtgcagggccattcacaatctccagagacaactcaagaacacggtctatctgacaaatgagcagcctgcganctaggacggacaccgtnttctttaatacgtgtcgcgagagtcgtgggggtgctaacggagtactgggttacttcgactcgtcgtcggggccgtggcctaccctgctgacttgtcctccncacgcctaccgaaccgacggcccagtccgtcctccccgnggccnccctgcctccgaggcgcctaccgttcggagacgcaacgcggccggcccgtgggcctcggcccgtggaccaagggttccttaaccgg

SEQ ID NO: 419359 - DNA, 520 bp, Homo sapiens
  misc_feature: GZ8MTXP01DGEYW.3.26.C04.1.454.CMB.2.raw
  modified_base (154)..(154): a, c, t, g, unknown or other
  modified_base (233)..(233): a, c, t, g, unknown or other
  modified_base (252)..(252): a, c, t, g, unknown or other
  modified_base (295)..(295): a, c, t, g, unknown or other
  modified_base (409)..(409): a, c, t, g, unknown or other
  modified_base (450)..(450): a, c, t, g, unknown or other
  modified_base (460)..(460): a, c, t, g, unknown or other
  modified_base (466)..(466): a, c, t, g, unknown or other
  modified_base (473)..(473): a, c, t, g, unknown or other
  modified_base (478)..(478): a, c, t, g, unknown or other
tcagagacgcactccacgaccggtgctcgatttagtctagcgactttgggtttgggggaagaggaagactgacggtccagcctgggaggtccctgagactctcctgtgcagcctctggattcagcttcagtgactatgctatgcactgggtccnccaggctccaggcaaggggctggagtgggtggcacttatatcatatgataggaaataaaacgtactacacagattccgngcagggccattcacaatcncagagacaactaccaagaacacggtctaatctagacaaatgancagcctgcgagctagaggacaccgcttctttatactgtcgcgagagtcgtggggtgactaacgagtactgggtacttcgatctcgtcggggcctggcacctgctgactgctccncacgcctaccacggaacggcctagtccggtcccttccccgngcccgtcccncgtccncgacgcnccacncgagcgcacgcgccgccgtggctcgcgtgacaacgttcgtcg

SEQ ID NO: 419360 - DNA, 606 bp, Homo sapiens
  misc_feature: GZ8MTXP01ARRTF.3.26.C04.1.454.CMB.2.raw
  modified_base (291)..(291): a, c, t, g, unknown or other
tcagagacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccgaggcgaaggggctgggagtggggtggcacttatatcatatgataggaaagtaaaacgtactacacagtacttccgtgcgagggcctattcaacaatctcagagacaactcaaagaacacggtctanctgacaaatgagcacgcctgcgagctaggacgaccaccgtcttactttatactgtcgacggagtacgtcggtgggggtacgacttaacggagttacgtggtacttcgattcgtcggtcggggccgtggccaccgtgactggactcgtcctcctcacgtccctaccgaccggaacgggccctacgtcccggtcccttccccgcggcccgtccctgtcccgtaccgacggaccgcccaacccgttccggaacgcgcccgaacgcggcccggcccgtgggcctcgggccgtcgggaccgtaacggttccgttaaccgg

SEQ ID NO: 419361 - DNA, 564 bp, Homo sapiens
  misc_feature: GZ8MTXP01BHV8J.3.26.C04.1.454.CMB.2.raw
  modified_base (318)..(318): a, c, t, g, unknown or other
  modified_base (398)..(398): a, c, t, g, unknown or other
tcagagacgcactccacgaccggtgctcgatttagtctagcgactttgggtttggggggaagaggaagactgacggtccatcctgggaggtccctgagactctcctgtgcagcctctggattcagcttcagtgactatgctatgcactgggtccgccaggctccaggcaaggggctggagtgggtggcacttatatcatatgatggaaagtaaaacgtactacacagattccgtgcagggccattcacaatctccagagacaactcaaagaacacggtctatctgcaaatgagcagcctgcgagctggaggacaccgnttactttattactgtcgcgagtagtcgtgggggtcgctaacggagtactgggtacttcggatcgtcgtcggggcgtggcncccgtgctgtactgtcctcctcacgcctacccacggaacggccctacgtccggtccctcccccgtcggcccgtcccgtcgtccgtccgacggcgcctacccgttccggagacgccgacgcggccggcccgtgggcctcgccgtggttactaacggttccttaaccg

SEQ ID NO: 419362 - DNA, 559 bp, Homo sapiens
  misc_feature: GZ8MTXP01A5CQE.3.26.C04.1.454.CMB.2.raw
  modified_base (292)..(292): a, c, t, g, unknown or other
  modified_base (482)..(482): a, c, t, g, unknown or other
tcagagacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaaagtaaaacgtactacacagattccgtgcagggccattcacaatctccagagacaactccaagaacacggtcatctgcaaatgancagcctgcgagctgacggacaccgtcttctttatactgtgcgagagtcgtggggtgctcgagtctggtacttgatcgtcgtcggggccgtggcaccgtgctgactgtcctcctcacgccctaccaccggtaacgggcccctacgtcccggtcccttcccccgtcggcccgccctcgtcctccgacggacnccgaccgttccggacgcgaccacgacggcccggcccgtgggccttcgccgtcggttacgaacggttcgttaacccgg

SEQ ID NO: 419363 - DNA, 541 bp, Homo sapiens
  misc_feature: GZ8MTXP01CNAOF.3.26.C04.1.454.CMB.2.raw
  modified_base (270)..(270): a, c, t, g, unknown or other
tcagagacgcactccacgaccggtgctcgatttagtctagcgactttgggtttgggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaaagtaaaacgtactacacagattccgtgcagggccattcacaatctccagagacaactccaaanaacacggtctaatctgacaaaatgagcaagcctgcgagctgaggacaccgctctttatactgtgcgagagtcgtgggggtgctaacgagtaactgggtacttcgatcgtcgtggggcctggcaccgtgctgtactgtctcctcacgtccctaccgaccgaacgggccctagtccgttccttcccccgtggcccgccctcgcctccgacggcgccacccttccgagcgcacgacgccggccctgggctcgcctgggttacaaggcttaaccg

SEQ ID NO: 419364 - DNA, 675 bp, Homo sapiens
  misc_feature: GZ8MTXP01CZ4MY.3.26.C04.1.454.CMB.2.raw
tcagagacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtgcacttatatcatatgatagggaaataaaacgtactacacagtacttccggtgcgagggggcccgtattccaactaaacttcctacccaaggaacgaaccaaacctaccaaagaaccacggtctatcctgacaaatgaagcagcctgcgagctaggacggacaccgtcttactttatactggtcgcgaggtgtcggtgggggtacgactaacggagtacgtaggtacttcgattccgtcggtcggggtccgtcgggcctaccgtcgcgtacggtaccttcggtcccttccgtacgaccgtcccctacccgaacccggggtaaccggggtcccctacgtccccggttccccgtttccccccgcgggtcccgtccccgtagtcccgtacccgaacggcgaaccctacccgttccggaacgacggccacggaccggccgggttcccgtggggtcctcggtccgtcgggttaccgaacgggttcccttaaccgg

SEQ ID NO: 419365 - DNA, 632 bp, Homo sapiens
  misc_feature: GZ8MTXP01DKKBX.3.26.C04.1.454.CMB.2.raw
  modified_base (253)..(253): a, c, t, g, unknown or other
  modified_base (317)..(317): a, c, t, g, unknown or other
tcagagacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgataggaaataaaacgtactacacagattccgtgcagggccattcacaatcncagagacaactcaaagaacacggtctaatctgacaaatgagcagcctgcgagctgagacaccgnttctttatactgtcgcgagagtcgtgggggtgctaacgagtacgtgggtacttcggaattcgtcggtgggggtcctggacctacctactgacgttcgttcctcctcgaccgccctacccaaccgaacggggggcccctaacgttccccgggttcccttcccccgtcggccccgtccccgttgcccgttcccgaaacgggccgccctaacccgtaccgacgaccgccaacccgacggccccgggcccccgttgggggcccttacgggccccgttagggtacccgaaacggtaacccgggttaacctttaacccggg

SEQ ID NO: 419366 - DNA, 659 bp, Homo sapiens
  misc_feature: GZ8MTXP01APA4O.3.26.C04.1.454.CMB.2.raw
  modified_base (259)..(259): a, c, t, g, unknown or other
  modified_base (264)..(264): a, c, t, g, unknown or other
  modified_base (295)..(295): a, c, t, g, unknown or other
  modified_base (298)..(298): a, c, t, g, unknown or other
  modified_base (320)..(320): a, c, t, g, unknown or other
  modified_base (325)..(325): a, c, t, g, unknown or other
tcagagacgcactccacgaccggtgctcgatttagtctagcgactttgggtttggggggaagaggaagactgacggtccagcctgggaggtccctgagactctcctgtgcagcctctggattcagcttcagtgactatgctatgcacgtgggtccgccaggctccaggcaaggggctggagtgggtggctacttatatcatatgaataggaaagtaaaacgtactacacagtattccgtgcgagggccattcacaatcncaganacaactcaaagacacgtctatctagacaaangancagcctgcgagcgtgacggacnccgtnttactttatacgtgtcgacgtaggtaggtcggtgggggtacgactaacggaagtacgtgggtactcggaacttccgttcgggtcggggccgtcggccctaccgttcgccgttacgaccttcggtccttcccgtacgtaccggtccctacccgaaccggggaaccgggtccctaaccgttcccgggttccccttcccccggtggccccgtccgtcgtcccgtccggtaacggccgaacctaaccccgttcggaacgacgacccgaacgccgggcccgcccggttcgggggccttcgggcccgttcgggaacccgtaacggttcccgtttaaccgg

SEQ ID NO: 419367 - DNA, 839 bp, Homo sapiens
  misc_feature: GZ8MTXP01AU3PC.3.26.C04.1.454.CMB.2.raw
  modified_base (196)..(196): a, c, t, g, unknown or other
  modified_base (265)..(265): a, c, t, g, unknown or other
tcagagacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtggggtggcactttanatcatatgatagggaaagtaaaaacgtctaacacaagattccggtgcgaggggccattcaactaatccnccagacgaacaactacccaaagaacacggttactaatctagaacctaaatcggacgcagcctaggacgagccgtaggacggacctaccgtctttacttttaacgtaccgtggttaccgacggtaagtaggttaccgggtggggggtaacgaccgttaacgggtaacgttacggttcgggttaacgtttcggaacgttccggttcgggtacggggggtcccggttacgggacccgtaacccgttggtaacccgttacggtacccgttcggttaccccttcccgtacgtaacccgtccccgttaacccccgaaccggggtaaacccggggccccttaaacgggttccccgggtttacccctttccccccggcgggtccccgtaaccccggttacgcccccggttaccgaaaccgggggacaacccccgttaacccggttacccgggaaaccggttacgaaacccggtaccggaaacccggggttccggggaccccccgggtttgggggcccttaacccggggttacccgggtacggggtttaaccgaaccgggggttaaccccttttaacccgggg

SEQ ID NO: 419368 - DNA, 416 bp, Homo sapiens
  misc_feature: GZ8MTXP02HZYUD.3.26.C04.1.454.CMB.2.raw
  modified_base (306)..(306): a, c, t, g, unknown or other
  modified_base (343)..(343): a, c, t, g, unknown or other
  modified_base (410)..(416): a, c, t, g, unknown or other
tcagagacgcactccacgaccggtgctcgatttagtctagcgactttgggtttgggcacttatatcatatgatggaagtaaaacgtactacacagattccgtgcagggccgattcacaatctccagagacaactccaagaacacggtctatctgcaaatgagcagcctgcgagctgaggacaccgctctttattactgtgcgagagtctgggggtgctacgagtactggtacttcgatctctggggcctggcaccctgctgactgtctcctcagcctccaccaagggccccatcggtcttcccccnggcgccctgcctcccaggagcacctccgagagccacngcgccctgggctgcctggtcaaggctacttcgagtgcgtctctgagcgggctggcaaggcgcatagnnnnnnn

SEQ ID NO: 419369 - DNA, 539 bp, Homo sapiens
  misc_feature: GZ8MTXP02GXXI6.3.26.C04.1.454.CMB.2.raw
tcagagacgcactccacgaccggtgctcgatttagtctagcgactttgggtttgggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaaagtaaacgtactacacagattccgtgcagggccgattcacaatctcagagacaactccaagaacacggtctatctgcaaatgagcagcctgcgagctgaggacaccgctctttatactgtcgcgagagtcgtggggtgctacgagtactggtacttcgatctcgtggggcgtggcaccgtgctgactgtctcctcacgcctccaccgacgggcccagtccggtccttcccccgtggccgccctcgcctccgaggcgccaccgtccgacgacgccacgacgccggcccgtggggccttcggcccgtgggtaccaaacgggtacctttaaccgg

SEQ ID NO: 419370 - DNA, 539 bp, Homo sapiens
  misc_feature: GZ8MTXP02JXNFI.3.26.C04.1.454.CMB.2.raw
tcagagacgcactccacgaccggtgctcgatttagtctagcgactttgggtttgggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaaagaacacggtctatctgcaaatgagcagcctgcgagctgaggacacgctctttatactgtgcgagagtcgtggggtgctagagtactggtacttgattctcgtggggccgtggcaccctgtgactgtctcctcacgcctccaccaacggccccatccggtccttcccccgtggcccgccctgcctccgaggacgccaacccgtccgagacgcacgacggccggcccgtggggcctcggccctcgggtaccaaacgggtacctacgttccgg

SEQ ID NO: 419371 - DNA, 535 bp, Homo sapiens
  misc_feature: GZ8MTXP02IH0F2.3.26.C04.1.454.CMB.2.raw
  modified_base (257)..(257): a, c, t, g, unknown or other
  modified_base (456)..(456): a, c, t, g, unknown or other
  modified_base (483)..(483): a, c, t, g, unknown or other
tcagagacgcactccacgaccggtgctcgatttagtctagcgactttgggtttgggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaacgtactacacagattccgtgcagggccgattcacaatctccaganacaactccaaagaacacggtctatctgcaaaatgagcagcctgcgagctgaggacaccgcttctttatactgtcgcgagagtcgtggggtgctacggagttactgggtaccttggatcgtcgtggggccgtggcaccctgctgacctgtctcctcacgccctccaccgaacgggcccacttccgggtcccttcccccgnggccgcccttcgcctcccgagggaccnccaccgccgacgacgcacgcgccgccgtggctcgcgtcggacacgtactacg

SEQ ID NO: 419372 - DNA, 526 bp, Homo sapiens
  misc_feature: GZ8MTXP02JBKIZ.3.26.C04.1.454.CMB.2.raw
  modified_base (232)..(232): a, c, t, g, unknown or other
  modified_base (485)..(485): a, c, t, g, unknown or other
  modified_base (504)..(504): a, c, t, g, unknown or other
tcagagacgcactccacgaccggtgctcgatttagtctagcgactttgggtttgggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaaagtaaacgtactacacagattccgngcagggccattcacaatctcagagacaactcaagacacgtctatctgacaaatgagcagcctgcgagctgaggacaccgctctttatactgtcgcgagagtcgtggggtgctacggagtactggttacttcgattcctcgtcgggggccgtggccaccctgctagctgtcctcctcacgcctaccaccgaacgggcccctagtccggtcccttcccccgtgcccgccctgcctccaggacgcaccgcgagacncacgacgccgcctgggccngccctggtacaacggactaccg

SEQ ID NO: 419373 - DNA, 528 bp, Homo sapiens
  misc_feature: GZ8MTXP02JHQ2E.3.26.C04.1.454.CMB.2.raw
tcagagacgcactccacgaccggtgctcgatttagtctagcgactttgggtttgggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaaagaacacggtctatctgacaaatgagcagcctgcgagctgaggacaccgctctttatactgtcgcgagagtcgtggggtgctacgagtactggtacttcgatctcgtggggcgtggcaccgtgctgactgtctcctcacgcctccaccgaacgggtcccacgtccggtccttcccccgtggccgtccctcgcctccgacggcgccaccctccgacgacgcacgacgccgccgtgggctcgccgtgtcgaaggtactaccg

SEQ ID NO: 419374 - DNA, 479 bp, Homo sapiens
  misc_feature: GZ8MTXP02G4584.3.26.C04.1.454.CMB.2.raw
  modified_base (459)..(479): a, c, t, g, unknown or other
tcagagacgcactccacgaccggtgctcgatttagtctagcgactttgggtttgggcacttatatcatatgatggaagtaaaacgtactacacagattccgtgcagggccgattcacaatctccagagacaactccaagaacacggtctatctgcaaatgagcagcctgcgagctgaggacaccgcttctttattactgtgcgagagtcgtgggggtgctacgagttactggtacttcgatctcgtggggcctggcaccctgctgactgtcctcctcacgccctccaccgaacgggccccagtccggttccttcccccgtggcccgtcccctgcctcccgaggacgccaccgtccgaagacgcccacacggccggcccgtggggcctggccgtgggtacaaaggtaccttacgttccgagtcgcgtctcgtgacggcgggctggcaagggcgcagtagnnnnnnnnnnnnnnnnnnnnn

SEQ ID NO: 419375 - DNA, 606 bp, Homo sapiens
  misc_feature: GZ8MTXP02HH8U2.3.26.C04.1.454.CMB.2.raw
tcagagacgcactccacgaccggtgctcgatttagtctagcgactttgggtttgggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaaagtaaaacgtactacacagattccgtgcagggccattcacaatctaccagagacaactccaaagaacacggtctaatctgacaaaatgagcagcctgcgagctagacggaccaccgtcttactttatactggtcgcgagtcgtcgtggggtgcgtacgagttactggtacttcgatcgtcgtcgggggccgtggcctaccctgccgtgtaccttgtcctcctcacgtccctaccgaaccgaacggtcccacgttcccggtcctcccccgtgcccgtacccgtcgcctaccgaggacctcccgacccgtccggaaacacggtacccacgaccgggcccggacccggttcgggcgtccggtcccgtacggtacccgtaaacggggtaccctttaacccggg

SEQ ID NO: 419376 - DNA, 525 bp, Homo sapiens
  misc_feature: GZ8MTXP02FSW5S.3.26.C04.1.454.CMB.2.raw
tcagagacgcactccacgaccggtgctcgatttagtctagcgactttgggtttgggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaacgtactacacagattccgtgcagggccgattcacaatctccagagacaactccaaagaacacggtctatctgacaaatgagcagcctgcgagctgaggacaccgctctttatactgtcgcgagagtcgtggggtgctacgagtacgtggtacttcgatctcgtggggccgtggcaccctgctgactgtctctcacgccctccaccaacgggcccagtccggtccttcccccgtggccgccctcgcctccgagcgccacctcgacgacgcacgacgcggcccgtgggctcgccgtggtacgaacggtactaccg

SEQ ID NO: 419377 - DNA, 565 bp, Homo sapiens
  misc_feature: GZ8MTXP02JQXOL.3.26.C04.1.454.CMB.2.raw
  modified_base (293)..(293): a, c, t, g, unknown or other
tcagagacgcactccacgaccggtgctcgatttagtctagcgactttgggtttgggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaaagtaaacgtactacacagattccgtgcagggccgattcacaatctcagagacaactccaaagaacacggtctatctgacaaatgancagcctgcgagctggaggacaccgcttctttatactgtcgcgagagtcgtggggtgctagagtactggtacttcgatctcgtcgggggccgtggccacccgtgctgacctgtcctcctcacgccctaccaccgaacgggccctagtcccggtcccttcccccgtggcccctcccgtcgcctcccgaggaccgcccacccgtccggagcgaccacgacggcccggcccgtggggccctcggtcccgtggtaccaacgggtacctttaacccgg

SEQ ID NO: 419378 - DNA, 527 bp, Homo sapiens
  misc_feature: GZ8MTXP02HG2EX.3.26.C04.1.454.CMB.2.raw
  modified_base (413)..(413): a, c, t, g, unknown or other
  modified_base (490)..(490): a, c, t, g, unknown or other
tcagagacgcactccacgaccggtgctcgatttagtctagcgactttgggtttgggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaaagtaaaacgtactacacagattcgtgcagggccattcacaatctcagagacaactccaaagaacacggtctatctgacaaatgagcacgcctgcgagctggacggaccaccgtcttctttatactgtgcgagtagtcgtggggtgctcgagtactggtacttgatcgtcgtcggggcgtggcacccgtgctgactgtctccgtacncgccctccaaccgaacgggtcccctagtcccggtcccttccccgtcgccgtccctgcctcgagcgcaccgcgacgcncacgcgccgccgtggctcgctggtacaacgtctaccg

SEQ ID NO: 419379 - DNA, 573 bp, Homo sapiens
  misc_feature: GZ8MTXP02JNXRE.3.26.C04.1.454.CMB.2.raw
tcagagacgcactccacgaccggtgctcgatttagtctagcgactttgggtttgggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgataggaagtaaaacgtactacacagattccgtgcagggccgattcacaatctcagagacaactccaagaacacggtctaatctgacaaatgagcagcctgcgagctgacgacaccgtctctttatactgtgcgagagtcgtggggtgctacggagtacgtggtacttcgattcgtcgtcgggggcctggccctacccgtgaccgtgacctgtcctccctcacgtccctccaaccgtacgggccctagtccggtcccttcccccgtggccctcccgtgccctccgaggtccgcctacccgcgaacgacgaccacgacggcccggcccgtggggccttacggcccttaggtaccaaacgggtacctttacccgg

SEQ ID NO: 419380 - DNA, 574 bp, Homo sapiens
  misc_feature: GZ8MTXP02H28LE.3.26.C04.1.454.CMB.2.raw
tcagagacgcactccacgaccggtgctcgatttagtctagcgactttgggtttgggggaagaggaagactgacggtccagcctgggaggtccctgagactctcctgtgcagcctctggattcagcttcagtgactatgctatgcactgggtccgccaggctccaggcaaggggctgggagtgggtggcacttatatcatatgatgggaaagtaaaacgtactacacagattccgtgcagggcattcacaatctcagagacaactaccaaagaacacggtactatctgacaaatgagcagcctgcgagctagagacacgcttactttatactgtcgcgagaggtcgtggggtgctacgagtactggtactgatctcgtcgggcgtggccacctgctgactgtcctcctcacgccctaccgaccgaacgggtcccctagttcccgggtacccttccccgtcggcccgtcccctggccctccgaggacccgtccgtaacccgtccggaacgacgccaccgaccggccggtcccgtcggggcctccggtccgtggtaccgaaacggttaccctaccgg

SEQ ID NO: 419381 - DNA, 434 bp, Homo sapiens
  misc_feature: GZ8MTXP02G9XKS.3.26.C04.1.454.CMB.2.raw
  modified_base (423)..(434): a, c, t, g, unknown or other
tcagagacgcactccacgaccggtgctcgatttagtctagcgactttgggtttgggcacttatatcatatgatggaagtaaacgtactacacagattccgtgcagggccgattcacaatctccagagacaactccaagaacacggtctatctgcaaatgagcagcctgcgagctgaggacaccgctctttattactgtgcgagagtctggggtggctacgagtactggtacttcgatctcgtggggcctggcaccctgctgactgtctcctcagcctccaccaagggccccatccggtcttccccctggccgcccctgcctcccaggacgccacctccgagagccacagcggccctgggctgcctggtcaaggacctacttcgagtgcgtctcgtgacggcgggctgggcaagggcgcatagnnnnnnnnnnnn

SEQ ID NO: 419382 - DNA, 578 bp, Homo sapiens
  misc_feature: GZ8MTXP02I4OXF.3.26.C04.1.454.CMB.2.raw
  modified_base (260)..(260): a, c, t, g, unknown or other
  modified_base (294)..(294): a, c, t, g, unknown or other
  modified_base (479)..(479): a, c, t, g, unknown or other
  modified_base (485)..(485): a, c, t, g, unknown or other
tcagagacgcactccacgaccggtgctcgatttagtctagcgactttgggtttgggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgataggaaagtaaacgtactacacagattccgtgcagggccattcactaatctaccaganacaactcaaagacacggtctatctgacaaatgancagcctgcgagctgacggaccaccgtcttctttatactgtcgcgagagtcgtggggtcgctacggagtaccgttgggtacctttcggaattccgtcggtcgggggcccgtggccacccgtgctgaccttgtcctccgtcacgccctaccaccgaacgggcccacgttccggtccccttcccccgnggcccncccgtgccctccgagggactccgaccgtccgacgacgccacgaccggccgccccgtggggcctcgccgtaggtaccgaacggtacctttaccg

SEQ ID NO: 419383 - DNA, 611 bp, Homo sapiens
  misc_feature: GZ8MTXP02FP23H.3.26.C04.1.454.CMB.2.raw
  modified_base (251)..(251): a, c, t, g, unknown or other
  modified_base (261)..(261): a, c, t, g, unknown or other
tcagagacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgataggaaagtaaaacgtactacacagtattccgtgcagggccgattcanaatctcaganacaactcaagacacggtctatctagacaaatgaagcagcctgcgagctaggacggacaccgtcttctttatactgtcgcgagagtcgtggggtcgctacgagtacgtggttaccttcgatcgtcggtcgggggccgtcggcctacccgtgcttgccttcgtccctccctcgacgtcccctccgaaccgaacgggcccctacgttcccggttccccttcccccgtcggcccgtcccgtcgcccgtccgacgggaccgcccaacccgtccggaacgacgaccgaccgaccgggcccgccccggtggggtccctacggcccgttacggtaccgaaacgggtacccttacccgg

SEQ ID NO: 419384 - DNA, 573 bp, Homo sapiens
  misc_feature: GZ8MTXP02I0D4E.3.26.C04.1.454.CMB.2.raw
  modified_base (290)..(290): a, c, t, g, unknown or other
tcagagacgcactccacgaccggtgctcgatttagtctagcgactttgggtttgggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccattcacaatctcagagacaactcaagaacacggtctatctgacaaatgancagcctgcgagctgacggacaccgcttctttattactgtgcgagagtcgtggggtgctaggagtacttggtacttcgatcgtcgtgggggtccgtggccacccgtgcgtgacctgtctcctcacgcctacccgaccgaaccgggccctacgttccgggtccccttcccccgtggcccgtccccgttgcccgtaccgacggacgccgacccgtccggacgacgaccgaacgcggcccggccgtcgggcctcggcccgttggaccgaacgggacctttaacccgg

SEQ ID NO: 419385 - DNA, 667 bp, Homo sapiens
  misc_feature: GZ8MTXP02IPQN4.3.26.C04.1.454.CMB.2.raw
tcagagacgcactccacgaccggtgctcgatttagtctagcgactttgggtttgggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgataggaaagtaaaacgtactacacagattcgtgcgaggccattcacaatctacagagacaactccaaagaacacggtctatactgacaaatgacgcacgcctgacgagctaggaccggactaccgtcttactttattacgtgtcgcgaagtcgtcggtggggtcgtacgtacgggtagttaccgtagggttaaccttcggtaacttcgttccgggtcgggggtccgttcggggacctacccccgtgtccgtgtacccttgtcctaccctcgacgtcccctacccgaacgaaccgggtccctaccgttcccgggttcccccttcccccggtgccccgtccgtcgccctaccgagggccacccgtacccgtccggaacgacgacccgtaacgaccgggcccggcccggttaacgggccgttccggtcccgttagggtaacccgtaaacgggttaccctttaacccggg

SEQ ID NO: 419386 - DNA, 571 bp, Homo sapiens
  misc_feature: GZ8MTXP02F6Q6K.3.26.C04.1.454.CMB.2.raw
tcagagacgcactccacgaccggtgctcgatttagtctagcgactttgggtttgggggaagaggaagactgacggtccagcctgggaggtccctgagactctcctgtgcagcctctggattcagcttcagtgactatgctatgcactgggtccgccaggctccaggcaaggggctgggagtgggtggcacttatatcatatgatggaaagtaaaacgtactacacagattccgtgcagggccgattcacaatctccagagacaactccaaagaacacggtctatctgacaaatgagcagcctgcgagctgaggacaccgtctctttatactgtcgcgagagtcgtggggtgctacggagtacgtggtacttcgatctcgtggggccgtggcacctgctgactgtctcctcacgccctaccaccgaacgggcccacgttcccgggtcccttccccccgtggcccgtccccgtcgcccgtcccgacggacgccgacccgtccggacgacgaccgaccgacggcccggcccgtcgggccgtcggcccgtggtaccgaacggtacctttacccgg

SEQ ID NO: 419387 - DNA, 549 bp, Homo sapiens
  misc_feature: GZ8MTXP02IQCCU.3.26.C04.1.454.CMB.2.raw
  modified_base (338)..(338): a, c, t, g, unknown or other
  modified_base (497)..(497): a, c, t, g, unknown or other
tcagagacgcactccacgaccggtgctcgatttagtctagcgactttgggtttgggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactcaaagaacacggtctatctgacaaatgagcagcctgacgagctagaggaccacgcttctttatactgtgcgagngtcgtggggtgctacgagttacgtggttaccttcgatcgttcggtcgggggtccgtggcctacccgtgcgtgaccttcgtcctccctcgacgccctacccgaaccgaacgggccctacgtccggttccctccccgtcggcccgccctgcctccgaggcnccacctcgacacgcacgcgccggcctggctcgcgtggacaacggtactaccg

SEQ ID NO: 419388 - DNA, 577 bp, Homo sapiens
  misc_feature: GZ8MTXP02G51FI.3.26.C04.1.454.CMB.2.raw
  modified_base (154)..(154): a, c, t, g, unknown or other
  modified_base (293)..(293): a, c, t, g, unknown or other
tcagagacgcactccacgaccggtgctcgatttagtctagcgactttgggtttgggggaagaggaagactgacggtccagcctgggaggtccctgagactctcctgtgcagcctctggattcagcttcagtgactatgctatgcactgggtccnccaggctccaggcaaggggctggagtgggtggcacttatatcatatgataggaaagtaaaacgtactacacagattccgtgacgagggccattcacaatctcagagacaactcaaagacacgtctatctgacaaatgancagcctgcgagctagagacaccgtcttactttatacgtgtcgacgagtacgttcgttagggggcgactacggagttactggttacttcgattcctgtcgggccgtcggccaccgtgcctgactcgtctcctcacgcctaccaaccgacggcccacgttccggtccccttcccccgtcggccctccctcgtccctaccgacggaccgcccgaacccttaccggacgacgaccgaacgccgccggcccgtcgggcctcgcccgttaggaccgaacggtacctaccg

SEQ ID NO: 419389 - DNA, 674 bp, Homo sapiens
  misc_feature: GZ8MTXP02GWFF6.3.26.C04.1.454.CMB.2.raw
  modified_base (268)..(268): a, c, t, g, unknown or other
tcagagacgcactccacgaccggtgctcgatttagtctagcgacttttgggtttgggggaagaggaagactgacggtccagcctgggaggtccctgagactctcctgtgcagcctctggattcagcttcagtgactatgctatgcactgggtccgccaggctccaggcgaaggggctgggagtgggtggcacttatatcatatgataggaaagtaaaacgtactaacacagtattccgtgcgagggccgtattcaacaatctccaganacaactccaaagaacacggtctatctagacaaatgagcacgcctgcgagctggacggaccaccgtcttacttttatacgttgtcgacgagtagtcggtgggggtgactacggagttacgtggtacttcgatcgtcggtcgggggccgtcggccacccgtggccttagtaccttcgttcctccctcgacgtcccctcccgaaacccggtaacggggcccctacggttcccgggttccccttccccccggcgggtcccccggtccccttacggtccccgtacccgaacggggtacccaccccgtacccgtaccggaacggaccgaccgaacccggaccggccccgggtccccggtggggtccctcggtacccggtacgggtaccggaaacggttaccctttacccggg

SEQ ID NO: 419390 - DNA, 599 bp, Homo sapiens
  misc_feature: GZ8MTXP02G0RFJ.3.26.C04.1.454.CMB.2.raw
  modified_base (294)..(294): a, c, t, g, unknown or other
  modified_base (363)..(363): a, c, t, g, unknown or other
  modified_base (427)..(427): a, c, t, g, unknown or other
tcagagacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctgggagtgggtggcacttatatcatatgatggaaagtaaaacgtctaacacagattccgtgcagggccattcacaatctccagagacaactccaaagacacgtctatctgacaaatgancagcctgcgagctggacggaccaccgtcttactttatactgtcgcgagtacgtcgtggggtcgctacgngtactgggtacttcgatcgtcggtcggggtccgtcggccaccgtgctgacttgtcctcctcacnccctaccaaccgacggccctacgttcccggttcccttcccccgtcggtcccgtccccgtcgtccctccggacggaccgacccacccggtaccggacggacgccgaccgccggtcccggtcccggtcggtccgtcgtcccggtcggtaaccgtaaccggtaacctttacccgg

SEQ ID NO: 419391 - DNA, 561 bp, Homo sapiens
  misc_feature: GZ8MTXP02H8UAK.3.26.C04.1.454.CMB.2.raw
  modified_base (404)..(404): a, c, t, g, unknown or other
  modified_base (490)..(490): a, c, t, g, unknown or other
tcagagacgcactccacgaccggtgctcgatttagtctagcgactttgggtttgggggaagaggaagactgacggtccagcctgggaggtccctgagactctcctgtgcagcctctggattcagcttcagtgactatgctatgcactgggtccgccaggctccaggcaaggggctgggagtgggtggcacttatatcatatgataggaaagtaaaacgtactacacagattccgtgcgagggccgattcacaatctccagagacaactccaaagaacacggtactatctagacaaaatgagcagcctgcgagctgaaggaccaccgtcttactttatactgcgcgagagtcgtggggtgctacgagttacgtgtacttcgatctcgtcgggccgtggcacccgngctgactcgtctcctcacgccctaccaccgaacggcccacgtccggtccccttccccgtggccctcccgtgaccctcgacggaccnccaacccgtccggaacacgccacgaccgccggcccgtgggctcggtccgtacggtaccgaacgacttaccg

SEQ ID NO: 419392 - DNA, 534 bp, Homo sapiens
  misc_feature: GZ8MTXP02G98OM.3.26.C04.1.454.CMB.2.raw
  modified_base (496)..(496): a, c, t, g, unknown or other
tcagagacgcactccacgaccggtgctcgatttagtctagcgactttgggtttgggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccattcacaatctcagagacaactccaagaacacggtctatctgacaaatgagcagcctgcgagctgaggacaccgctctttatactgtcgcgagagtcgtggggtgctacgagtactggtacttcgatctcgtggggctggccacctgctgactgtctcctcacgcctccaccgacggcccagtccggtccttcccccgtggcccgcctgcctccgacgacgccacccgtccgagacgccaacgcggccggttcccncggggctcggcccttgggaccaacgggaccttaaccgg

SEQ ID NO: 419393 - DNA, 559 bp, Homo sapiens
  misc_feature: GZ8MTXP02G7QPO.3.26.C04.1.454.CMB.2.raw
  modified_base (332)..(332): a, c, t, g, unknown or other
tcagagacgcactccacgaccggtgctcgatttagtctagcgactttgggtttgggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaagtaaaacgtactacacagattccgtgcagggccgattcacaatctccagagacaactccaagaacacggtctatctgcaaatgagcagctgcgagctgagacaccgctctttatactgtgcgagngtcgtggggtgctacgagtactggtacttcgatcgtcgtgggggccgtggcctacccgtgctgctcgtctcctcacgcctcccacgaacgggccctacgtccgggttccctcccccgtcggcccgtccctcggccctccgacggacgtcccaccgtcccggacgacgcctaccgacggcccggcccgtggcccgtcgcccggtggtaccgaacgggactttacccgg

SEQ ID NO: 419394 - DNA, 725 bp, Homo sapiens
  misc_feature: GZ8MTXP02GJ8HW.3.26.C04.1.454.CMB.2.raw
tcagagacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaaagtaaaacgtactacacagattccgtgcagggccgattcaactaatctaccagacgacaactccaaagaacacggtctatctgacaaatgagcacgcctggcgagcctaggacggaccacccgtctttactttatacgtggtgcggaagtaggttcgggttgggggtagaccgtacgggtagttaaccggttgggtttaacccttcgggtacttccggtttcggggtccgggggtcccggttcgggacccgtaaccccgttggccgttacgggtacctttcggttcccctccctaccgtacccggtaccccttaccccgaaaacccgggaacccgggggtccccctaaccgggtttcccccgggtttccccgtttaccccccccggtcggggtcccccgtccccgttccgcccgttacccgagggtacccgaccctacccgtacggacgaccggccacgacgggttcccgccgtggggtcctcggtcccggtaggtaccgacggtacctttacccgg

SEQ ID NO: 419395 - DNA, 642 bp, Homo sapiens
  misc_feature: GZ8MTXP02FVYVG.3.26.C04.1.454.CMB.2.raw
tcagagacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctgggagtgggtggcacttatatcatatgatggaaagtaaaacgtactacacagattccgtgcagggccattcaacaatctccagagacaactccaaagaacacggtctatctgacaaaatgagcagcctgcgagctggagaccaccgtcttactttatactgcgcgagtagtcgtggggtgctaggatacgtggttaccttcgattcgtcgtcgggggtccgtcggcctaccgtcgcgtcgacgttcgttcctcctaccgaccgcccgtaccccgaacccggaacccggggtcccctaaccgtttcccgggttcccctttccccccggtcggtccccgtccccgtcggtcccaccggtacggaccggacccacccggtaccgacggaccgaccgaaccgccggcccggtcccggcggggtcctccgggtaccggtacggtaccggtaaacggtacctttaacccggg

SEQ ID NO: 419396 - DNA, 678 bp, Homo sapiens
  misc_feature: GZ8MTXP02JVE7W.3.26.C04.1.454.CMB.2.raw
  modified_base (262)..(262): a, c, t, g, unknown or other
  modified_base (277)..(277): a, c, t, g, unknown or other
  modified_base (296)..(296): a, c, t, g, unknown or other
  modified_base (326)..(326): a, c, t, g, unknown or other
  modified_base (371)..(371): a, c, t, g, unknown or other
tcagagacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgataggaaagtaaaacgtactacacagtacttccgtgagggccattcaacaatctccaganacaactccaagaacncgtctatctagacaatgancagcctgacgagtctaggacgaccaccgtnttactttaatcgtgtggaccgagtgtcggtggggtgaccgtaggngttacgtggtaccttgactccgtaggtcgggggacccttggaccctcccgtgccttgtaccttcgtccttcccgacaccgtcccctaccgacccgaaacggggtccccctaggtttccccgggtcccctttcccccggcgggtccccgtcccccttcgggccctcccggaaaggggtccacccctaccccggtaccgggaaacaaccggccctaaccggacccggtcccgggggttacccccggtcgggggtcccgtccgggtacccggttacggtaaccgtaccggttaacccttccggttaccgg

SEQ ID NO: 419397 - DNA, 528 bp, Homo sapiens
  misc_feature: GZ8MTXP02HINYK.3.26.C04.1.454.CMB.2.raw
  modified_base (340)..(340): a, c, t, g, unknown or other
  modified_base (403)..(403): a, c, t, g, unknown or other
  modified_base (414)..(414): a, c, t, g, unknown or other
  modified_base (457)..(457): a, c, t, g, unknown or other
  modified_base (475)..(475): a, c, t, g, unknown or other
  modified_base (477)..(477): a, c, t, g, unknown or other
  modified_base (485)..(485): a, c, t, g, unknown or other
tcagagacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtggggtggcacttatatcatatgatggaaagtaaaacgtactacacagattccgtgcagggccgattcacaatctcagagacaactccaaagaacacggtctatctgacaaatgagcagcctgcgagctgagaccacgcttctttatactgacgcgaagngtcgtggggtgctacgggatacgtggttactcgatcgtcgtggggccgtggctaccctgcgtncgtgtcctccnctacgccctaccaccgaacggccctacgtccggtcctccccgngccgccctgcctcgagcncnccgccgancgcacgtcgccgcccgtggctcgctggtacaacggtactaccg

SEQ ID NO: 419398 - DNA, 686 bp, Homo sapiens
  misc_feature: GZ8MTXP02F53D1.3.26.C04.1.454.CMB.2.raw
  modified_base (295)..(295): a, c, t, g, unknown or other
tcagagacgcactccacgaccggtgctcgatttagtctagcgactttgggtttggggggaagaggaagactgacggtccagcctgggaggtccctgagactctcctgtgcagcctctggattcagcttcagtgactatgctatgcactgggtccgccaggctccaggcaaggggctggagtgggtggcacttatatcatatgatggaaagtaaaacgtactacacagattccgtgcagggccgattcacaatctcagacacaactccaaagaacacggtctatctgacaaatgancacgcctgcgagctggacgacaccgtcttcgtttatacgtgtcgcgagagtcggtggggtcgacgtacggagtacgttacggtaccttgattcgtacgtcgggggtcccgttcggcccgtaacccgtgtccgttacgaccgttcgttcccttcccgtaccgtaccgtaccccgttacccccgtaaacccggaaacccggggtccccctaaccgggtttcccgggttacccccgttttcccccccggtcgggtccccgtccccgtcggtccccgtacccggacggaccgccgtaaccccgtccggaacggacgacccgaacgaccgtcccgggtcccgtcggggtccctacggtccgtacgggttacgaaaaccgggtacctttaacccggg

SEQ ID NO: 419399 - DNA, 645 bp, Homo sapiens
  misc_feature: GZ8MTXP01CS3XU.51.73.G07.1.454.CMB.2.raw
tcagcgatcgtatacacgaccggtgctcgatttagctctacgctcagggcacgaccggtgctcgatttagtgtcgtcgcaagagagaggggggtgggtccaggaggcagaactctgggtgtctcaccatggcctggatccctctacttctccccctctcactctctgcacaggctctgaggcctcctatgagctgacacacgcccacctcggtgtcagtcgtccccgaggacaggacggccaggactcacctgctctggagatgcattgaccaaaaccgtatatgtactttattcggtaacctagcgaacggaacggacccggggaccgacgggtacccccgttggtcggttcggtagtaagtgtaaagttaaaacggacctaacgtagaacggacggtacccctacggaagggactcccgtaggacgacggtacttcgtcgtgtcctcgacggtcgacgggtaacgaacggtcgaactacgttcggacccagtacgtacggtggggtacgtaccggaaggcgaagggacggacgggacgtaccgtggtaacttaagttattgtaacaacttacgaaacacgtaaacaccttagtttacggttacttaagtcgttaacgtacgtacttcgaacgaacgtaaccgg

SEQ ID NO: 419400 - DNA, 601 bp, Homo sapiens
  misc_feature: GZ8MTXP01CWGXS.51.73.G07.1.454.CMB.2.raw
  modified_base (361)..(361): a, c, t, g, unknown or other
  modified_base (378)..(378): a, c, t, g, unknown or other
  modified_base (426)..(426): a, c, t, g, unknown or other
  modified_base (458)..(458): a, c, t, g, unknown or other
tcagcgatcgtatacacgaccggtgctcgatttagctctacgctcagggcacgaccggtgctcgatttagctctacgctcagggcacgaccggtgctcgatttagatagctctcgttgggtttgggctgagctggcttttcttgtggctattttaaaaggtggccagtgtgaggtgcagctgttagagtctgggggaggcttggtccagccgtggggggtccctcagactctcctgtgcagcctcgggaattatatttaagaactttgccatgagttgggtccgcaggctccgagggaagggctggaatgggtctccactattagtggcagcggtgatgacacattctaccacagactcgngaacggggccttcaccntctcagagacaatcgacaaagacacgctactatcgtaggaagtgaagngaccgtgaggagtacggagacgacggccgttntttagttggtggtaggtaagggggcgtggggtaactttaagttcgttacgacgggtaccctagttaacgtttcgtttaggtaacccgtttcggtcggggggtaccccgggtaacggtttccgttcgggttcccgtaaccccgg

SEQ ID NO: 419401 - DNA, 670 bp, Homo sapiens
  misc_feature: GZ8MTXP02H524W.51.73.G07.1.454.CMB.2.raw
  modified_base (329)..(329): a, c, t, g, unknown or other
  modified_base (367)..(367): a, c, t, g, unknown or other
tcagcgatcgtatacacgaccggtgctcgatttagctctacgctcagggcacgaccggtgctcgatttagctctacgctcagggcacgaccggtgctcgatttagatagctctcgttgggtttgggctgagctggcttttctgtggctattttaaaaggtggccagtgtgaggtgcagctgttagagtcgtgggggaggcgttggtccaggccgtggggggtccctcgagactctcctgtgcagcctaggattatattaagacttgccatgagtggtcgcaggctcgagggaggctggatggtctccgatagtagtggcaggcggtgangacacattctacacagacgtcgtgacgggtccttcacntctccagacacgaatcgaaccaaagccacgactcttaatcgtaaggaacgtaggaagacgaccgttagggaaagtacgggttaccgaacgggaaccgttaccgggtccccgttttagtttttaagttgggtacgggtttacggggaacgggggttacccgggttaggggtaaccctttttaagtttacccgttaacgaaaccgggttaaacccttaagtttaaaccgttttagtttacccgtaacgttacccgggtaccgggggtacccggttaatttcccggtagtttaccccctaacccgg

SEQ ID NO: 419402 - DNA, 520 bp, Homo sapiens
  misc_feature: GZ8MTXP01D007V.8.33.C11.1.454.CMB.2.raw
  modified_base (208)..(208): a, c, t, g, unknown or other
  modified_base (257)..(257): a, c, t, g, unknown or other
  modified_base (263)..(263): a, c, t, g, unknown or other
  modified_base (280)..(280): a, c, t, g, unknown or other
  modified_base (495)..(495): a, c, t, g, unknown or other
  modified_base (502)..(502): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtcttgtctccaggggaaangccaccctctcctgcagggccagtcagatgttgcgcttgaagctgacanacaacngcagctcccagcccctnatctatggtgcatccaacagggcccacgtggcatcccagccaggttcagtcgcaggtgggtatgggaacagcttcactctcaccatcatcagcctggagcctagaaagattgttgctagtttattactgttcaaactattaccgtaccgagtcggccgtccgggggcctacgtttccggcctgggaccaagggtgagattacgaaacgaacttgnggctgcnccatcttgttcttctaac

SEQ ID NO: 419403 - DNA, 540 bp, Homo sapiens
  misc_feature: GZ8MTXP01BFU70.8.33.C11.1.454.CMB.2.raw
  modified_base (296)..(296): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgaagctggtaccaacacaaacctggccaggctcccaggcccctnatctatggtgcatcccaacagggccactggcatcccagccaggttcagtcggcaggtgggtatgggaacagaacttcactctcaccatcatcagcctggacgcctagaagatgttgctagtttattactgtacaactatcgtaccgagtcggccgtccgggggcctacgtttccgggcccgtgggaccaagggtcggagacttcgaaacgaattggttgctgcaaccatccttagtcttctaac

SEQ ID NO: 419404 - DNA, 592 bp, Homo sapiens
  misc_feature: GZ8MTXP01C0S4V.8.33.C11.1.454.CMB.2.raw
  modified_base (402)..(402): a, c, t, g, unknown or other
tcagctcgcgtgtccacgaccggtgctcgatttagagtgagctcgttgggttggggaggaactgctcagttaggacccagacggaaccatggaagccccagcgcagcttctcttcctcctgcctactctggctcccagagatcattggagaagtggtgatgacacagtctccggtcaccctgtcttgtttttccgtggggagacgagccaccctctcctgtgcggccagtcagagcgttaaggacgtaacttaggcctaggtatcagcagaggcctggccaggctcccagacctcctcattctttggccgtacctttaacgacgggccaagtcggaactcccagccaggttcaggcggctaggtgggtctgggtacttcgtcactctcacatacaatacctnacaatcagacgtacttgactagtttattctgtcagcagtcctaggtaacgtacgtcggtccgttcgtaaccgtttcggggacggtaacgggacctaaagggtcggaaccctagaaacgtagttgggtacgcgtaggccttaccgattcccgttggttcctccgtacttcccttcccgccttaagttcccg

SEQ ID NO: 419405 - DNA, 521 bp, Homo sapiens
  misc_feature: GZ8MTXP01DT4YR.8.33.C11.1.454.CMB.2.raw
  modified_base (209)..(209): a, c, t, g, unknown or other
  modified_base (260)..(260): a, c, t, g, unknown or other
  modified_base (281)..(281): a, c, t, g, unknown or other
  modified_base (290)..(290): a, c, t, g, unknown or other
  modified_base (372)..(372): a, c, t, g, unknown or other
  modified_base (516)..(516): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgtggcgcttgaagctgacanacaactgcagctccagccctnatctatggncatccaacaggccactggcatcccagccaggtcagtgcagtggtatgggaacagcttcactctcaccatcatcagcctggancctagaagtattgttgactagtttattactgtacaaactagttcgtaaccgagtcggccgtccgggggcctacgttccggcccgtgggaccgaaggtcggagacttacgaaacgtacttgttggctgcaaccatcttgtccttntaacc

SEQ ID NO: 419406 - DNA, 531 bp, Homo sapiens
  misc_feature: GZ8MTXP01A0BJZ.8.33.C11.1.454.CMB.2.raw
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttgtaagctggtaccaacacaaacctggccaggctccccaggcccctcatctatggtgcatccaatagggccactggcatccccagccaggttcagtcgcaggtgggtatggggaacagtcttcactctcaccatcatcagcctggagcctgaagattgttgactagtttattactgtacaactatcgtaccgagtcggccgtccgggggcctacgttccggcccgtgggaccaagggtggagattcgaaacgtattgttggctgcaacgatcttgtcttctc

SEQ ID NO: 419407 - DNA, 521 bp, Homo sapiens
  misc_feature: GZ8MTXP01CUE1L.8.33.C11.1.454.CMB.2.raw
  modified_base (210)..(210): a, c, t, g, unknown or other
  modified_base (245)..(245): a, c, t, g, unknown or other
  modified_base (250)..(250): a, c, t, g, unknown or other
  modified_base (257)..(257): a, c, t, g, unknown or other
  modified_base (263)..(263): a, c, t, g, unknown or other
  modified_base (278)..(278): a, c, t, g, unknown or other
  modified_base (288)..(288): a, c, t, g, unknown or other
  modified_base (373)..(373): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagccaccctctcctgcagggccagtcagatgtgcnctganctgacanacaacngcagctccagccctnatctatggtncatccaacagggccactggcatcccagccaggttcagtcggcagtgggtatgggaacagtcttcactctcaccatcatcagctgncctagaagatgtgctagtttattactgtacaactagtcgtaccgtagtcggccgtccgggggcctacgtttccgggcccgtcgggaccaagggtcggagaattcgaaaacgtacttaggttgacgtgcaaccatcttgtcgttctaac

SEQ ID NO: 419408 - DNA, 591 bp, Homo sapiens
  misc_feature: GZ8MTXP01CWWV3.8.33.C11.1.454.CMB.2.raw
  modified_base (296)..(296): a, c, t, g, unknown or other
  modified_base (404)..(404): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgaagctggtaccaacacaaacctggccaggctcccaggccccctnatctatggtgcatccaacagggccactggcatccccagccaggttcagtcggcagtgggtatggggaacagcttcactctcaccatcatcagcctggagacctaaagntgttgcgttagttactatcgtaacacgtcgtaccggtacgtaggtccggtacccgggtccgggtaccttaccggttcccggtcccgggtacggtaaccggtaagggtaacggaagttacgtaaacggaaacgtaccggtggttacggttcgttcgaacccactcgtcgtcttcctcttaacttcccg

SEQ ID NO: 419409 - DNA, 543 bp, Homo sapiens
  misc_feature: GZ8MTXP01BB12Y.8.33.C11.1.454.CMB.2.raw
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttgtaagctggtaccaacacaaacctggccaggctcccaggcccctcatctatggtgcatccaacagggccactggcatcccagccaggttcagtcggcagtggatgggaacagctcactctcaccatcatcagcctggagcctagaagattgttgctagttattactgtacaaactagtccgtacgagtcggccgtccgggggcctacgtttccggcccgtcgggtaccgaaagggtcggaggacttacgaaaacgtaacgttggttggctgcaaccagtcttgtcttcgtaac

SEQ ID NO: 419410 - DNA, 565 bp, Homo sapiens
  misc_feature: GZ8MTXP01DFV50.8.33.C11.1.454.CMB.2.raw
  modified_base (300)..(300): a, c, t, g, unknown or other
  modified_base (382)..(382): a, c, t, g, unknown or other
  modified_base (425)..(425): a, c, t, g, unknown or other
  modified_base (434)..(434): a, c, t, g, unknown or other
  modified_base (438)..(438): a, c, t, g, unknown or other
  modified_base (470)..(470): a, c, t, g, unknown or other
  modified_base (544)..(544): a, c, t, g, unknown or other
  modified_base (551)..(551): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaaggggaaagagccacctctctgcagggccagtcagaatgttggcgcttcgtaagctaggtaaccaaacacaaacctggccaggcctcccaggcccctnatctatggtgcaatccaaacgacgggcccacgtggacaactccccgaagccctaagggttcaggtcggctaggtggggtaanggggaaacaggaacttcactctacaccatcatcagcctggacnctagaagtntgtnattagtttatactagtacaactagtacgacgngtcggccggtcgggtacctcgttccggccgtacgggaacgtaaggtgaagtacaacgaaacgtgttggcgcgtnacaactntcgttctcttcgtc

SEQ ID NO: 419411 - DNA, 534 bp, Homo sapiens
  misc_feature: GZ8MTXP01AB58F.8.33.C11.1.454.CMB.2.raw
  modified_base (207)..(207): a, c, t, g, unknown or other
  modified_base (517)..(517): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgctccaggggaaanagccaccctctcctgcagggccagtcagaatgttggcgccttcgtaagctggtaccaacacaaacctggccaggctcccaggcccctcatctatggtgcatccaatagggccatggcatcccagccaggttcagtcggcagtgggtatggggaacagaacttcactctcaccatcgatcagcctggagcctagaagatgttgactagtttatactgtacaacatcgaccgagtcggccgttccgggggcctacgtttccgggccctcgggaccgaaggtggagattacgaaagaacttggttcggctgcnccatcttgtcttaactc

SEQ ID NO: 419412 - DNA, 630 bp, Homo sapiens
  misc_feature: GZ8MTXP01C7QZA.8.33.C11.1.454.CMB.2.raw
  modified_base (250)..(250): a, c, t, g, unknown or other
  modified_base (288)..(288): a, c, t, g, unknown or other
  modified_base (298)..(298): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccaccctgtctttgtctccgaaggggaaagagcccaccctctcctgcagggccagtcagaatgtggcncttgaagctgacaacacaactgcaggctcccagccctnatctatggtncactcccaaacgacgggcccacgtggcactcccagccaggttcaggtcggcaggtgggtatggggaacagtcttcactctacaccatcaatcagcctaggacgcctagaaagtattgtgacttagtttattacgtgtacgtaaactacgttccgtaaccggagtccggcccggtcccgggggtaccctaccggtttccccgggacccggttacggggaacccgtaaggggtcgggaacgtaacgttaaccgaaaaaccggtaccgttagggttcgggaccgttcggaccctaacccgtagttcctttacggtttccttttaacgttcccccg

SEQ ID NO: 419413 - DNA, 577 bp, Homo sapiens
  misc_feature: GZ8MTXP01A2OUH.8.33.C11.1.454.CMB.2.raw
  modified_base (287)..(287): a, c, t, g, unknown or other
  modified_base (391)..(391): a, c, t, g, unknown or other
  modified_base (402)..(402): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagacgcccaccctctcctgcagggccagtcagaatgtgcgccttgagctgaccaacacaactgccaggctcccagccctnatctatggtgcatccaacacggggccacgtggcatcccagccaggttcagtcggcaggtgggtatggggaacagtcttcactctcaccatcatcagcctggacncctagaaagtntgttgacttagtttattactgtacaactagttccgtaccgaggttcggcccggttccgggggacctaccggtttccgggacccgttcggggacctaaggggtcggagtaacttacgaaaacggtacgttggttcgggactggacctaacctagtccgttcgttccttcgtaaccg

SEQ ID NO: 419414 - DNA, 528 bp, Homo sapiens
  misc_feature: GZ8MTXP01BLHXZ.8.33.C11.1.454.CMB.2.raw
  modified_base (209)..(209): a, c, t, g, unknown or other
  modified_base (287)..(287): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagatgtgcgcttgaagctgtacaacacaaactggcaggctcccaggcccctnatctatggtgcatccaacagggccactggcatcccagccaggttcagtcggcagtgggtatgggaacagcttcactctcaccatcatcagcctggagcctgaagatgttgctagtttattactgtacaactatccgtacgagtcggcccgtccgggggcctacgtttccggcccgttggggacccaagggtcggagattacgaaacgaacttgttggctgcaaccatcttgtcttcgtaac

SEQ ID NO: 419415 - DNA, 570 bp, Homo sapiens
  misc_feature: GZ8MTXP01DWIXZ.8.33.C11.1.454.CMB.2.raw
  modified_base (298)..(298): a, c, t, g, unknown or other
  modified_base (308)..(308): a, c, t, g, unknown or other
  modified_base (383)..(383): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagaatgttggcgtccttgtaagctggtaccaacacaaacctggccaggctcccaggcccctnatctatggtncatccaacgacgggccacgtggacactcccagccaggttcagtcggcaggtgggtatgggaacagtcttcactcncaccatcatcagtcctggacgcctagaaagtatgtgtacttagtttattactgttacaaactacgtacgtacgaggtcggcccggtccggggcctaccgtttccgggccctggggaccaagggtcggaagacgttacgaaaacgtagttgttggcttggactaaccgatcgttacgtcttcgtaacc

SEQ ID NO: 419416 - DNA, 633 bp, Homo sapiens
  misc_feature: GZ8MTXP01AG9GQ.8.33.C11.1.454.CMB.2.raw
  modified_base (328)..(328): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaagggaaagacgccaccctctcctgcagggccagtcagaatgttggcgtccttcgtaagctggtaaccaacacaaacctggccaggcctcccacggcccctcactctagtggtgcactcccaaacgnggggccacgtggcacgtcccagccaggttcaggtcggacaggtgggtatggggaaacagtaacttcactctacacatcatcagcctgagcctagaagatgtgctagtttatacgtgtacgaaactgttccggtaccgaggtcgggcccggttcccgggggacctaccggttttccggggaccccgtttcgggggaacccgtaaaggggttcgggaacgtaacgttaccgaaaaaccgggtaacgttcgggttacgggttcctaacgggacctaaccgtattccgttcgttccgtttcgtaacccg

SEQ ID NO: 419417 - DNA, 530 bp, Homo sapiens
  misc_feature: GZ8MTXP01DEZ3Y.8.33.C11.1.454.CMB.2.raw
  modified_base (211)..(211): a, c, t, g, unknown or other
  modified_base (245)..(245): a, c, t, g, unknown or other
  modified_base (265)..(265): a, c, t, g, unknown or other
  modified_base (280)..(280): a, c, t, g, unknown or other
  modified_base (511)..(511): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagttttcagataccaccggagagattgtgttgacacagtctccagccaccctgttctttgtctccgaggggaaanagccaccctctcctgcaggccagtcagatgtgcncttgaagctgacacacaacngcagctccagccctnatctatggtgcatccaatagggccactggcatcccagccaggttcagtggcaggtggtatgggaacagcttcactctcaccatcatcagcctggacgcctagaagtattagttgactagtttattacttcgtacaactacgttacgtaccggtaggtcggtccgtccgggggcctaccgtttcggcccgtgggaccgaaggtggagacttcgaaacgtagttgttgctgcncgatcttgttcttcgtaac

SEQ ID NO: 419418 - DNA, 559 bp, Homo sapiens
  misc_feature: GZ8MTXP01B42NR.8.33.C11.1.454.CMB.2.raw
  modified_base (210)..(210): a, c, t, g, unknown or other
  modified_base (246)..(246): a, c, t, g, unknown or other
  modified_base (253)..(253): a, c, t, g, unknown or other
  modified_base (282)..(282): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccaccctgtctttgtctccaggggaaanagcccaccctctcctgcagggccagtcagatgtgcnccttganctgacaacacaactgcagctcccagcccnatctatggtgcatccaacagggccacgtggccatccccagcccaggttcagtcggcaggtgggtatgggaacagcttcactctcaccatcatcagcctggacgcctagaaacgtatgttgacttagtttacttactagttacaaactagttccgtaccggtagtccggcccgttccgggggacctacggtttccggcccgtcggggacccgtaagggtcggagacttacgaaaacggtacttaggttggctggccaacctatcgttgtcttcgtaac

SEQ ID NO: 419419 - DNA, 547 bp, Homo sapiens
  misc_feature: GZ8MTXP01CN4BQ.8.33.C11.1.454.CMB.2.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttgtaagctggtaccaacacaaacctggccaggctcccacggcccctcatctatggtgcatccaacgagggcccactggcatccccagccaggttcagtcggcaggtgggtatggggaacagcttcactctcacatcatcagctgagcctagaagatgttgctagtttattactgtacaactactcgtaccgtagtcggtcccgtccgggggcctacgtttccggcccgtcgggaccgaaggtcggagacgttacgaaacgtacttgttggcgtgcaaccagtcttcgtcttcgtaac

SEQ ID NO: 419420 - DNA, 536 bp, Homo sapiens
  misc_feature: GZ8MTXP01C9B0W.8.33.C11.1.454.CMB.2.raw
  modified_base (293)..(293): a, c, t, g, unknown or other
  modified_base (303)..(303): a, c, t, g, unknown or other
  modified_base (394)..(394): a, c, t, g, unknown or other
  modified_base (403)..(403): a, c, t, g, unknown or other
  modified_base (407)..(407): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagcccaccctctcctgcagggccagtcagaatgtggcgcttgtaagctggaccaacacaaactggccaggctcccagcccctnatctatggtncatcccaagagggccatggcatcccagccaggttcagtcggcaggtgggtatggggaacagtcttcaactctcaccatcatcagcctggancctagaagntgtnctagtttattactgtacaactagtcgtacgagtcggccgtaccgggggcctacgttccggccgtgggaccgtaagggtcgagagttacgaaacgacttggttcgctgcaacagtcttgtctttaatccg

SEQ ID NO: 419421 - DNA, 538 bp, Homo sapiens
  misc_feature: GZ8MTXP01ANMQV.8.33.C11.1.454.CMB.2.raw
  modified_base (209)..(209): a, c, t, g, unknown or other
  modified_base (293)..(293): a, c, t, g, unknown or other
  modified_base (401)..(401): a, c, t, g, unknown or other
  modified_base (520)..(520): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgtttacacagtctccagccaccctgtctttgtctccaggggaaagngccaccctctcctgcagggccagtcagaatgttgcgccttgaagctggtaccaacacaaacctggccaggctcccaggcccctnatctatggtgcatcccaaacgacggggcccacgtggccatccccagccaggttcagtggccaggtgggtatgggacaagacttcactctcaccatcatcagcctgganctagaagatgttgctagtttattactgtacaactatcgtaccgaggtcggcccgtccgggggcctaccgttcgcccgtggaccaggtgagatacgaaacgacgtgttggcttcgcactntctgttcttcgcttcccg

SEQ ID NO: 419422 - DNA, 583 bp, Homo sapiens
  misc_feature: GZ8MTXP01B9ZZI.8.33.C11.1.454.CMB.2.raw
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagaatgttggcgccttgtaagctggtaccaacacaaacctggccaggctcccaggcccctcatctagtggtgcatcccaaatcgggccacgtggcatcccagccaggttcaggtcggcaggtgggtatggggaacagtcttcactctcaccatcatcagccgtggacgcctagaagtatgttgacttagtttattactgtactaactagtaccgtaccgaggtccggcccggtccgggggtccctaccgtttccggcccgtgggaacccgaagggtcggacgacgttacgaaacggtacgttaggttcggcgtggacctaacctatcgttcgttaaccttcgtaaccg

SEQ ID NO: 419423 - DNA, 599 bp, Homo sapiens
  misc_feature: GZ8MTXP01EGLEA.8.33.C11.1.454.CMB.2.raw
  modified_base (289)..(289): a, c, t, g, unknown or other
  modified_base (299)..(299): a, c, t, g, unknown or other
  modified_base (307)..(307): a, c, t, g, unknown or other
  modified_base (390)..(390): a, c, t, g, unknown or other
  modified_base (400)..(400): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccacctgtctttgtctccgaggggaaagacgccaccctctcctgcagggccagtcagaatgttggcgccttgaagctggtaccaacacaactgcagctccagccctnatctatggtncatccaanaggccatggcactcccagccaggttcagtcggcaggtgggtatgggaacagtcttcactctacacctatcatcagcctggacncctagaaagngttgtgacttagtttacttactgtacaaactagttccggtaaccgaggtccggccccggttcccgggggcccttaccggtttcccgggccccgttacggggaacccgtaaaggggttcggaaggacttaacgaaaaccggtacgttagggttcgggaccttggaccctaaccgtactccgttgttccctttcgtaaccc

SEQ ID NO: 419424 - DNA, 776 bp, Homo sapiens
  misc_feature: GZ8MTXP01DA3YA.8.33.C11.1.454.CMB.2.raw
  modified_base (209)..(209): a, c, t, g, unknown or other
  modified_base (292)..(292): a, c, t, g, unknown or other
  modified_base (302)..(302): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaanagccaccctctcctgcagggccagtcagaatgttggcgtcttcgaagctaggtaccaacacaactgccagctcccacgccctnatctatggcncactccaaacgagggcccaacgtcggaccaacgtcccccgaagtccccgtaaggggtttccaagggttcgggaccgtaaaggggtgggggttaaagtcggggggaaaaccctaagggtaaccctttacaacccttaccctacccaaacccctaattccaaacttacccaaggtcccgtagggaacggtcccttaagggaaaggtattcggttagtacttaagttttaacttaacttcggtaacgtaaaaccgtacgttaacccggtaacccgggtaggttcccggggtccccggttcccggggggtaccccttaacccggttttcccgggggacccccggttacgggggaaacccggtaaagggggttagggaaacggtaaacgttaaaccggaaaaccggtaacgttagggttcgggaccttaacgggacccaaccgtacgttccttcggtttaacccgtttcccgttaaccg

SEQ ID NO: 419425 - DNA, 544 bp, Homo sapiens
  misc_feature: GZ8MTXP01AI65N.8.33.C11.1.454.CMB.2.raw
  modified_base (295)..(295): a, c, t, g, unknown or other
  modified_base (314)..(314): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttgcgccttgtaagctggtaccaacacaaacctggccaggctcccaggcccctnatctatggtgcatccaacngggccatggcatcccagccaggttcagtcgcaggtggtatgggaacagtcttcactctcaccatcatcagcctggacgcctgaagatgttgctagtttattactgtacaacagttcgaccgaggtcggccgtccgggggcctacgtttccggcccgtcggggaccaagggtcggagacgttacgaaacgaacttggttcggactgcaacctatcgttgtccttcgtaacc

SEQ ID NO: 419426 - DNA, 537 bp, Homo sapiens
  misc_feature: GZ8MTXP01DXSDF.8.33.C11.1.454.CMB.2.raw
  modified_base (211)..(211): a, c, t, g, unknown or other
  modified_base (247)..(247): a, c, t, g, unknown or other
  modified_base (267)..(267): a, c, t, g, unknown or other
  modified_base (282)..(282): a, c, t, g, unknown or other
  modified_base (301)..(301): a, c, t, g, unknown or other
  modified_base (381)..(381): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgttctttgtctccgaggggaaanacgccaccctctcctgcagggccagtcagatgtgcncttgaagctgacacacaacngcagctccagccctnatctatggtgcatccaacngggccagtggccatcccagccaggttcagtcggcaggtgggtatgggaacagcttcactctcaccatcatcagcctgganctgaagtattgtgctagtttattactgtacaactagtacgtacgagtcggccgtccgggggcctacgttccggccgtgggaccgaaggtggagacgttacgaaacgtacgttaggttcggacgtggccaaccgtatccgttcgttccttctaaccg

SEQ ID NO: 419427 - DNA, 576 bp, Homo sapiens
  misc_feature: GZ8MTXP01DYEVE.8.33.C11.1.454.CMB.2.raw
  modified_base (209)..(209): a, c, t, g, unknown or other
  modified_base (246)..(246): a, c, t, g, unknown or other
  modified_base (283)..(283): a, c, t, g, unknown or other
  modified_base (293)..(293): a, c, t, g, unknown or other
  modified_base (390)..(390): a, c, t, g, unknown or other
  modified_base (399)..(399): a, c, t, g, unknown or other
  modified_base (404)..(404): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgtggcncttgaagctgacaacacaaactgcagctccagccctnatctatggtncatcccaaacgagggccacgtggcaactccccagccaggttcagtcggcagtgggtatgggaacagcttcactctacaccatcaatcagcctggacnctagaagtnttgtnacttagtttacttactagtacaactacgtacgtacgaggtccggtcccggtccggggtacctacggttcccgggacccgtacgggaaccgtaagggtacggaacgaacgttaacgaaaacgtacgttggttcggctaacgacctaacctatccgttacgttccttcgtaacc

SEQ ID NO: 419428 - DNA, 623 bp, Homo sapiens
  misc_feature: GZ8MTXP01EGFFP.8.33.C11.1.454.CMB.2.raw
  modified_base (291)..(291): a, c, t, g, unknown or other
  modified_base (301)..(301): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagaatgttggcgccttgaagctgaccaacacaactggccaggctcccagcccctnatctatggtncatccaacagggccactggcatcccagccaggttcagtcggcaggtgggtatgggaacagcttcactctcaccatcatcagcctggagcctagaagtatgttgacttagtttaattactcgtacaaactacgttaccgtaccggaggtcggcccggttcccggggggtaccctaccggtttcccggggaccccgttacgggggaacccgtaaaggggttcggaaacggtaacgttaaccgaaaaccggtaaacgttcgggttcgggaccgttcgggacccaaccccgtaattccgttacggtttcccgtttccgttaacccg

SEQ ID NO: 419429 - DNA, 546 bp, Homo sapiens
  misc_feature: GZ8MTXP01AUE6E.8.33.C11.1.454.CMB.2.raw
  modified_base (370)..(370): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtcggcagtgggtatggggaacagcttnactctcaccatcatcagcctggacgcctagaaacgattggttgctagtttacttactgtacgtaaactattccgtaccgagtcggcccgtccgggggcctacgtttccggcccgttcgggaccaagggtggagacttacgaaacgaacttgcggctgcaacatcttgtcttctaac

SEQ ID NO: 419430 - DNA, 572 bp, Homo sapiens
  misc_feature: GZ8MTXP01DRFO2.8.33.C11.1.454.CMB.2.raw
  modified_base (304)..(304): a, c, t, g, unknown or other
  modified_base (324)..(324): a, c, t, g, unknown or other
  modified_base (534)..(534): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggaggtcacagagactctcctgtgcagcctctgggttcaccttcagtagctacggcatgcacgtgggtcccnccaaactccgaggcaagggnttggagtgggtggctagtttgttcattccgtggagggcagttgtacaatgggtatggctgacgcggtaggaagggccgtattcacatctaccagacgacaactaccagaaacactaataggttacgtttaggacctagaacacgacctaagtacctgtaggacgacgggtgtaatacttacgtagttaacggaaaggggagggggaccgnggacgggaagtacaagtctcgttgtaacgttcgtcggg

SEQ ID NO: 419431 - DNA, 517 bp, Homo sapiens
  misc_feature: GZ8MTXP01EBW07.8.33.C11.1.454.CMB.2.raw
  modified_base (250)..(250): a, c, t, g, unknown or other
  modified_base (256)..(256): a, c, t, g, unknown or other
  modified_base (263)..(263): a, c, t, g, unknown or other
  modified_base (269)..(269): a, c, t, g, unknown or other
  modified_base (275)..(275): a, c, t, g, unknown or other
  modified_base (283)..(284): a, c, t, g, unknown or other
  modified_base (291)..(291): a, c, t, g, unknown or other
  modified_base (298)..(298): a, c, t, g, unknown or other
  modified_base (425)..(425): a, c, t, g, unknown or other
  modified_base (500)..(500): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccaccctgttctttgtctccgaaggggaaagacgcccaccctctcctgcagggccagtcagatgtgcncttganctgacanacaacngcagcnccagcccnntctatgncatcacnggcactgcatccagccaggtcagtcgcaggtggtatgggaacagtcttcacttctacaccatcatcacgcgtggacgcctagaaagtattgtgactagtttaacttactgtacaactgtacgtacgngtcggccgtccggggcctcgttcggccgtcgggacgaaggtgagtattacgaaacgtacttggttcggactgacnctatcgttctcgttctc

SEQ ID NO: 419432 - DNA, 577 bp, Homo sapiens
  misc_feature: GZ8MTXP01C3P0W.8.33.C11.1.454.CMB.2.raw
  modified_base (209)..(209): a, c, t, g, unknown or other
  modified_base (285)..(285): a, c, t, g, unknown or other
  modified_base (295)..(295): a, c, t, g, unknown or other
  modified_base (396)..(396): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcgcttgtaagctagacaacacaactgcagctccagccctnatctatggtncatccaacgcgggccacgtcggacactcccagcctaggttcaggtcggctaggtgggtagtgggaacagtcttcactctaccacatcatcagcctaggacncctagaagtattgtgacttagtttacttactgtacaaacgtcgtacggtaccgaggtccggcccgtccgggggacctacgttccgggccctagggaaccgtaagggtcggaagtacaaccgaaaacggtcttagggcggacttcggacctaaccgtattccgttacgttccttcgtaaccc

SEQ ID NO: 419433 - DNA, 556 bp, Homo sapiens
  misc_feature: GZ8MTXP01DG9UJ.8.33.C11.1.454.CMB.2.raw
  modified_base (400)..(400): a, c, t, g, unknown or other
  modified_base (442)..(442): a, c, t, g, unknown or other
  modified_base (509)..(509): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctcctgtgcagcctctgggtcaccttcagtagctacggcatgcactgggtcccgaccaaactccaggcaaggggattgggagtggggtggctaggtttgttcatccgtggagggctagtgttacaatggtatgctgacgcgtgaggcatcacntctcagacgacactcagaacacaatgtattggacctagaacncgcctaagtcctagagacgacgggtgtaatacgttacgtacgttaacggaagggtagggggaaccgngggacgggtaagttacgaagtactcgttcgtaacgttcggtccgggg

SEQ ID NO: 419434 - DNA, 585 bp, Homo sapiens
  misc_feature: GZ8MTXP01BCN3B.8.33.C11.1.454.CMB.2.raw
  modified_base (252)..(252): a, c, t, g, unknown or other
  modified_base (289)..(289): a, c, t, g, unknown or other
  modified_base (299)..(299): a, c, t, g, unknown or other
  modified_base (465)..(465): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgttctttgtctccgaaggggaaagacgccaccctctcctgcgagggccagtcagaatgttggcncttgaagctgacaacacaactgcaggctccagccctnatctatggtncactcccaacgagggcccacgtggaccactccccgagcctaggttcaggtcggcaggtgggtaatgggaacagtctcacttcacacatcatcagcctggacgtcctagaaacgtgttgttcgacttagtttacttacgtgttacaaacttacgtaccgtaaccggngtaccgggcccgtccgggggtcctacgtttccgggcccgttagggaaccaagggtcgaagtacttaccgaaacggtacttggcgctaaggacctaacgtcgttcttcgttccttcgtaac

SEQ ID NO: 419435 - DNA, 605 bp, Homo sapiens
  misc_feature: GZ8MTXP01DP0HP.8.33.C11.1.454.CMB.2.raw
  modified_base (276)..(276): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtagtccagcctgggagtcacagagactctcctgtgcagcctgtggttcaccttnagtagctacggcatgcacgtcgggtcccgaccaaaactccgaagggacaaagggggtatttgggaggtgggggtggcttaggtttgtttcagttccgtggaggggctaaggttgttaacaaagttgggtatggctggaccgcggtaggaacgggccgatcacatctacagacgacaacacaagaacacaatggtatttggacctagaacacgacctaagtcctaggaaggacgtacgggtgtaactaacgttacgtaggaacggaaaggggaacgggggaaccgagggacgggaagttaccgaagtctcgttgaacgttcgtaacgggg

SEQ ID NO: 419436 - DNA, 671 bp, Homo sapiens
  misc_feature: GZ8MTXP01B0EXV.8.33.C11.1.454.CMB.2.raw
  modified_base (298)..(298): a, c, t, g, unknown or other
  modified_base (308)..(308): a, c, t, g, unknown or other
  modified_base (418)..(418): a, c, t, g, unknown or other
  modified_base (430)..(430): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagacgccaccctctcctgcagggccagtcagaatgttggcgtccttgaagctggtaccaacacaaacctggccaggctcccaggcccctnatctatggtncactccaacgacgggcccacgtggccaactccccgaagccctaaggttccaggtcggctaggtggggtatggggaacagtcttcactctcaccatcatcagcctgggacncctagaaacgtnttggttagcttaagtttatacgtgtacaactacgttaccggtaccgtaggttccgggccccggttccccggggggtacccttaacccgggttttccccggggaccccggtttacggggggaaaccccgtaaagggggttcgggaaacggtaaccgttaaccggaaaaaaccggtaacgttcgggttcgggaccgttcggaccctaaccgtacttccgttacggttcctttaacgtaacccg

SEQ ID NO: 419437 - DNA, 615 bp, Homo sapiens
  misc_feature: GZ8MTXP01DH7X2.8.33.C11.1.454.CMB.2.raw
  modified_base (292)..(292): a, c, t, g, unknown or other
  modified_base (302)..(302): a, c, t, g, unknown or other
  modified_base (394)..(394): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgtggcgcttcgtaagctggtaccaacacaaactggcaggcctccaggcccctnatctatggtncatccaaagtacgggcccatggcatcccagccaggttcagtcggcaggtggtatgggaacagcttcactcacaccatcatcagcctgggacncctagaagattgtgctagtttatacttgtacaactataccgtaccgagtcggcccgtccgggggtaccctaccggtttccgggaccccgtcggggaacccgtaacggggtgggttaacgtaacgttaccgtaaaaccggtaacgttcgggttcgggttaccgttcgggaacccctaaccttaacggttccttacggtttaacccgttttaaccgtaacccg

SEQ ID NO: 419438 - DNA, 651 bp, Homo sapiens
  misc_feature: GZ8MTXP01AV032.8.33.C11.1.454.CMB.2.raw
  modified_base (508)..(508): a, c, t, g, unknown or other
  modified_base (545)..(545): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtagtccagccgtgggagtcacagagactctcctgtgcagcctcgtggtcaccttcagtagctacgcatgcacgtcgggtcccaccaaactccgaggacaagggtattgggagttgggtgcttagttgttcagtccgtggaggtctaggtgttaacaagtggtatgctacggaccggccggtagggaacgggccgtattccacgtactcctacccgaagacgtaaccaaccgtaccgaaggaaaccactaaagttcggggtttaacgttacgggaacctagaaacncgtacccgtaagtcccgtaggaacggacgtacgggtntaacgtaacgttacggtaggttaacgggaaaggggacgggggaaccgcgggacgggtaacgtaccgtaacgttccgttcgttacggtaaccgttcggtaaccgggg

SEQ ID NO: 419439 - DNA, 545 bp, Homo sapiens
  misc_feature: GZ8MTXP01ALLAS.8.33.C11.1.454.CMB.2.raw
  modified_base (208)..(208): a, c, t, g, unknown or other
  modified_base (296)..(296): a, c, t, g, unknown or other
  modified_base (316)..(316): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccagggaaanagccaccctctcctgcagggccagtcagaatgttggcgccttcgtaagctggtaccaacacaaacctggccaggctcccaggcccctnatctatggtgcatccaaacngggccactggcactccccagccaggttcagtcggcaggtgggtatgggaacagcttcactctcaccatcatcagcctggacgcctagaagattgttgctagtttattactgtacaactagtcgtaccgagtcgggccgtccgggggtcctaccgtttccggcccgtgggacccgaagggtggagacttacgaaacgtacgttgttcggctgcaaccatcttgtcttctc

SEQ ID NO: 419440 - DNA, 584 bp, Homo sapiens
  misc_feature: GZ8MTXP01BD6F4.8.33.C11.1.454.CMB.2.raw
  modified_base (503)..(503): a, c, t, g, unknown or other
tcagctcgcgtgtccacgaccggtgctcgatttagagtgagctcgttgggtttggggagctctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctcctgtgcagcctctgggttcaccttcagtagctacggcatgcacgtggggtccccaccaaactccgaaggcgaaagggggtatttgggaggtgggggtggctaggtttgtttcccattcgtggaggggctaaggttgttcaaagtgggtatggctggacgccgtgaacgggccattcacatctccagagacaactccaagaacacaatgtattgacctgaacagacctaagtcctgacgacgaacgggtnttatacttacgtaggtaacggaaggggagggggaaccaagggacgggtaacgttaccaaggttacctccgtttggaaccgg

SEQ ID NO: 419441 - DNA, 556 bp, Homo sapiens
  misc_feature: GZ8MTXP01CDIO2.8.33.C11.1.454.CMB.2.raw
  modified_base (326)..(326): a, c, t, g, unknown or other
  modified_base (401)..(401): a, c, t, g, unknown or other
  modified_base (404)..(404): a, c, t, g, unknown or other
  modified_base (415)..(415): a, c, t, g, unknown or other
  modified_base (440)..(440): a, c, t, g, unknown or other
  modified_base (462)..(462): a, c, t, g, unknown or other
  modified_base (501)..(501): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctcctgtgcagcctctgggttcaccttcagtagctacggcatgcacgtgggtccccaccaaactccgaggcaaggggtnttggagtgggtggctagtttgttcatccgtggagggctagtgtacaatggtatgctgacgcgtgacggcatcacntcncagagacaacncagaacacaatgtattgacctgacngctagtctgaggacgacgggtntaatacttacgtaggacggaaaggggacgggggaaccgngggacgggtaacgttaccgaagttactccgttggtaaccgttcggtaaccggggg

SEQ ID NO: 419442 - DNA, 667 bp, Homo sapiens
  misc_feature: GZ8MTXP01CCVC1.8.33.C11.1.454.CMB.2.raw
  modified_base (295)..(295): a, c, t, g, unknown or other
  modified_base (393)..(393): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagaatgttggcgcttgaagctggtaccaacacaaacctggccaggctcccaggcccctnatctatggtgcatccaaacgagggcccacgtggcatcccagccaggttcagtcggctaggtcggggtatcggggaacagtcttcaactcctcaacccntcaatccagcctgggacgcctaggaaacgtagttcgttgacttaagttttaacttacgtcgttaccaaacgttacgttaccggtaaccggtaggttccgggaccccggttccggggggacccttaccggttttcccggggccccggttacgggggtaaccccggtaaaggggttcggggaaacggtaacgttaccgaaaaacccgggtacgttcggggttcgggacccttcgggacctaacccgattccgttcgtttcccgtttcgttaacccg

SEQ ID NO: 419443 - DNA, 587 bp, Homo sapiens
  misc_feature: GZ8MTXP01DD8R8.8.33.C11.1.454.CMB.2.raw
  modified_base (288)..(288): a, c, t, g, unknown or other
  modified_base (297)..(297): a, c, t, g, unknown or other
  modified_base (360)..(360): a, c, t, g, unknown or other
  modified_base (400)..(400): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctccagtttcagataccaccggagagattgtgttgacacagtctccagccaccctgtctttgtctccgaggggaaagagccacctctctgcagggccagtcagaatgttggcgtcttgaagctagacaacacaacctggcaggctcccacgccctnatctatggncactccaaacgacgggccactggaccactccccagcctaggttcaggtcggctaggtgggtangggaacagtcttcactctacaccatcatcagccgtggacnctagaagtatgttacgcttagtttatacttgtacaactacgtacgtaccggtagtccggtcccggtaccgggggtaccctacgtttcccggggacccgtcggggaaccgaagggtggaacgtaacttacgaaaacggtacttggttcggctaagacctaacgtattcgttacgtccgtttcgtaacc

SEQ ID NO: 419444 - DNA, 587 bp, Homo sapiens
  misc_feature: GZ8MTXP01AJS1P.8.33.C11.1.454.CMB.2.raw
  modified_base (209)..(209): a, c, t, g, unknown or other
  modified_base (290)..(290): a, c, t, g, unknown or other
  modified_base (309)..(309): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagatgttgcgccttgtaagctgtaccaacacaactggccaggctcccagcccctnatctatggtgcatccaacngggccactggcatcccagccaggttcagtcggcaggtggtatggggaacagcttcactctcaccatcatcagtcctggacgcctagaagtatgttgacttagtttattacttgtacgaactacgttccgtaccgtagtcggcccgtcccgggggtccctaccgtttccgggccccgttcggggacccgtaagggtcgggttaggaacgttacgaaaacggtaacgttcggttcggttcgtaacggccaaccgtactccgttcgttcctttcgtaaccg

SEQ ID NO: 419445 - DNA, 562 bp, Homo sapiens
  misc_feature: GZ8MTXP01A8OIS.8.33.C11.1.454.CMB.2.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaaggggaaagagccaccctctcctgcagggccagtcagaatgttggcgtcttcgaagctggtaccaacacaaactggccaggctcccaggcccctcatctatggtgcatccaacgagggccacgtggcactccccagccaaggttcaggtcggcaggtgggtatggggaacagcttcactctcaccatcatcagcctggagcctagaagtatgttgcttagtttattactgtacaaactagtaccgtacgagtcggcccggtccgggggcctacgttccggcccgtgggaccgaagggtcggagacgttacgaaacgtaacgttggttcggctggacaacgtactcttcgtccttaacgtc

SEQ ID NO: 419446 - DNA, 620 bp, Homo sapiens
  misc_feature: GZ8MTXP01EHRTK.8.33.C11.1.454.CMB.2.raw
  modified_base (289)..(289): a, c, t, g, unknown or other
  modified_base (398)..(398): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccaccctgtctttgtctccgaggggaaagagccaccctctcctgcagggccagtcagaatgttggcgcttgaagctgaccaacacaactggcagctcccaggccctnatctatggtgcatccaacagggccacgtggcatcccagccaggttcagtcggctaggtgggtatggggaaacagtaacttcgaactctcaccatcatcagtcctggacncctagaaagtattgttgcttagtttaattacgtgtacgtaaactacgttaccgtaaccggaggtcgggtccccggttaccggggggacccttaccggtttcccgggccccgttaggggaaacccgtaaaggggttcgggaagtaacgttaacgaaaaccggtaaacgttgggttacgggcttaacggacctaacctattccgttagttcctttcgtaacccg

SEQ ID NO: 419447 - DNA, 572 bp, Homo sapiens
  misc_feature: GZ8MTXP01AE1SL.8.33.C11.1.454.CMB.2.raw
  modified_base (207)..(207): a, c, t, g, unknown or other
  modified_base (241)..(241): a, c, t, g, unknown or other
  modified_base (247)..(247): a, c, t, g, unknown or other
  modified_base (260)..(260): a, c, t, g, unknown or other
  modified_base (275)..(275): a, c, t, g, unknown or other
  modified_base (285)..(285): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacctgtctttgctccgaggggaangccaccctctcctgcagggccagtcagatgtgcncttganctgacacacaacngcagctccagccctnatctatggtncatccaacgcgggccacgtggcactcccagccaggttcagtcgcaggtgggtatgggaacagcttcactctcacatcatcagcctggacgctagaagtatgttgcttagtttattacgtgtacgtaactagtccggtaccgtaggtcggcccgtccgggggtccctaccgtttcccgggcccgttcggggaacccgtaagggtcgggaacgtacgttaacgaaaccggtaacgttggttcggttaccgtggaccgtaacctagttccttacgttccttccgtaaccg

SEQ ID NO: 419448 - DNA, 536 bp, Homo sapiens
  misc_feature: GZ8MTXP01ETOFB.8.33.C11.1.454.CMB.2.raw
  modified_base (289)..(289): a, c, t, g, unknown or other
  modified_base (299)..(299): a, c, t, g, unknown or other
  modified_base (409)..(409): a, c, t, g, unknown or other
  modified_base (535)..(535): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccacccttgttctttgtctccgaaggggaaagacgcccaccctctcctgcagggccagtcagaatgttgcgcttgaagctgacaacacaactgcagctccagccctnatctatggtncatccaacagggcccacgtggcactccccagccaggttcaggtcggcaggtgggtatgggaacagtcttcacttctacaaccatcatcagcctaggacgcctagaaagtntgttgcttagtttaatactgtacaactatacgtacgagtcggccgtccggggctacgttcgccgtcgggcgaaggtggagcttacgaaacgtaacgttgttcggctgcaactatcttagttcttcnc

SEQ ID NO: 419449 - DNA, 563 bp, Homo sapiens
  misc_feature: GZ8MTXP01CHR5D.8.33.C11.1.454.CMB.2.raw
  modified_base (293)..(293): a, c, t, g, unknown or other
  modified_base (303)..(303): a, c, t, g, unknown or other
  modified_base (404)..(404): a, c, t, g, unknown or other
  modified_base (412)..(412): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagacgcccaccctctcctgcagggccagtcagatgttggcgtcttgtagctgtaccaacacaaactggccaggctcccagcccctnatctatggtncatccaagtacgggccacgtggccaactcccgagcccaggttcaggtcggctaggtggtagtgggaacagtcttcactctacaccatcatcagcctggacnctagaagnttgtgacttagtttactacgtgtacaactagttaccgtacgagtcggcccgtccgggggcctacgttccggcccgtgggaccaagggtggacgtacgttacgaaaacgtgttaggttcggctcgactaacacttcgttgtccttcgtaacc

SEQ ID NO: 419450 - DNA, 551 bp, Homo sapiens
  misc_feature: GZ8MTXP01ESUTW.8.33.C11.1.454.CMB.2.raw
  modified_base (298)..(298): a, c, t, g, unknown or other
  modified_base (409)..(409): a, c, t, g, unknown or other
  modified_base (420)..(420): a, c, t, g, unknown or other
  modified_base (536)..(536): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgttctttgtctccgaggggaaagagccaccctctcctgcagggccagtcagaatgttggcgcttcgtaagctggtaccaacacaaacctggccaggctcccaggcccctnatctatggtgcatcccaacgagggccacgtggacatccccagccaggttcagtcggcaggtgggtatggggaacagaacttcactctcacctatcatcagtccgtgggacncctagaaagtnttgtgcttagtttattactgtacaatatcgtacgtagtcggccgtccgggggcctcgttccggccgtgggccaagggtggagacttacgaaacgtacgttgttggactgacaacgntcgttgtctttcgtc

SEQ ID NO: 419451 - DNA, 669 bp, Homo sapiens
  misc_feature: GZ8MTXP01B01BY.8.33.C11.1.454.CMB.2.raw
  modified_base (209)..(209): a, c, t, g, unknown or other
  modified_base (321)..(321): a, c, t, g, unknown or other
  modified_base (323)..(323): a, c, t, g, unknown or other
  modified_base (328)..(328): a, c, t, g, unknown or other
  modified_base (339)..(339): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccacctctcctgcagggccagtcagaatgttggcgccttcgtaagctggtacaacacaaacctagcaggctcccaggcccctcatctatgtgcatccaacaggccactgnanccacncacgtgagcgngagtggtagtaggaacgagaactactactctcaccactactactacacgaccgtcggacggaccgtacgtaaagtaagttagtttgttacgttacgtttaagtttaactttacgttacgtaaactaaacgttaaccgttaacccggtaacggtaccgggtcccggtccccgggggtacccgggtacccgtttacccgggttaccccggtacccgggtaacccgggtaaacgggtaacgggttaacggtaaacgttaacgtaaaaccgtaaaacgttacggttcggttacggtaacgtacgaaccgaactacgttacgttcgttcgttaac

SEQ ID NO: 419452 - DNA, 543 bp, Homo sapiens
  misc_feature: GZ8MTXP01EX7MC.8.33.C11.1.454.CMB.2.raw
  modified_base (209)..(209): a, c, t, g, unknown or other
  modified_base (246)..(246): a, c, t, g, unknown or other
  modified_base (366)..(366): a, c, t, g, unknown or other
  modified_base (400)..(400): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgtggcnccttgtaagctggtaccaacacaaacctggccaggctcccaggccccctcatctatggtgcatccaacagggccactggcatcccagccaggttcagtcggcaggtgggtatggggaacngaacttcaactctcacccatcatcagcctgggancctagaagattgttgctagtttattaactgtacaactagtcgtaccgagtcggcccgttcgggggcctacgttccggcctggggacccaaggtggagacttacgaaacgaacttggttgctgcaacatcttcgttcttctaac

SEQ ID NO: 419453 - DNA, 490 bp, Homo sapiens
  misc_feature: GZ8MTXP01EWQNL.8.33.C11.1.454.CMB.2.raw
  modified_base (256)..(256): a, c, t, g, unknown or other
  modified_base (278)..(278): a, c, t, g, unknown or other
  modified_base (283)..(283): a, c, t, g, unknown or other
  modified_base (288)..(288): a, c, t, g, unknown or other
  modified_base (294)..(294): a, c, t, g, unknown or other
  modified_base (297)..(297): a, c, t, g, unknown or other
  modified_base (310)..(310): a, c, t, g, unknown or other
  modified_base (312)..(312): a, c, t, g, unknown or other
  modified_base (314)..(314): a, c, t, g, unknown or other
  modified_base (316)..(316): a, c, t, g, unknown or other
  modified_base (318)..(318): a, c, t, g, unknown or other
  modified_base (320)..(320): a, c, t, g, unknown or other
  modified_base (322)..(322): a, c, t, g, unknown or other
  modified_base (327)..(327): a, c, t, g, unknown or other
  modified_base (329)..(329): a, c, t, g, unknown or other
  modified_base (331)..(331): a, c, t, g, unknown or other
  modified_base (333)..(333): a, c, t, g, unknown or other
  modified_base (352)..(352): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccagggaagagccaccctctcctgcagggccagtcagaatgttggcgccttcgtaacgnaacacaacacgcgacgacgccncgccnccacnctatgngcncacgacgcgcgcncncncncncncncgtgngngngngtgagagacgacactctcncacacactacacacgacgcgcgacgacgacgtagtagtcgtgtaacgttacgttagttacttacgtactaacttacgttcgttacggtaacgtcgggtccggtccgggtccggttaccgttccggttccggtaaccgg

SEQ ID NO: 419454 - DNA, 537 bp, Homo sapiens
  misc_feature: GZ8MTXP01BJUO7.8.33.C11.1.454.CMB.2.raw
  modified_base (208)..(208): a, c, t, g, unknown or other
  modified_base (242)..(242): a, c, t, g, unknown or other
  modified_base (261)..(261): a, c, t, g, unknown or other
  modified_base (267)..(267): a, c, t, g, unknown or other
  modified_base (275)..(275): a, c, t, g, unknown or other
  modified_base (283)..(283): a, c, t, g, unknown or other
  modified_base (291)..(291): a, c, t, g, unknown or other
  modified_base (326)..(326): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacctgtctttgtctccgagggaaanagccaccctctcctgcaggccagtcagatgtgcncttgagctgacacacaacngcagcnccagcccnatctatgncatccaanggccatgcatccagccagtcagtcgcaggtggtanggaacagctcactctcacatcatcagcctggacgcctagaacgtatgttgacttagtttattactgtacaaactagttacggtaccgaggtccggcccggttccgggggaccctacggtttccgggcccgtggggaacccaagggttcggaagtacttaacgaaacgtacgttagttcggcctgaccaactatcttagttccttcgtaacc

SEQ ID NO: 419455 - DNA, 573 bp, Homo sapiens
  misc_feature: GZ8MTXP01E219R.8.33.C11.1.454.CMB.2.raw
  modified_base (209)..(209): a, c, t, g, unknown or other
  modified_base (418)..(418): a, c, t, g, unknown or other
  modified_base (555)..(555): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanacgccaccctctcctgcagggccagtcagaatgttggcgtccttcgtaagctggtaccaacacaaacctggccaggctcccaggccccctcatctatggtgctaatcccgaaatacgggggcccacgtggaccatccccagccagggttcagtcggcaggtgggtatggggaactagaacttcactctcaccatcaatcagcctggacncctagaagtatgttagactagtttattactgttacaacatccgtacgagtcgggcccgtccggggcctacgttccggaccgtggggaccaagggtgagaacttacgaaacgtacgttggttcggctgacctaacctntcttcgttccttcgtccc

SEQ ID NO: 419456 - DNA, 646 bp, Homo sapiens
  misc_feature: GZ8MTXP01EH3H9.8.33.C11.1.454.CMB.2.raw
  modified_base (268)..(268): a, c, t, g, unknown or other
  modified_base (283)..(283): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaaggggaaagacgccaccctctcctgcagggccagtcagaatgtggcgcttgagctgacacacaacngcagctccagccctnatctagtggtgcactccaacgagggccacgtggaccactcccagccaggttcaggtcggctaggtgggtatgggaaacagtcttcactctacaccatcatcagcctggacgccgtagaaagtattgttgacttaagtttattacgttgtactaaacgtacgttaccggtaccggtaggtccgggtaccccggttcccggggggtacccttaccggttttccccggggacccgttacgggggtaaccccggtaaaggggttacgggaaacggtaaacgttaaaccgaaaaccggtaacgttcgggttcgggttcgttaacggacctaacccgtacttccgttcggtttccctttaacgtaaccc

SEQ ID NO: 419457 - DNA, 749 bp, Homo sapiens
  misc_feature: GZ8MTXP01AUEZZ.8.33.C11.1.454.CMB.2.raw
  modified_base (210)..(210): a, c, t, g, unknown or other
  modified_base (296)..(296): a, c, t, g, unknown or other
  modified_base (308)..(308): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaancgccaccctctcctgcagggccagtcagaatgttggcgccttgaagctggtaccaacacaaactggccaggcctcccaggcccctnactctagtggtnctactcccaaacgcgggcccacgtggaccactccccgagcccgtaggttccaggtcggacgtagggttcggggtagtcggggaaactacggtcctttaccgaccttcctacccaaccgtaacttacaaacgttcccgaacgtcccggttagggaccgtcccgtaggaaacggtagttggttacgtaccgttaagttttaacttacgttacgtaacctaaacgttacgttacccggtaaccggtaggttccggggtaccccggttcccggggggtaccccttaccgggttttccccggggaccccggttacgggggaaaccccggtaaagggggttcgggaacgggtaacgttaaacccggaaaacgggtacgttagggttacggccgttaacgggaccctaaccgttacgttccgttcggttaacccgtttccgtaacccg

SEQ ID NO: 419458 - DNA, 559 bp, Homo sapiens
  misc_feature: GZ8MTXP01EA54L.8.33.C11.1.454.CMB.2.raw
  modified_base (245)..(245): a, c, t, g, unknown or other
  modified_base (277)..(277): a, c, t, g, unknown or other
  modified_base (322)..(322): a, c, t, g, unknown or other
  modified_base (331)..(331): a, c, t, g, unknown or other
  modified_base (393)..(393): a, c, t, g, unknown or other
  modified_base (396)..(396): a, c, t, g, unknown or other
  modified_base (401)..(401): a, c, t, g, unknown or other
  modified_base (406)..(406): a, c, t, g, unknown or other
  modified_base (432)..(432): a, c, t, g, unknown or other
  modified_base (460)..(460): a, c, t, g, unknown or other
  modified_base (502)..(502): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggagcgtagtccagcctgggagtcacaganactctcctgtgcagcctcgtgggttcaccttnagtagctacggcatgcacgtgggtcccacaaactccagcaagggntggagtggngctagttgttcatccgtgagggcagtgtacaatggtatgctgacgcgtgaacggcgatcacntcncaganacacncagaacacatgtattggactagaacngacctaagtcctgacggacgtacgggtntaatacttacgtaggttacggaaaggggaacgggggaaccgngggacgggtaagttaccgtaacgttcgtaccgtttgtaaccggttcgtaaccggggg

SEQ ID NO: 419459 - DNA, 555 bp, Homo sapiens
  misc_feature: GZ8MTXP01AOANQ.8.33.C11.1.454.CMB.2.raw
  modified_base (538)..(538): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgagggaaagagccaccctctcctgcagggccagtcagaatgttggcgccttgtaagctaggtaccaacacaaacctggccaggctcccacggcccctcatctatggtgcactccaacacggggcccacgtggcactcccgagcccaggttcaggtcggcaggtggggtatggggaacaggcttcactctcaccatcatcagcctggacgcctagaagagttgtgcttagtttattactgtacaactatcgtaccgaggtcggccgtaccgggggcctaccgttccggccgtcgggaccgaaggtcggagattacgaaacgagttcgttggctgcaacntcttgtccgttcgtaac

SEQ ID NO: 419460 - DNA, 574 bp, Homo sapiens
  misc_feature: GZ8MTXP01D820T.8.33.C11.1.454.CMB.2.raw
  modified_base (298)..(298): a, c, t, g, unknown or other
  modified_base (308)..(308): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccaccctgtctttgtctccgaaggggaaagagccaccctctcctgcagggccagtcagaatgttggcgccttgtaagctggtaccaacacaaacctggccaggctcccagcccctnatctatggtncatccaacgagggccacgtggcatcccagccaggttcaggtcggcaggtgggtatggggaacagcttcactctacaccatcatcagcctggacgcctagaagtattgttagcttagtttaattacttgtactaaactagtacgtaccggtaggtcggcccgttaccgggggccctaccgtttcggcccgtgggaccgtaagggtggagtacttacgaaacgtaacgttggttggctgacaacctatcgttgttccgttcgtaaccg

SEQ ID NO: 419461 - DNA, 556 bp, Homo sapiens
  misc_feature: GZ8MTXP01EL8IC.8.33.C11.1.454.CMB.2.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccagcccctcatctatggtgcatccaacacgggccactggcactcccagccaggttcagtcggcaggtggtatgggaacagtaacttcactctacaccatcatcacgcctaggacgcctagaagtattgttgactagtttattactgtacaaactagtacgtaccgaggtcggcccgtccgggggacctacgtttccgggccctcgggaccaagggtgagacgttacgaaacgacgttggttcgctgcaacgatcttcgtcttcgtaacc

SEQ ID NO: 419462 - DNA, 595 bp, Homo sapiens
  misc_feature: GZ8MTXP01DIWA4.8.33.C11.1.454.CMB.2.raw
  modified_base (207)..(207): a, c, t, g, unknown or other
  modified_base (245)..(245): a, c, t, g, unknown or other
  modified_base (254)..(254): a, c, t, g, unknown or other
  modified_base (264)..(264): a, c, t, g, unknown or other
  modified_base (273)..(273): a, c, t, g, unknown or other
  modified_base (283)..(283): a, c, t, g, unknown or other
  modified_base (333)..(333): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacctgtctttgctccgaggggaanacgccacctctctgcaggccagtcagatgtgctctganctgacacanaactgcagcnccagccctnatctatggtncactccaagacggccacgtgcactccagccagttcagtcgcaggtggtangggaacagtctcactctacaccatcatcgagcctaggacgccttaggaaagtagttacgttgacgttaagttttaattacgtgttaactaaacgtacgttccggtaaccggtaggttccggtcccggttcccgggggtacctaccggttttcccgggacccggttacggggaacccgtaaggggtacggaacgtaacgttacgaaaaccggtacgttaggttcgccgtgcctaaccgtacttcttcgttccgttctaacccg

SEQ ID NO: 419463 - DNA, 632 bp, Homo sapiens
  misc_feature: GZ8MTXP01E0ZNW.8.33.C11.1.454.CMB.2.raw
  modified_base (274)..(274): a, c, t, g, unknown or other
  modified_base (325)..(325): a, c, t, g, unknown or other
  modified_base (585)..(585): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtagtccagcctgggagtcacagagactctcctgcgcagcctctgggttcaccttnagtagctacgcatcgcacgtcgggtcccaccaaactcgaggacgaagggtnttgggaggtgggtgctagtttgttcagtccgtggaggctagttgttaacaagttggtatcgcgtggaccggtcggtagggaacgggcctacttaccactactcctacgaagaacgaaccaaaccgtaccgaaacgaaactaactaagttacggttaagtttacggaacctacgaaacacgtaccgtaagtaccgtagaacggtacgacgggtagtaactaacgttacgtacggaacgggaaaggggaacgggggaaccgnggacgggtaacgtacgtaacgtactcgttacgtaacgttcggtcggg

SEQ ID NO: 419464 - DNA, 518 bp, Homo sapiens
  misc_feature: GZ8MTXP01BA96T.8.33.C11.1.454.CMB.2.raw
  modified_base (209)..(209): a, c, t, g, unknown or other
  modified_base (245)..(245): a, c, t, g, unknown or other
  modified_base (251)..(251): a, c, t, g, unknown or other
  modified_base (259)..(259): a, c, t, g, unknown or other
  modified_base (265)..(265): a, c, t, g, unknown or other
  modified_base (281)..(281): a, c, t, g, unknown or other
  modified_base (381)..(381): a, c, t, g, unknown or other
  modified_base (421)..(421): a, c, t, g, unknown or other
  modified_base (496)..(496): a, c, t, g, unknown or other
  modified_base (505)..(505): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanacgccaccctctcctgcagggccagtcagatgtgcncttganctgacaanacaacngcagctcccagccctnatctatggtgcatccaatcgggccacgtggcatcccagccaggttcagtcggcaggtgggtatgggaacagcttcactctcaccatcatcagcctggacncctagaagtattgttgcttagtttattactgtacaaactntaccgtaccgagtcggcccgtccgggggcctacgttccggcccgtgggaccaaggtgagacttcgaaacgattgngctgcaacntcttgtcttcaac

SEQ ID NO: 419465 - DNA, 517 bp, Homo sapiens
  misc_feature: GZ8MTXP01D1TE2.8.33.C11.1.454.CMB.2.raw
  modified_base (209)..(209): a, c, t, g, unknown or other
  modified_base (295)..(295): a, c, t, g, unknown or other
  modified_base (305)..(305): a, c, t, g, unknown or other
  modified_base (314)..(314): a, c, t, g, unknown or other
  modified_base (386)..(386): a, c, t, g, unknown or other
  modified_base (412)..(412): a, c, t, g, unknown or other
  modified_base (421)..(421): a, c, t, g, unknown or other
  modified_base (466)..(466): a, c, t, g, unknown or other
  modified_base (475)..(475): a, c, t, g, unknown or other
  modified_base (479)..(479): a, c, t, g, unknown or other
  modified_base (489)..(489): a, c, t, g, unknown or other
  modified_base (499)..(499): a, c, t, g, unknown or other
  modified_base (510)..(510): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgtttacacagtctccagccaccctgtctttgctccgaggggaaangcccacctctcctgcagggccagtcagaatgttggcgtccttgaagctggtaaccaacacaaactggccaggctcccaggcccctnatctatggtncatccaacncgggccactggcactcccagccaggttcagtggccaggtggtagtcgggacaagtacttcgactcacaaccntcatcagctggacgctgaagatgttnctagttatntagtcaagtactcgtacgagtcgccgtccgggctacgtcgtccgnggaccaggngagncgaaagctgngcttgcactntctgttcttcncttcccg

SEQ ID NO: 419466 - DNA, 561 bp, Homo sapiens
  misc_feature: GZ8MTXP01DKRS2.8.33.C11.1.454.CMB.2.raw
  modified_base (253)..(253): a, c, t, g, unknown or other
  modified_base (263)..(263): a, c, t, g, unknown or other
  modified_base (303)..(303): a, c, t, g, unknown or other
  modified_base (323)..(323): a, c, t, g, unknown or other
  modified_base (398)..(398): a, c, t, g, unknown or other
  modified_base (403)..(403): a, c, t, g, unknown or other
  modified_base (409)..(409): a, c, t, g, unknown or other
  modified_base (468)..(468): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtagtccagcctgggagtcacagagactctccngtgcagcctntgggttcaccttcagtagctacggcatgcactgggtcccnccaaactccaggcaaagggnttgggagtgggtgcagtttgttcatcctggagggcagtgttacaatggatgctgacgcgtgaaggcatcacatcncaganacaacncagaacacaatgggtaatttggaacctagaacagcctaaagtcctgaggacacggggtntaatacttacgtaggttaacggaaagggagggggaaaccgttgggacgggaagttaccgaagttactccgtttaggaacgttcgtaacggggg

SEQ ID NO: 419467 - DNA, 652 bp, Homo sapiens
  misc_feature: GZ8MTXP01BPPYI.8.33.C11.1.454.CMB.2.raw
  modified_base (209)..(209): a, c, t, g, unknown or other
  modified_base (245)..(245): a, c, t, g, unknown or other
  modified_base (251)..(251): a, c, t, g, unknown or other
  modified_base (258)..(258): a, c, t, g, unknown or other
  modified_base (270)..(270): a, c, t, g, unknown or other
  modified_base (279)..(279): a, c, t, g, unknown or other
  modified_base (288)..(288): a, c, t, g, unknown or other
  modified_base (297)..(297): a, c, t, g, unknown or other
  modified_base (392)..(392): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanacgccaccctctcctgcagggccagtcagatgtgcncttganctgacanacaactgcagcnccagccctnatctatggncatccaacngggcccacgtggccatccccagccaggttcagtcggcaggtggtatgggaacagcttcactctcaccatcatcagcctggacgcctagaaacgtnttggtttcgacgttaagttttacttaacgttcgttaccaaacgttacgttacccggttaaccggtagggttccgggtccccggttacccggggggtaccccttaacccgggttttccccggggaccccggttacgggggtaaccccgtaaagggggttcgggaacggtaaacgttaccggaaaaaccggtaaccgttgggttcgggaccgttccggacccgtaaccctacgttcccgttcggttccctttcgtaaccccg

SEQ ID NO: 419468 - DNA, 557 bp, Homo sapiens
  misc_feature: GZ8MTXP01BGHC0.8.33.C11.1.454.CMB.2.raw
  modified_base (209)..(209): a, c, t, g, unknown or other
  modified_base (247)..(247): a, c, t, g, unknown or other
  modified_base (287)..(287): a, c, t, g, unknown or other
  modified_base (297)..(297): a, c, t, g, unknown or other
  modified_base (308)..(308): a, c, t, g, unknown or other
  modified_base (395)..(395): a, c, t, g, unknown or other
  modified_base (406)..(406): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanacgccaccctctcctgcagggccagtcagaatgtggcncttgaagctgacaacacaactggccaggctccagcccctnatctatggtncatccaaacgngggccagtggcactcccagccaggtcaggtcggctaggtgggtatcgggaacagtcttcacttcacacatcatcacgcctagggacncctagaaagtnttgtgacttaagtttactactgtacaatacgtccgtacgagtcggcccgtcgggggacctacggtttccggccgtacgggacctaaggggtcgaggtacttacgaaacgtacttcggttgctgacctaactatcgttactcttcgtaaccg

SEQ ID NO: 419469 - DNA, 718 bp, Homo sapiens
  misc_feature: GZ8MTXP01AZEEA.8.33.C11.1.454.CMB.2.raw
  modified_base (306)..(306): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagacgccaccctctcctgcagggccagtcagaatgttggcgtccttgaagctggtaccaacacaaactggccaggctcccaggccctcatctatggtncactcccaaacgacggggcccaacgtcggaccaactccccgaagcccgtaaggtttccaaggtcggaccgtagggttgggggtaactcgggggaaaaccagggtaaccctttcaaccttcctacccaaccctatacctaactccgacgtccctaggggacgtcccgtaggaaagtgttggttacgtacttaagtttacttacgttctaacctaaacgttcgttaccggaaccggtggtcccgggtcccggttcccgggggacccttaccggtttcccgggacccggtacggggtaaccccggtaaggggtacggaacggtaacgttaaaccggaaaacgtaacgggttcgggttcggttacccgtaacggtacccgtaacctcgttcccgttcgttcccttcgttaaccccg

SEQ ID NO: 419470 - DNA, 647 bp, Homo sapiens
  misc_feature: GZ8MTXP01AW4S6.8.33.C11.1.454.CMB.2.raw
  modified_base (210)..(210): a, c, t, g, unknown or other
  modified_base (246)..(246): a, c, t, g, unknown or other
  modified_base (265)..(265): a, c, t, g, unknown or other
  modified_base (271)..(271): a, c, t, g, unknown or other
  modified_base (280)..(280): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaancgccaccctctcctgcagggccagtcagatgtggcncttgagctgacacacaacngcagcnccagccctnatctagtggtgcactccaaacgaggggcccacgtggccactcccgagcctaggttcaggtcggctaggtgggtatggggaacagtaaccttcactcctacactatcatcacgtccgtagggacgtcctaggtaaagtagtttggttagtacgttaagttttaacttacttacggtactaaacgtacgttaccggtaccggtaggttccggacccggttcccgggggaccttacccggttttcccggggcccgtagggggaaccccgtaaaggggttcggaaacggtacgttaaccgaaaaaaccggtcgttacgggttcgggttactcggacctaaccgtacttcgttacgttcctttcgtaacccg

SEQ ID NO: 419471 - DNA, 740 bp, Homo sapiens
  misc_feature: GZ8MTXP01BMJDN.8.33.C11.1.454.CMB.2.raw
  modified_base (333)..(333): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtagtccagcctgggaggtcacagagactctcctgtgcagcctcgtgggttccaccttcagtagctacggcatgcacgtcgggtcccaccaaactccgaggacaaaggggtnttggagttgggggtgctagttgttcagtccgtggagggctaggttgttaacaagttgggtatcggcttacggaccggtccgggtaggaaccggggtccctatttacccgacgtacttcccacgaacggaacgaacctaaaccgtaccccgaaaggaaaccctaaacgtaaagttacgggtttaacgttttaccggggaaacccttacgggaaaccaaccggtaacccttaaacggtacccgtagggtaaccgggtaacgtaccggggttagttaaacttaacgttaacggttacgggttaaaccggggaaagggggtaaccggggggaaaccgacgggttaccggggtaacgttacccgaacggtttaccgttccgttacgggtaaccgtttcgggtaacccggggg

SEQ ID NO: 419472 - DNA, 650 bp, Homo sapiens
  misc_feature: GZ8MTXP01BFU1U.8.33.C11.1.454.CMB.2.raw
  modified_base (294)..(294): a, c, t, g, unknown or other
  modified_base (422)..(422): a, c, t, g, unknown or other
  modified_base (490)..(490): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagacgccaccctctcctgcagggccagtcagaatgtggctccttgtaagctggaccaacacaaactgccaggctcccacgcccctnatctatggtgcactcccaaacgacggggcccacgtggacctactccccgagccctagggttccaggttcggcagggtgggtagtcggggaacagtcttcaacctctaccacatcatcagcctaggacncctaggaaacgtgttgttgaccgttaagtttacttacgttacggtacaaacgtcgtaccgtaaccggnggttccggcccggttccgggggacccttaccgtttcccggggacccgttacggggaacccgtaaggggtcggaaacggtacgttaaccgaaaaccggtaacgttcgggcgggttcctaacggcctaaccctgttccgttacggttccgtttcgtaacccg

SEQ ID NO: 419473 - DNA, 599 bp, Homo sapiens
  misc_feature: GZ8MTXP01BXB2Q.8.33.C11.1.454.CMB.2.raw
  modified_base (305)..(305): a, c, t, g, unknown or other
  modified_base (324)..(324): a, c, t, g, unknown or other
  modified_base (458)..(458): a, c, t, g, unknown or other
  modified_base (490)..(490): a, c, t, g, unknown or other
  modified_base (537)..(537): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtagtccagccgtgggaggtcacagagactctcctgtgcagcctctgggttcaccttcagtagctacggcatgcacgtggtcccnccaaactccaggcaagggnttggagtgggtgctagttgttcatcctggagggcagtgttaacaagttgggtatgctggaccgtccggtagaacgggccgattccacatctccagacgacactcaacgaacacaatggtattggacctagaacncgacctaagtccgtagtacggacgtacgggtntaactaacgttacgtaggttaacggaaaggggagggggttaacccgngggaccggggtaagttaccggaacgttaccgtccgtttacgaacggttccggtaaccggggg

SEQ ID NO: 419474 - DNA, 715 bp, Homo sapiens
  misc_feature: GZ8MTXP01C9UVM.8.33.C11.1.454.CMB.2.raw
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactgggtggagtcgtgggggagcgtagtccagccgtgggagtcacagagactctcctgtgcagcctcgtggttcaccttcagtacgctacggcatcgcacgtcgggtacccaccaaactccgaggacgaaggggtattgggaggtggggtgtctaggtttgttacagttccgtaggagggtctaggttcgttaacaaagttcgggttaatcggtacgttacgggaccggtaccgggtagggaaaccggggtcctaacgttaccaaccgtactccgtaaccgaagaacgaacctaaccgtaccgaaagaaactaacgtaagttacgggttaacgtttacgggaaccttaacggaaacctacggtacccttaaaggtacccgaggtaacggacggtacgggtattaactacgttacgtacggttaaacgggaaagggggaacgggggaacgcgggacgggttaacgttaccgtaacggttaccgtcggtttacggaaccggttcgggtaacccggggg

SEQ ID NO: 419475 - DNA, 765 bp, Homo sapiens
  misc_feature: GZ8MTXP01DSWSW.8.33.C11.1.454.CMB.2.raw
  modified_base (179)..(179): a, c, t, g, unknown or other
  modified_base (278)..(278): a, c, t, g, unknown or other
  modified_base (283)..(283): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgcttcttttaagnggtgtccagtgtcaagtgcaacgtggtggagtcgtgggggagcgtagtccagccgtgggagtcacagagactctctgtgcacgcctcgtggtcaccttnagtanctacggcatgcacgtcggtaccaaccaaactccgaggacgaagggtattgggaggtggggtggcttaggtttgtttcagttccgaggacgggtctagttgttaacaaagttgggtatggcttacggaccgtccgggtagggaaacgggtccgtaatttacccaaccgtacttaccgtacccgaaaggaaccgaaaccgtaaacctacccgaaaacgggtaaacctaaaccgttaaagttaggggtttaaacgttttaccgggaaacccgtttacggaaaaccgtaaccggtaacccgttaaacggttaccccgtagggtaaacgggtaaccggtaaccgggggttaacttaacgttaaccgttaacggtaacgggttaaacggggaaacgggggtaacgggggaaacccgttacggggaccggggtaacgttaccgaacggttaccgttcggttacggtaaccgtttccgggtaaccggggg

SEQ ID NO: 419476 - DNA, 616 bp, Homo sapiens
  misc_feature: GZ8MTXP01C3WFY.8.33.C11.1.454.CMB.2.raw
  modified_base (299)..(299): a, c, t, g, unknown or other
  modified_base (309)..(309): a, c, t, g, unknown or other
  modified_base (317)..(317): a, c, t, g, unknown or other
  modified_base (416)..(416): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctccagtttcagataccaccggagagattgtgttgacacagtctccagcccaccctgttctttgtctccgaaggggaaagacgccaccctctcctgcagggccagtcagaatgtggcgtcttgtaagctagaccaacacaaacctggccaggcctcccaggcccctnatctatggtncatccaanacgggccagtggcatcccgagccaggttcaggtcggcaggtgggtaatcgggaacagtcttcactctacaaccatcatcagcctggagcctagaaagtnttgtagattaagtttattactagtaacgaaactacgtacgtaccggaggtccggcccgggtaccggggtacccttacggtttcccgggacccgtacggggtaaaccgtaaggggtcggaaacgtaacttaaaccgtaaaaccgtacgttaggttcggttactaacgacctaaccgtattccgttacgttccttcgtaacg

SEQ ID NO: 419477 - DNA, 534 bp, Homo sapiens
  misc_feature: GZ8MTXP01BMUWL.8.33.C11.1.454.CMB.2.raw
  modified_base (295)..(295): a, c, t, g, unknown or other
  modified_base (305)..(305): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgaagctggtaccaacacaaacctggccaggctcccaggcccctnatctatggtncatccaatacgggccactggcatcccagccaggttcagtcgcaggtggtatgggaacagcttcactctcaccatcatcagcctggagcctgaagatgttgctagtttattacttgtacaaactatccgtaccgagtcggccgtccgggggcctacgttccggcccgtcgggacgaagggtggagagttacgaaacgacttggttggactgctaaccatcttgtcttctc

SEQ ID NO: 419478 - DNA, 626 bp, Homo sapiens
  misc_feature: GZ8MTXP01BUON5.8.33.C11.1.454.CMB.2.raw
  modified_base (274)..(274): a, c, t, g, unknown or other
  modified_base (291)..(291): a, c, t, g, unknown or other
  modified_base (301)..(301): a, c, t, g, unknown or other
  modified_base (398)..(398): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgttctttgtcctccgaaggggaaagacgccaccctctcctgcagggccagtcagaatgtgcgtcttgaagctgtaccaacacaaacngccaggctcccagcccnatctatggtncatcaatcggccatgcatccagccaggttcagtcgcaggtggatgggaacagtctcactctcacctatcatcagcctagggactcctaggaaacgtnttaggttcgattaagttttatacgttagtaactaaactcgttaccggtaaccggtggtcccgggtaccggttcccgggggtaccctaaccggtttcccggggaccccgttacgggggaacccgtaagggggtaggaacggtaaccttacggtaaaaacccggtgtttaggggcgttccgtaacggtacccaacgttactcggttacgtttccctttaacgtaaccccg

SEQ ID NO: 419479 - DNA, 560 bp, Homo sapiens
  misc_feature: GZ8MTXP01EZQ6F.8.33.C11.1.454.CMB.2.raw
  modified_base (302)..(302): a, c, t, g, unknown or other
  modified_base (465)..(465): a, c, t, g, unknown or other
  modified_base (508)..(508): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctcctgtgcagcctctgggttcaccttcagtagctacggcatgcactgggtcccnccaaactccgaggcaagggattgggagtgggtgctagttgtttcatccgtgagggcagtgtacaatggtatgctgacgcgtgacgggccatcacatctccagagacaactcagaacacaatgtattgacctagaacagcctaagtccgtgaggacacggggtntaactacttacgtaggttacggaaaggggaacgggggaaccgngggacggggtaacgttaccgaagtacgtccgtttagaacgttcgtaacgggg

SEQ ID NO: 419480 - DNA, 554 bp, Homo sapiens
  misc_feature: GZ8MTXP01DL6HI.8.33.C11.1.454.CMB.2.raw
  modified_base (211)..(211): a, c, t, g, unknown or other
  modified_base (287)..(287): a, c, t, g, unknown or other
  modified_base (297)..(297): a, c, t, g, unknown or other
  modified_base (307)..(307): a, c, t, g, unknown or other
  modified_base (385)..(385): a, c, t, g, unknown or other
  modified_base (396)..(396): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccaccctgtctttgtctccgaggggaaanagccaccctctcctgcagggccagtcagaatgttggcgccttgtaagctgacaacacaactgcagctccagccctnatctatggtncatccaacgngggccacgtgcatcccagccaggtcagtcgcaggtggtatgggaacagcttcactctacaccatcatcagcctggacncctagaaagtntgttgcttaagtttattaactcgtacaacgtataccgtaacgaggttcggcccgtccgggggaccctacgtttccggcccgtggggaaccgaagggttcggagtacttaacgaaacgaacgttggttcggctgacctaacatcttgttccttgtaacc

SEQ ID NO: 419481 - DNA, 538 bp, Homo sapiens
  misc_feature: GZ8MTXP01DKKUH.8.33.C11.1.454.CMB.2.raw
  modified_base (297)..(297): a, c, t, g, unknown or other
  modified_base (306)..(306): a, c, t, g, unknown or other
  modified_base (315)..(315): a, c, t, g, unknown or other
  modified_base (362)..(362): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctnatcatggtncatccaacngggcccacgtggcatcccagccaggttcagtgcagtggatgggaacngcttcactctcaccatcatcagccgtggagcctagaagatgttgactagtttatacgttgtacaactattccgtaccgagtcggccgtccgggggcctacgttcggcccgtgggaccgaaggtggagattacgaaacgacttggttcgcgtgcaacctatcgttgttcttcgtaac

SEQ ID NO: 419482 - DNA, 577 bp, Homo sapiens
  misc_feature: GZ8MTXP01E2OV2.8.33.C11.1.454.CMB.2.raw
  modified_base (403)..(403): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagcccaccctgtctttgtctccgagggaaagagcccaccctctcctgcagggccagtcagaatgttggcgccttcgtaagctggtaccaacacaaacctggccaggctcccaggccccctcatctatggtgcatccaatagggccactggcatccccagccaggttcagtcggcaggtgggtatggggaacagaacttcactctcaccatcatcagcctgggacncctgaaacgatcgttgctagtttatactgtacaacatccgtaccgaggtcggccccgtccgggggtcccaccgttccgggccccgtggggtaaccccgaagggtcggagacgttacgaaaaccggtaacttcggttgggctggccaaccctatcgttcgttccttcgtaacccg

SEQ ID NO: 419483 - DNA, 620 bp, Homo sapiens
  misc_feature: GZ8MTXP01CR8B6.8.33.C11.1.454.CMB.2.raw
  modified_base (214)..(214): a, c, t, g, unknown or other
  modified_base (310)..(310): a, c, t, g, unknown or other
  modified_base (319)..(319): a, c, t, g, unknown or other
  modified_base (330)..(330): a, c, t, g, unknown or other
  modified_base (441)..(441): a, c, t, g, unknown or other
  modified_base (582)..(582): a, c, t, g, unknown or other
  modified_base (600)..(600): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccacccttgttctttgtctccgaaggggaaanacgccaccctctcctgcagggccagtcaagaatgttggcgtccttgtaagctaggtaaccaacacaaaccgtggaccaggcctcccgaggcccctnatctatggncatccaaacgngggcccagtggacatccccagccaggttcaggtcggctaggtggtaatcgggaaactagtccttcacgtctacacctatcatcgacgtccgtaggactccgtagaaacgtntcggttagacttagttttaactacgtcgtaacgaaacttcgttaccgtacggaggttccggacccggttcccgggggaccttaccggtttcccgggccctagggggacctaacgggtggacgtacacgaaacgtcgttggngcgtaaggcctaaccgtnttacgttcgttcgttctccg

SEQ ID NO: 419484 - DNA, 553 bp, Homo sapiens
  misc_feature: GZ8MTXP01CJXHJ.8.33.C11.1.454.CMB.2.raw
  modified_base (210)..(210): a, c, t, g, unknown or other
  modified_base (299)..(299): a, c, t, g, unknown or other
  modified_base (455)..(455): a, c, t, g, unknown or other
  modified_base (541)..(541): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagntccaccctctcctgcagggccagtcagaatgttggcgccttcgtaagctggtaccaacacaaacctggccaggcctcccaggccccctnatcctatggtgcatcccaagtacggggccacgtggcatccccagccaggttcagtcggcaggtgggtatggggaacagtctcactctcaccatcatcagcctggacgcctgaagattgttagcttagtttattactgtacaactatccgtaaccgngtcggccgtccggggcctacgttccggccctcgggactaacgggtgacgacgttacgaaacgtacttggttcggctcgctaacctntcttctcttctc

SEQ ID NO: 419485 - DNA, 526 bp, Homo sapiens
  misc_feature: GZ8MTXP01DFI1U.8.33.C11.1.454.CMB.2.raw
  modified_base (207)..(207): a, c, t, g, unknown or other
  modified_base (243)..(243): a, c, t, g, unknown or other
  modified_base (268)..(268): a, c, t, g, unknown or other
  modified_base (277)..(277): a, c, t, g, unknown or other
  modified_base (287)..(287): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtcttgtctccaggggaanagccaccctctcctgcagggccagtcagatgtggcnctgaagctgacacacaactgcagcnccagccctnatctatggtncatccaacagggccatggcatcccagccagtcagtcggcaggtggtatgggaacagtaacttcactctcacctatcatcagcctggacgcctagaagtattgttgactagtttattactgtacaactagttacgtacgtagtcggccgtccgggggcctacgttccggccgtcgggaccgaaggtgagtacttacgaaacgtacttggttcgctcgacaactactcttcgttcttcttc

SEQ ID NO: 419486 - DNA, 621 bp, Homo sapiens
  misc_feature: GZ8MTXP01BXTWJ.8.33.C11.1.454.CMB.2.raw
  modified_base (336)..(336): a, c, t, g, unknown or other
  modified_base (376)..(376): a, c, t, g, unknown or other
  modified_base (432)..(432): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtagtccagcctgggagtcacagagactctcctgtgcagcctcgtggttcaccttcagtagctacggcatgcacgtcgggtccccgaccaaactccgagggaccgaaagggggtntttgggagttgggggtggtctaggtttgtttcagttccgnggagggctagtgttaacaagtggtatgctggacgcggtaggaacggccgtatcacntctcagacgacacacagaacacaatggtattcggacctagaacacgccgtaagtaccgtggtaacggtacgtacggggttataacgtaacgttacgtaggttaaacggaaagggggaacgggggaaccgacgggacgggtaagttacccgaagttacctcggttagtaaccggttcggtaacccggggg

SEQ ID NO: 419487 - DNA, 596 bp, Homo sapiens
  misc_feature: GZ8MTXP01BISHS.8.33.C11.1.454.CMB.2.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccagggaaagagccaccctctcctgcagggccagtcagaatgttggcgtccttgtaagctggtaccaacacaaacctggccaggcctcccaggcccctcatctatggtgcactccaacgagggcccactggccactccccagccaggttcagtcggcaggtggtatggggaacagtctcactctcaccatcatcagtccgtggacgcctagaagagttgttagacttagtttattactagtacaactagttaccgtaccggtaggtccgggtcccggtccgggggtccctaccggtttcccgggcccgttcggggaacccgaagggtcggaacgacgttaccgaaacgtacgttaggttgccgtaaggccaactacgttcgttcttcttccgtaaccg

SEQ ID NO: 419488 - DNA, 557 bp, Homo sapiens
  misc_feature: GZ8MTXP01AYM8O.8.33.C11.1.454.CMB.2.raw
  modified_base (471)..(471): a, c, t, g, unknown or other
  modified_base (513)..(513): a, c, t, g, unknown or other
tcagctcgcgtgtccacgaccggtgctcgatttagagtgagctcgttgggtttgggctgggagaggagcccagcactagaagtcggcggtgtttccattcggtgatcagcactgaacacagaggactcaccatggagtttgggctgaactgggttttcctcgttgctctttaagaggtgtccagtgtcaagtgcaactggtggagtcgtgggggaggcgtagtccagcctgggaggtcacagagactctcctgtgcagcctctgggtcaccttcagtagctacggcatgcacgtgggtcccaccaaactccgaggcaaggggattgggagtggggtgctagtttgttcatcctggagggcagtgtacaatggtatgctgacgcgtgaacggccgatcacatctcagacgacaactcagaacacaatggtatttggacctagaacagacctaagtcctgaggacgacgggtntaactacgttacgtagttacggaaagggaacgggggaaccgngggcgggaagtccgaagtctccgttgtaacgttcgtaaccgggg

SEQ ID NO: 419489 - DNA, 550 bp, Homo sapiens
  misc_feature: GZ8MTXP01BU1X3.8.33.C11.1.454.CMB.2.raw
  modified_base (328)..(328): a, c, t, g, unknown or other
  modified_base (361)..(361): a, c, t, g, unknown or other
  modified_base (412)..(412): a, c, t, g, unknown or other
  modified_base (417)..(417): a, c, t, g, unknown or other
  modified_base (422)..(422): a, c, t, g, unknown or other
  modified_base (448)..(448): a, c, t, g, unknown or other
  modified_base (457)..(457): a, c, t, g, unknown or other
  modified_base (469)..(469): a, c, t, g, unknown or other
  modified_base (506)..(506): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctcctgtgcagcctctgggttcaccttcagtagctacggcatgcacgtgggtcccaccaaactccgaagggcaaaggggtnttgggagtgggggtgcgtagtttgttcatccgnggagggctagtgttacaagtggtatgctgacgcgtgaacggcatcacatcncaganacacncagaacacatgtattgacctagaacngctagtccngagacgacggtntaatacttacgtggttacggaagggacgggggaacgngggacggtaagtacaagtacctcgttacgtaacgttcgtcgggg

SEQ ID NO: 419490 - DNA, 624 bp, Homo sapiens
  misc_feature: GZ8MTXP01BNBWZ.8.33.C11.1.454.CMB.2.raw
  modified_base (285)..(285): a, c, t, g, unknown or other
  modified_base (373)..(373): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagacgccaccctctcctgcagggccagtcagaatgttgcgcttgaagctgacaacacaactggcagctccagcccctnatctatggtgcatccaagtacgggccacgtggcatccccagccaggttcagtcggcaggtgggatgggaacagcttcactctacaccntcatcagccgtggacgcctagaagtattgttgacttaagtttattacgttcgtacgtaaactagttaccgtaaccggtagtccgggtcccgtccggggggtaccctaccggttttccggggccccgttacgggggaaacccgaaagggggttcgggaaacggtacgttaaccgaaaaaaccggtaaccggttaggttcgggcgttaacggaccctaaccgtaacgttccttacggtttcctttcgtaaccg

SEQ ID NO: 419491 - DNA, 618 bp, Homo sapiens
  misc_feature: GZ8MTXP01BB7BU.8.33.C11.1.454.CMB.2.raw
  modified_base (306)..(306): a, c, t, g, unknown or other
  modified_base (411)..(411): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaaggggaaagacgcccaccctctcctgcgagggccagtcaagaatggttggcgtccttacgtaagctggtaaccaacacaaacctggccaggctcccaggcccctnatctatggtgcatccaagtagggccactggcactcccgagccaggttcagtcggctaggtgggtatggggaacagcttcactctacacatcatcacgcctaggcncgtagaagtatgtgacttagtttaatactagtacgaaactgttacccgtacggtaggtccgggtcccggtcccggggggtccctaaccggtttccgggacccggtacggggaacccgtaaggggtcggaagaacgttacgaaaacgggtaacttcgggttcggacgttcggcctaaccgtcttcgttcgttcctttaacgtaacccg

SEQ ID NO: 419492 - DNA, 573 bp, Homo sapiens
  misc_feature: GZ8MTXP01AOYRA.8.33.C11.1.454.CMB.2.raw
  modified_base (323)..(323): a, c, t, g, unknown or other
  modified_base (413)..(413): a, c, t, g, unknown or other
  modified_base (515)..(515): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctcctgtgcagcctctgggttcaccttcagtagctacggcatgcacgtgggtcccaccaaactccaggcaaggggnttggagtgggtggctagttgttcatccgtggaggcagtgttacaagtggtatgctgacgcgtgaacggcgatcacatctcagacgacacncagaacacaatggtatttcggacctagaacagcctaagtcctgacggtacacgggtgtaataacgttacgtaggttaacggaaaggggaacgggggaaccgngggacgggtaacgttaccgtaagttccgtccgttacggtaaccggttcggtccggggg

SEQ ID NO: 419493 - DNA, 549 bp, Homo sapiens
  misc_feature: GZ8MTXP01AW9XM.8.33.C11.1.454.CMB.2.raw
  modified_base (209)..(209): a, c, t, g, unknown or other
  modified_base (243)..(243): a, c, t, g, unknown or other
  modified_base (281)..(281): a, c, t, g, unknown or other
  modified_base (288)..(288): a, c, t, g, unknown or other
  modified_base (301)..(301): a, c, t, g, unknown or other
  modified_base (384)..(384): a, c, t, g, unknown or other
  modified_base (533)..(533): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaancgccaccctctcctgcaggccagtcagatgtgcncttgagctgacaacacaactggcaggctcccagccctnatctagngtgcatccaacgngggccactggccatcccgagccaggttcagtcggcaggtgggtatggggaacagcttcactctcaccatcatcagcctggacnctagaacgattgttgcttagtttatacgtgtacaactagtcgtacgaggtcggcccggtccgggggaccctcgtttccgggcccgttacgggcgaaacgggttggaagacgttaacgaaacggaacttgggttcggacgtgccaacctnttcttcgttcttcgtc

SEQ ID NO: 419494 - DNA, 645 bp, Homo sapiens
  misc_feature: GZ8MTXP01AP38C.8.33.C11.1.454.CMB.2.raw
  modified_base (211)..(211): a, c, t, g, unknown or other
  modified_base (270)..(270): a, c, t, g, unknown or other
  modified_base (278)..(278): a, c, t, g, unknown or other
  modified_base (281)..(281): a, c, t, g, unknown or other
  modified_base (288)..(288): a, c, t, g, unknown or other
  modified_base (298)..(298): a, c, t, g, unknown or other
  modified_base (382)..(382): a, c, t, g, unknown or other
  modified_base (387)..(387): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaaggggaaanacgccaccctctcctgcagggccagtcagatgtggctccttgagctgaccaacacaacngcaggccnccncgccctnatctagtgtncataccaacgacggcacgtgaccactcccgagcctaggttcaggtcggacgtaggtggggtatggggaacagtccttcacctcnccacntcaatcagcgtggacgcctagaagtgttgttgacttaagttttatacgttgtaactaaacgttacgtaccggtaaccggtacggttccgggccccgggttacccgggggtccttacccgggtttcccggggacccggttacggggtaacccggtaagggttacgggaacgtaaccgttaacggtaaaacgtaacggttcgggttcgttaccgtaacggtacccgaacttactcggttacgttccgttaactaaccccg

SEQ ID NO: 419495 - DNA, 580 bp, Homo sapiens
  misc_feature: GZ8MTXP01EJNT4.8.33.C11.1.454.CMB.2.raw
  modified_base (319)..(319): a, c, t, g, unknown or other
  modified_base (430)..(430): a, c, t, g, unknown or other
  modified_base (442)..(442): a, c, t, g, unknown or other
  modified_base (532)..(532): a, c, t, g, unknown or other
  modified_base (546)..(546): a, c, t, g, unknown or other
tcagctcgcgtgtccacgaccggtgctcgatttagagtgagctcgttggggtttgggggaggaactgctcagttaggacccagagggaaccatggaagccccagctcagcttctcttcctcctgctactctggctcccagtttcagataccaccggagagattgtgttgacacagtctccagcccaccctgtctttgtctccgaaggggaaagacgccaccctctcctgcagggccagtcagaatgttggcgtccttcgtaagctaggtaaccaaacacaaacctggaccaggcctcccacggcccctcatctatggtncactccaaacgacgggaccacgtggccaactccccagccctaaggttccaaggtcggacgaggtggggtatggggaaacagtcttcactctacaccatcatcagcctggcnccgtagaaagtntagtgactagtttaattactgtacaaactgtcggtaaccgaggtccgccgtccgggggcctacgttccgggacctgggacaaggtgatanacgaaacgacttgnggctgcaaccattcgttacgttcttaactaaccc

SEQ ID NO: 419496 - DNA, 509 bp, Homo sapiens
  misc_feature: GZ8MTXP01BK82O.8.33.C11.1.454.CMB.2.raw
  modified_base (242)..(242): a, c, t, g, unknown or other
  modified_base (245)..(245): a, c, t, g, unknown or other
  modified_base (254)..(254): a, c, t, g, unknown or other
  modified_base (269)..(269): a, c, t, g, unknown or other
  modified_base (275)..(275): a, c, t, g, unknown or other
  modified_base (284)..(284): a, c, t, g, unknown or other
  modified_base (349)..(349): a, c, t, g, unknown or other
  modified_base (492)..(492): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgagggaaagagccaccctctcctgcaggccagtcagatgtgcnctnagctgacanacaactgcagctccngccctnatctatgtncatccaatcggccacgtgcatcccagccaggtcagtcggcaggtggtatgggaacagtctcactntcacgatcgatcagcctgacgctgaagatgttgctagtttatactgtacaactatcgtaccgtagtcggcccgtaccgggggcctacgttcggaccctgggacccaagggtgagattcgaaacggcttggttggctgcaaccngtccttgtcttctaacc

SEQ ID NO: 419497 - DNA, 698 bp, Homo sapiens
  misc_feature: GZ8MTXP01CLZL7.8.33.C11.1.454.CMB.2.raw
  modified_base (399)..(399): a, c, t, g, unknown or other
  modified_base (613)..(613): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtagtccagccgtgggagtcacagagacctctcctgtgcagcctcgtggtccaccttcagtacgctacggcagtcgccacgtcgggaccccaccaaaccgtccgaggacgaaggggtattgggaggtgggtgcttagtttgttcatccgtggaggtctagtgtaacaagtgtatcgntgaccgcgtaggacggtccagtccacatcctacgaagacgaacaaccgtaccgaaacgaacctaagtaagttacggttacgtttaccggaaacctacggaaaccgtaacgtacccgtaaaggtcccgtaggtaaacgggtacggtaacgggtagtaacgtaacgttacggtaacggttaacgggggaaaagggggaaccgggggttaaacccgnggggttaaccgggggtaaccttaacccggtaacggtttacccgttacgggttacgggtaacccggtttcgggtaaccccgggggg

SEQ ID NO: 419498 - DNA, 648 bp, Homo sapiens
  misc_feature: GZ8MTXP01B3DAD.8.33.C11.1.454.CMB.2.raw
  modified_base (308)..(308): a, c, t, g, unknown or other
  modified_base (409)..(409): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagaatgttggcgtccttgtaagctggtaccaacacaaacctggccaggctcccaggcccctcatctatggtncatccaacgagggccacgtggcatcccagccctaggttcaggtcggcaggtgggtatggggaacagtccttcactcctacaccatcatcagccgtgggacncctagaaagattgttagacttagtttattacgtgtaccaaagtagtaccgtaccggtaggtcgggcccgttaccgggggtcccttaccgtttccggggaccccgttagggggaaccccgtaaagggggttcggaacgggtaaacttaaaccggtaaaaaaccggtaaccgttgggttcgggacccgtttaaggacccctaaccttacgtccgttcggttccctttttaacgtaaccccg

SEQ ID NO: 419499 - DNA, 566 bp, Homo sapiens
  misc_feature: GZ8MTXP01DXOHE.8.33.C11.1.454.CMB.2.raw
  modified_base (425)..(425): a, c, t, g, unknown or other
  modified_base (518)..(518): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctcctgtgcagcctctgggttcaccttcagtagctacggcatgcacgtgggtccccgccaaaactcccgaaggcaaagggggattgggagtgggggtggctagtttgttcatccgtggagggctagtgttacaatggtatgctgacgcgtgaaggcgatcacatctacagagacaacnccagaacacaatggtatttggacctagaacagcctaagtcctgagactacgggtgtaatacttactggttaacggaaggggagggggaaccgnggacggggtaagtaccgaagttactccgttggtaacgttcgtcggggg

SEQ ID NO: 419500 - DNA, 771 bp, Homo sapiens
  misc_feature: GZ8MTXP01AW128.8.33.C11.1.454.CMB.2.raw
  modified_base (280)..(280): a, c, t, g, unknown or other
  modified_base (285)..(285): a, c, t, g, unknown or other
  modified_base (292)..(292): a, c, t, g, unknown or other
  modified_base (387)..(387): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaacgtggtggagtcgtgggggagcgtagtccagccgtgggagtcacagagactctcctgtcgcagcctcgtcggttcaccttnagtcnctacggnagtgcacgtcgggtcccaccaaactccgaggacgaagggtattggggagttgggtagctagtttgttcagtccgtggagggctaggttcgttaanaagttgggtattcggacgtcggaccggtccggtaggaaaccgggtccgtacttaccaccgtacttacccgaccgtaaacgacgaaaccgtaaccgtacccgaaacggaacctaacgtaagttacggggtttaacgtttaccgggtaaccgtaacggaaaccgtaacggtaaccgttaacggtacccgtagggtaaccgggtaacgtaccgggggttagtaaacgttaaccggttacggttaacgggttaaacggggtaaaacggggggtaaccggggggaaacccgttacgggggttacccggggtaacggttaaccccgttaaacggggtttaccccgtttaccggtttacgggtaacccgggttcccgggttaacccggggg

SEQ ID NO: 419501 - DNA, 596 bp, Homo sapiens
  misc_feature: GZ8MTXP01CQBMC.8.33.C11.1.454.CMB.2.raw
  modified_base (212)..(212): a, c, t, g, unknown or other
  modified_base (249)..(249): a, c, t, g, unknown or other
  modified_base (254)..(254): a, c, t, g, unknown or other
  modified_base (260)..(260): a, c, t, g, unknown or other
  modified_base (269)..(269): a, c, t, g, unknown or other
  modified_base (272)..(272): a, c, t, g, unknown or other
  modified_base (275)..(275): a, c, t, g, unknown or other
  modified_base (280)..(281): a, c, t, g, unknown or other
  modified_base (283)..(283): a, c, t, g, unknown or other
  modified_base (287)..(287): a, c, t, g, unknown or other
  modified_base (295)..(295): a, c, t, g, unknown or other
  modified_base (310)..(310): a, c, t, g, unknown or other
  modified_base (356)..(356): a, c, t, g, unknown or other
  modified_base (570)..(570): a, c, t, g, unknown or other
tcagctcgcgtgtccacgaccggtgctcgatttagagtgagctcgttgggtttgggggaggaactgctcagttaggacccggagggaaccatggaagccccagctcagcttctcttcctcctgctactctggctcccagtttcagataccaccggagagattgtgttgacacagtcctccagccaccctgtctttgtctccgaaggggaaancgcccacccctctcctgcagggccagtcagatgtgcnctgantgacanacaactgcngcnccngcccnntnatgncatcaagnggccagtcgcatccngccagttcagtgccaggtggtagtggacaagtcttcactctcacancatcacgctggacgctagaagtattgttgtacgttagtttacttacgtcgtaccaaacgtacgtaccggtaccggtacggtcgggtccccggtcccggggggtaccttacccgggtttccggtccccggtacggggtacccggtaaggggtaacggtaacggaacgttaaccgaaacggtaaacgtcggttacgggcgttacggtcaacccgtnttcgtcgttcttccgttctttccccg

SEQ ID NO: 419502 - DNA, 747 bp, Homo sapiens
  misc_feature: GZ8MTXP01BHLZE.8.33.C11.1.454.CMB.2.raw
  modified_base (291)..(291): a, c, t, g, unknown or other
  modified_base (300)..(300): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacctgttctttgtctccgaggggaaagacgccaccctctcctgcagggccagtcagatgttggctcttgagctagtaccaacacaactggccaggctcccgagccctnatctatggncactccaacgacgggcccacgtcggcactccccgagcccgtaggttcaggtccggacgtagggttagggggtaacgtgggggaaactacgtaaccgtttacaacccttcctaccaaccctattccaacttaccgaacgtcccgttaggggacgtacccgtaggtaaacggtagtttgggttacgtacgttaagttttacttaacgttcggtaaccgtaaactaacggtttacccggtaaccgggtacgggtccgggtaccccgggttacccggggggtaccctttaacccgggtttcccggggaccccggttacgggggaaaccccggttaaggggtacggggttaacggtaacgttaaccggaaaacgggtaccgttacggggttcggttaccgttaacggaccgtaacccttaacggttccttacggttcccgtttcttaacccg

SEQ ID NO: 419503 - DNA, 552 bp, Homo sapiens
  misc_feature: GZ8MTXP01EX7DE.8.33.C11.1.454.CMB.2.raw
  modified_base (293)..(293): a, c, t, g, unknown or other
  modified_base (303)..(303): a, c, t, g, unknown or other
  modified_base (394)..(394): a, c, t, g, unknown or other
  modified_base (525)..(525): a, c, t, g, unknown or other
  modified_base (539)..(539): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagatgttggcgcttgaagctggaccaacacaaacctggccaggctcccaggcccctnatctatggtncatcccaaacgacgggccacgtggaccatccccgagcccagggttcaggtcggcaggtgggtaatggggaaccaggaacctttcatttccncacctatcatcagcctggacgcctaggaagtattgttgcttagtttattacgtgtacgaactagtccgtacgagtcggccgtcggggcctacgttcggcctcgggacgaaggtggagagttacgaacgtanggttgctgccaacntcttcgtcttctc

SEQ ID NO: 419504 - DNA, 590 bp, Homo sapiens
  misc_feature: GZ8MTXP01CHP1H.8.33.C11.1.454.CMB.2.raw
  modified_base (210)..(210): a, c, t, g, unknown or other
  modified_base (301)..(301): a, c, t, g, unknown or other
  modified_base (413)..(413): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaaggggaaanacgcccaccctctcctgcagggccagtcagaatgttggcgccttgtaagctggtaccaacacaaacctggccaggcctcccacggcccctnatcctatggtgcatccaagtacggggcccacgtggccactccccgagccaaggttcagtcggcaggtggggtatggggaacagcttcactctcaccatcatcagcctggacncgtagaagtattgttgtacttagtttaatactgtaggaactagttccgtacggagttcggcccgttccgggggcctacgtttccgggcccgttagggacccgtaagggtcggacgtaacgttacgaaaacgtacgttggttggacctggccaacctattcgttcgttcttcgtaacc

SEQ ID NO: 419505 - DNA, 567 bp, Homo sapiens
  misc_feature: GZ8MTXP01EZH6C.8.33.C11.1.454.CMB.2.raw
  modified_base (302)..(302): a, c, t, g, unknown or other
  modified_base (313)..(313): a, c, t, g, unknown or other
  modified_base (551)..(551): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgttctttgtctccgaaggggaaagacgccaccctctcctgcagggccagtcagaatgttggcgtccttcgtaagctggtaccaacacaaacctggccaggctcccacggcccctnatctagtggtncatcccaaagtacgggcccacgtggccaactccccagccctaggttcaggtcggcaggtgggtatgggaaacagtcttcactctcaccatcatcagcctggacgctagaagtattgtgacttagtttattactgtacaatagtccgtacgaggtccggccgtccggggcctacggttccggccgtagggaccgaagggtcgagacttacgaaacgtacgttggttcggctgcaacctntcttcgtcttcgtaac

SEQ ID NO: 419506 - DNA, 554 bp, Homo sapiens
  misc_feature: GZ8MTXP01E3IU3.8.33.C11.1.454.CMB.2.raw
  modified_base (210)..(210): a, c, t, g, unknown or other
  modified_base (246)..(246): a, c, t, g, unknown or other
  modified_base (262)..(262): a, c, t, g, unknown or other
  modified_base (285)..(285): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagccaccctctcctgcagggccagtcagaatgtgcncttgaagctgaccaanacaaactgcagctcccagccctnatctatggtgcatccaacaggggcccactggccactccccagccaggttcaggtcggcagtgggatgggaacagcttcactctcaccatcatcagcctggacgcctgaagatgttagctagtttaattactagtacaactacgtaccgtaccgaggtcggcccgttcccggggggcctaccgtttccggacccgtcgggaaccgtaagggtcggagacttacgaaacgtaacgttggttcggactgacaacatcttcgtcttcgtaacc

SEQ ID NO: 419507 - DNA, 682 bp, Homo sapiens
  misc_feature: GZ8MTXP01A6P0M.8.33.C11.1.454.CMB.2.raw
  modified_base (299)..(299): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgttctttgtctccgaaggggaaagacgccaccctctcctgcagggccagtcagaatgttggcgtcttgaagctggaccaacacaacctggccaggcctcccacggcccctnatctatggtgacatacccaacgacgggccacgtcggcaactcccagcctaggttcaggtcggcaggtggtatgggaacagcttcacttcacaccatcatcacgccgtggacgtccgtagaagtagttggttacgtacgttaagttttaacttacttacggttacctaaacgtacgttacccggtaaccggtacggttccgggtccccggttcccggggggtaccccttaccgggtttcccggggtaccccggttacgggggaaccgtaaacgggggtcgggttaaacggtaacgttaaacggtaaaaccggtaacgttcggggttcggttaccggttaacgacccgtaaccgtacttcggttacgttccgtttccgtaacccg

SEQ ID NO: 419508 - DNA, 653 bp, Homo sapiens
  misc_feature: GZ8MTXP01D5L0V.8.33.C11.1.454.CMB.2.raw
  modified_base (265)..(265): a, c, t, g, unknown or other
  modified_base (449)..(449): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtggggagcgtagtccagccgtgggagtcacagagactctcctgtgcagcctntggtcaccttcagtagctacggcagtgccacgtcgggtcccgaccaaactccgaggacgaaagggtgttgggagttgggggtcgctagtttgttcagtccgtggaggctagtgttaacaagttggtatggctacggaccggtcggtaggaaccgggtccgtacgttcacctactccgaccgaanacgacaaaccgtacccgaaggaaacaactaattaggttaagtttacggaacctacgaaacgacgtaccgtaaacgtccgtaggacggtaaccgagggtacgtaacgtaacgttacgtacggttaacgggaaagggaacgggggaaacgcgggacgggtaacgttaccgaacgtaccgtccgttaggtccgttcggtaaccgggg

SEQ ID NO: 419509 - DNA, 651 bp, Homo sapiens
  misc_feature: GZ8MTXP01BNKXB.8.33.C11.1.454.CMB.2.raw
  modified_base (272)..(272): a, c, t, g, unknown or other
  modified_base (289)..(289): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccacctgtctttgtctccgagggaaagacgccaccctctcctgcagggccagtcagaatgtggcgtcttcgaagctgtaccaacacaacngcagctcccacgccctnactctagtggtgcaactcccaaacgacgggacccacgtcggacccactccccgagtacccgtaggttccaggtcggctaggggttggggtagtcggggaaacctacggtaaccttccgacctctacccaacctactcaactccgacgcccgtagggactccgtaggaaagtgttgtacgacttagtttattactggtactaaacgtacgttaccggtacggtaggtcccgggtcccgggtccgggggtacccttaaccggtttcccgggacccggttaggggaacccgaaggggttcggaggtaacttacgaaacgtacgttggcggactgaccctctacgttcgttcgttccttctaaccg

SEQ ID NO: 419510 - DNA, 544 bp, Homo sapiens
  misc_feature: GZ8MTXP01BOBOF.8.33.C11.1.454.CMB.2.raw
  modified_base (298)..(298): a, c, t, g, unknown or other
  modified_base (308)..(308): a, c, t, g, unknown or other
  modified_base (317)..(317): a, c, t, g, unknown or other
  modified_base (358)..(358): a, c, t, g, unknown or other
  modified_base (375)..(375): a, c, t, g, unknown or other
  modified_base (379)..(379): a, c, t, g, unknown or other
  modified_base (386)..(386): a, c, t, g, unknown or other
  modified_base (392)..(392): a, c, t, g, unknown or other
  modified_base (530)..(530): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccagggaaagacgccaccctctcctgcagggccagtcagaatgttggcgccttcgtaagctggtaccaacacaaacctggccaggcctcccaggcccctnatctatggtncatccaacngggccactggcatcccagccaggttcagtcggcagtggtangggaacagcttcactcncacntcatcancctggncctagaagatgttgactagtttatacgtgtacgaactataccgtacgtacgtcggcccgtccgggggtccctacgttccggcccgtcgggacccgaagggtcggagacttacgaaacgacttcggttgctgcaacctntcttcgtcttcgtc

SEQ ID NO: 419511 - DNA, 619 bp, Homo sapiens
  misc_feature: GZ8MTXP01D2VF1.8.33.C11.1.454.CMB.2.raw
  modified_base (213)..(213): a, c, t, g, unknown or other
  modified_base (250)..(250): a, c, t, g, unknown or other
  modified_base (257)..(257): a, c, t, g, unknown or other
  modified_base (271)..(271): a, c, t, g, unknown or other
  modified_base (286)..(287): a, c, t, g, unknown or other
  modified_base (289)..(289): a, c, t, g, unknown or other
  modified_base (293)..(293): a, c, t, g, unknown or other
  modified_base (310)..(310): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccacccttgtctttgtctccgaaggggaaanacgccaccctctcctgcagggccagtcagatgttgcncttgaanctgacaacacaacngcagctccagccctnntnatgncacacaacgacggcagngcactccagccgtaggtcaggtcggcgtagggtggtagtggaaactagtccttcacctcctacaacctatcatcacgtccgtaggacgtacgtaagaaagtgttgttagtacgttaagtttacttacttacgtaactaacgtacgttaccgtacggtacggtccggtcccggtcccggggtacccttaccggtttcccgggacccggtacgggaaccggtaaagggtacgggaacgtaaacgttaaacgaaacggtacgttggttcgacgtaacgactaaccgtacgtcttcgttccttccgtaacccg

SEQ ID NO: 419512 - DNA, 641 bp, Homo sapiens
  misc_feature: GZ8MTXP01A1HH7.8.33.C11.1.454.CMB.2.raw
  modified_base (209)..(209): a, c, t, g, unknown or other
  modified_base (269)..(269): a, c, t, g, unknown or other
  modified_base (287)..(287): a, c, t, g, unknown or other
  modified_base (407)..(407): a, c, t, g, unknown or other
  modified_base (417)..(417): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaangccaccctctcctgcagggccagtcagaatgttggcgccttgaagctgaccaacacaacngcaggctcccaggccctnatctatggtgcatccaaagtacgggccacgtggcactccccagccctagggttcaggtcggctaagggtggggtatggggaacaggtccttcactctacacctatcatcagcctgggacnctgaaacgtntgtagcttagtttacttacgtcgttacaaacgtgttaccgaacccgtgggttccggacccggtttccccgggggaccttaacccggttttccggggacccccgtttacgggggaaaccccgtaagggggttacgggaaggtaaccgttaaacggaaaacccggttaacgttgggttacgggttccttggacctaaccttaggtcttcgtttccttaacgtcccg

SEQ ID NO: 419513 - DNA, 660 bp, Homo sapiens
  misc_feature: GZ8MTXP01AKBYX.8.33.C11.1.454.CMB.2.raw
  modified_base (212)..(212): a, c, t, g, unknown or other
  modified_base (291)..(291): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccaccctgtctttgtctccgaaggggaaanacgccaccctctcctgcgaggccagtcagaatgttgcgtcttgtaagctcgacaacacaactggcagctccacgccctnatctatggtgcactaccgaacgacgggcccacgtggaccactccccgagcccgtaggttacaggtcggcgtaggtcggggtaagtcggggaacaacgtcttaccactcctaccacctatcaactcacgtcccgtagggacgtaccgagtaagtattgttaggtacttagtttaactacgttgtactaaactcgttaccgtaaccggtggtccgggtcccggtcccgggggtcctaccggtttccggaccccggttacgggaaccgtaaggggtacggagtaaccgttaaaccgtaaaacggtaccgttgggttccgcgtaacgggacctaaacccgttgttcccgttacgttcccttccgttaaccccg

SEQ ID NO: 419514 - DNA, 610 bp, Homo sapiens
  misc_feature: GZ8MTXP01E0YTF.8.33.C11.1.454.CMB.2.raw
  modified_base (330)..(330): a, c, t, g, unknown or other
  modified_base (411)..(411): a, c, t, g, unknown or other
  modified_base (419)..(419): a, c, t, g, unknown or other
  modified_base (460)..(460): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagtcgtgggggaggcgtagtccagcctgggagtcacgagagactctcctgtgcagtcctctgggttcaccttcagtagctacggcatgcacgtgggtcccaccaaactccgaggcgaaagggtnttgggaggtgggggtggctagtttgtttcattcccgtggagggctagtgttacaagtggtatgctgacgcgtagacgggcntcacatcncagacgacactaccagaacacatggtattggacctagaacngacctaacgtaccgtagacggacgtacgggtgtaactaacgttacgtacggttaacgggaaagggggtaacgggggaaccgagggaccggggtaacgttacccgtaacgttccgttaccgttacggtaaccggttccgggtaaccggggg

SEQ ID NO: 419515 - DNA, 675 bp, Homo sapiens
  misc_feature: GZ8MTXP01AJK0Q.8.33.C11.1.454.CMB.2.raw
  modified_base (320)..(320): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaaggggaaagacgcccaccctctcctgcgacgggccagtcagaatgtggcgtccttagaagctaggtaaccaacacaaaccgtggcccaggcctcccgacggcccctcatctatggtcncataccaacgacgggcccacgtggcacgtcccgagccgtaggttcaggtcggcgtagggtggggtatggggaaactagtccttacacttcctacactatcactcgacgccgtagggacgccgttaggaaagtgttggttacgtacgtttagttttaacttacgtaggtacctaaacgtacggttccggtaacccgggtaggtcccggggtaccccggggttcccgggggtcccttaaccggtttccccggggacccgttacgggggaacccgtaaggggtcggttaaagtacgttaaacggaaaccgtagttcgggttcgccgtgacccaacgtcttcgttcgttaacttcgtcc

SEQ ID NO: 419516 - DNA, 649 bp, Homo sapiens
  misc_feature: GZ8MTXP01C1SS4.8.33.C11.1.454.CMB.2.raw
  modified_base (209)..(209): a, c, t, g, unknown or other
  modified_base (293)..(293): a, c, t, g, unknown or other
  modified_base (303)..(303): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccacctgtctttgtctccgaggggaanacgccacctctcctgcgagggccagtcagatgttggcgcttgtaagctagtaccaacacaaactggccaggctcccaggccctnatctatggtncatccaacgagggcccatggacactcccagcctaggttcaggtcggcaggtgggtagtgggaacagtcttcactcctacacctatcatcacgtcctaggacgccttagaaagtgttgttacgtacgttagtttaattacgttacgttactaaacgtacgttaccggtaaccggtacggtccggggtacccggttccggggggtaccctccggttttcccgggacccgttacgggggaacccgtaaagggggttcggaaacggtacgttaaaccgaaaaccggtaagttcgggttcggttaccgttcggaacctaaccgtaactcgttcgttccgtttcgtaacccg

SEQ ID NO: 419517 - DNA, 627 bp, Homo sapiens
  misc_feature: GZ8MTXP01BEX3G.8.33.C11.1.454.CMB.2.raw
  modified_base (328)..(328): a, c, t, g, unknown or other
  modified_base (358)..(358): a, c, t, g, unknown or other
  modified_base (575)..(575): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggagcgtagtccagccgtgggaggtcacagagactctcctgtgcagcctctgggttcaccttcagtagctacggcatgcacgtcgggcccaccaaactccgaggcaaagggtnttgggagtgggtgctagtttgttcatccgnggaggctagtgttaacaagttgggtatgcgtggacgccggtaggaacgggtccgattccgacctatcctaccgaagacgaaccaactaccgaacggaaacaactaagttacggttaagtttacggaacctagaaacacgtacctaacgtaccgtaggaacggtacgtacgggtataactacgttacgtaggttacgggaaaggggacgggggaacgngggacgggtaagtaccgaagttcgtcgttacggtaacgttcggtaaccgggg

SEQ ID NO: 419518 - DNA, 651 bp, Homo sapiens
  misc_feature: GZ8MTXP01A8WKV.8.33.C11.1.454.CMB.2.raw
  modified_base (287)..(287): a, c, t, g, unknown or other
  modified_base (297)..(297): a, c, t, g, unknown or other
  modified_base (306)..(306): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaaggggaaagacgccaccctctcctgcagggccagtcagatgtgcgtctgtagctgtaccaacacaactgccagctcccagccctnatctatggtncatccgaancgggccacgtggcactcccgagccaggttcagtcggcaggtgggtatgggaacagtcttcgactcaccacatcatcagcctggagtccaggaactagttgttgtacttagtttacttactcgtactaaacgtacgttaccgtaaccgtacggtccggtccccgggttcccgggggtacccttaccggtttcccggggaccccggttacggggaaaccccggtaagggggttcggaaacgggtaaaccgttaaccggaaaacccggtaaaggttcgggttacgggttcccgtaacgggaccctaaccggttaactcccggttccgttaaccctttccgtaaccccg

SEQ ID NO: 419519 - DNA, 568 bp, Homo sapiens
  misc_feature: GZ8MTXP01B806D.8.33.C11.1.454.CMB.2.raw
  modified_base (314)..(314): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcaggccagtcagaatgttggcgccttgtaagctgtaccaacacaaacctggccaggctcccaggcccctcatctatggtgcatccaacngggccactggcatcccagccaggttcagtcgcagtggtatgggaacagcttcactctcaccatcatcagcctggacgcctgaagtattgttgctagtttattacgtgtacaactattccgtaaccgtagtcggcccgtccgggggcctacgtttccgggcccgttcgggaccgtaaagggtcggagtaacgttacgaaaacggtaacgttaggttcggacgttggccaacctacgtcttgttcctttcgtaacc

SEQ ID NO: 419520 - DNA, 614 bp, Homo sapiens
  misc_feature: GZ8MTXP01AB9UE.8.33.C11.1.454.CMB.2.raw
  modified_base (205)..(205): a, c, t, g, unknown or other
  modified_base (213)..(213): a, c, t, g, unknown or other
  modified_base (238)..(238): a, c, t, g, unknown or other
  modified_base (244)..(244): a, c, t, g, unknown or other
  modified_base (252)..(252): a, c, t, g, unknown or other
  modified_base (273)..(273): a, c, t, g, unknown or other
  modified_base (283)..(283): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacctgtctttgctcgagggaangccacctntcctgcagggccagtcagatgtgcncttganctgacaanacaactgcagctccagccctnatctatggtncatccaacgcgggccacgtggcactcccgagccaggttcaggtcgcaggtggtatgggaacagtcttcactctcactatcatcacgccgtagggacgcgtacccgaagtattaggttcgtacgttaggttttaattaacgttacggtaccgtaaacgtacgttaccggtaaccggtaacggtccgggtcccggtcccgggggtacccgtaccggtttccggggaccccggttacggggaaccggtaacgggtacggaaggtacgttaaccgaaacggtaacgttggttacggcgtcggacaacctacgtcgttacgttcgttcgtaacccg

SEQ ID NO: 419521 - DNA, 580 bp, Homo sapiens
  misc_feature: GZ8MTXP01AXCCT.8.33.C11.1.454.CMB.2.raw
  modified_base (360)..(360): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccagggaaagagccaccctctcctgcagggccagtcagaatgttggcgccttcgtaagctggtaccaacacaaacctggccaggctcccaggcccctcatctatggtgcatccaacagggccatggcatcccagccaggttcagtcggcagtggatgggaanagcttcatctcaccatcaatcagcctggacgcctagaagattgtagactagtttaatacgttagtacaaactagtccgtaccggtagtcgggcccgtccgggggcctaccgtttccggaccccttggtgaacccgtaaggttgggaagacgtaaccgaaaacggaacgttggttacgggaacttcggaacccaacctacgttccctggttcctttaaccg

SEQ ID NO: 419522 - DNA, 668 bp, Homo sapiens
  misc_feature: GZ8MTXP01BUN5G.8.33.C11.1.454.CMB.2.raw
  modified_base (334)..(334): a, c, t, g, unknown or other
  modified_base (365)..(365): a, c, t, g, unknown or other
  modified_base (430)..(430): a, c, t, g, unknown or other
  modified_base (548)..(548): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtagtccagccgtgggagtcacagagactctctgtgcagtcctcgtggtccaccttcagtagctacggcagtcgcacgtcgggtaccccacaaactccgaggcgaaagggtnttgggaggtgggtgctagtttgttcagtcgnggaggctagtgtaacaagtggtatcgctggacgccggtaggaacgggtccgtaattccaaccgtntacccgtacgaacgaacgaaccaactaccgaaacgaaacaacgtaagttagggtttaactttacggaaccttagaaaccgacgtacccgttaacgtccgtaggacggtacgtacggtntaacgtaccgttaaggtaggttaaacggggaaacggggacggggttaaaccgaggttccgggtaagttacccgtaaacggttcgttaccgtttacgggtaaccgttcgggtaacccgggg

SEQ ID NO: 419523 - DNA, 761 bp, Homo sapiens
  misc_feature: GZ8MTXP01BMPV7.8.33.C11.1.454.CMB.2.raw
  modified_base (291)..(291): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagtcgtgggggagcgtagtccagccgtgggagtcacagagactctcctgtgcagcctcgtgggttccaccttcagtagctacggnatgcacgtggtcccaccaaacctccgaggcgaaagggtgttggaggttggggtggctaggtttgttcagtccgtagggagggtctaggttcgttaacgaaagttgggttaatcgggtctacgggaccggtacccgggtagggaaacggggtcccgtaacgttacccaacccgtacgttacccgtacccgaaacggtaacggaaccctaaacccgtacccgaaacgggaaacctaaacgtaaacgttagggtttaaacgtttacgggaaacccttacggaaaccgtacgtacccgttaacgtacccgtaggaacggtaaccggtacgggttagtaaacttaacgttaacggttacgggaaacgggtaaagggggaacggggggttaacccgagggttaccgggggtaacgttaccccggaaacgtttacccgttaccggttacgggtaacccggtttcgggtaaccggggg

SEQ ID NO: 419524 - DNA, 606 bp, Homo sapiens
  misc_feature: GZ8MTXP01CHS75.8.33.C11.1.454.CMB.2.raw
  modified_base (275)..(275): a, c, t, g, unknown or other
  modified_base (326)..(326): a, c, t, g, unknown or other
  modified_base (405)..(405): a, c, t, g, unknown or other
  modified_base (454)..(454): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctcctgtgcagcctcgtggttcaccttnagtagctacgcatcgcacgtcgggtcccaccaaacgtccgaggacaagggnttgggagtgggtggctagttgttcatccgtggaggctagtgtaacaagtggtatgctgacgccgtgaaggcctatcacntctcagacacaactcaagaacacaatcggtatttacggacctagaaacncgacctaaagtccgtaggacggtacgacgggttgtaactaacgttacgtacggttaacggaaacgggggacgggggaaacccgaggggaccgggtaacgttacccgtaacggttaccttaccggttttcggaaccggttcgggttccggggg

SEQ ID NO: 419525 - DNA, 531 bp, Homo sapiens
  misc_feature: GZ8MTXP01DDHPP.8.33.C11.1.454.CMB.2.raw
  modified_base (208)..(208): a, c, t, g, unknown or other
  modified_base (243)..(243): a, c, t, g, unknown or other
  modified_base (249)..(249): a, c, t, g, unknown or other
  modified_base (256)..(256): a, c, t, g, unknown or other
  modified_base (277)..(277): a, c, t, g, unknown or other
  modified_base (286)..(286): a, c, t, g, unknown or other
  modified_base (295)..(295): a, c, t, g, unknown or other
  modified_base (356)..(356): a, c, t, g, unknown or other
  modified_base (361)..(361): a, c, t, g, unknown or other
  modified_base (366)..(366): a, c, t, g, unknown or other
  modified_base (380)..(380): a, c, t, g, unknown or other
  modified_base (388)..(388): a, c, t, g, unknown or other
  modified_base (415)..(415): a, c, t, g, unknown or other
  modified_base (506)..(506): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaanagccaccctctcctgcagggccagtcagatgtgcnctgaanctgacanacaactgcagctccagccctnatcatggtncatccaacngggccacgtggccatccccagccaggttcaggttcggctaggtgggtatgggaacagcttnactcncaccntcatcagcctggcnctagaagntgttgctagtttattacgtgtacaacngttacgtacgagtcggcccgtcgggggacctacgttccggcccgtgggacctaaggtcggagtagttacgaaacggacttggcgactgacncgtactcgttacgttcttcgtaacc

SEQ ID NO: 419526 - DNA, 743 bp, Homo sapiens
  misc_feature: GZ8MTXP01AQKEO.8.33.C11.1.454.CMB.2.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagcgtacgtaaccaacaaccaaccgtcgaccgacggccctacccgacccggtcccctactacttactagtcggtcgacctactaccccgaaacggaccgggaccctacggtcggacctacccgtaccccgacgacccgttaggtaccgtagggtccggacgtaggggttagggtaggacgggaaacctacgttaaccttccaacccttcctacccaactactactaactccacggtccgtagggaccgtcgtaaggaaacgtgttggttacgatttaagtttaacttacgttacgaacgtaaactggttacccggtaccggagggtcccggtccccggggtcccgggggtacctttaccgggttcccggtacccgggtacggggaaccggtaagggtaggacgtaacgaaaccggtaaaacgtcggttcgggttcgggttactccggcctaaaccctgttccgttacgtttccttaacgttaaccccg

SEQ ID NO: 419527 - DNA, 642 bp, Homo sapiens
  misc_feature: GZ8MTXP01CUOI4.8.33.C11.1.454.CMB.2.raw
  modified_base (284)..(284): a, c, t, g, unknown or other
  modified_base (360)..(360): a, c, t, g, unknown or other
  modified_base (457)..(457): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactgggtggagtcgtgggggaggcgtagtccaggccgtggggagtcacagagactctcctgtcgcacgcctcgttgggttcaccttnagtacgctacggcagtgccacgtcgggtccccaccaaacctccgaagggcgaaaggggtgttggggagttgggggnggtactaggtttgttcagtccgtggaggggctaggtgttaacaagttggtatgctggacgcggtggacggcctatcacatcctacagacgaacaacnccgaagaaacactaacgttggttaactttcggacctagaaaccgtacgacctaagtccgtaggacggacgtacgggtgtaacgtacttaggtacggaacgggaacggggacgggggaaacgttggggaccggggtaacgtaccgtaacggttcttacggttacggtaaccggttcggtccggggg

SEQ ID NO: 419528 - DNA, 622 bp, Homo sapiens
  misc_feature: GZ8MTXP01BYOCP.8.33.C11.1.454.CMB.2.raw
  modified_base (283)..(283): a, c, t, g, unknown or other
  modified_base (292)..(292): a, c, t, g, unknown or other
  modified_base (303)..(303): a, c, t, g, unknown or other
  modified_base (393)..(393): a, c, t, g, unknown or other
  modified_base (402)..(402): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctccagtttcagataccaccggagagattgtgttgacacagtctccagccaccctgtctttgtctccgaggggaaagacgccaccctctcctgcagggccagtcagatgtgcgcttgaagctgaccaacacaactgcagctcccagccctnatctatggncactccaacgngggccacgtggcactcccagccaggttcaggtcggcgaggtgggtatgggaacagtaaccttcgactctaccacatcatcagcctggacnctagaagtnttgtgacttagtttattacgtgtacaagtcgttccgtaaccggtaggtccgggacccggttcccgggggtacccttacggtttccccggggacccgttacggggaacccgtaaaggggtacgggaacggtaaacgttaaccggaaaacgggttacgttcgggttacggttccgtaaggaccctaacccgtagttccgttacgttccctttcgtaaccccg

SEQ ID NO: 419529 - DNA, 562 bp, Homo sapiens
  misc_feature: GZ8MTXP01DQJTL.8.33.C11.1.454.CMB.2.raw
  modified_base (247)..(247): a, c, t, g, unknown or other
  modified_base (265)..(265): a, c, t, g, unknown or other
  modified_base (280)..(280): a, c, t, g, unknown or other
  modified_base (290)..(290): a, c, t, g, unknown or other
  modified_base (362)..(362): a, c, t, g, unknown or other
  modified_base (385)..(385): a, c, t, g, unknown or other
  modified_base (396)..(396): a, c, t, g, unknown or other
  modified_base (439)..(439): a, c, t, g, unknown or other
  modified_base (524)..(524): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccaccctgtctttgtctccgaaggggaaagacgccaccctctcctgcaggccagtcagatgtgcnctgagctgacacacaacngcagctccagccctnatctatggtncatccaacgacggccatggcactcccagccaggttcaggtcggctaggtgggtatgggaacagtctcactcncacctatcatcagcctagggacnctaggaaagtnttgtgacttagtttatactgtactaaagtacgtacgtaccggngtcgggtcccgtacggggcccttacgtttcccgggccctacggggaacctaaggggtgaagtaacttacgaaaacgtcgttcggnggttcctgacccaacttcgtcttcgttccttcgtaacc

SEQ ID NO: 419530 - DNA, 827 bp, Homo sapiens
  misc_feature: GZ8MTXP01ER2OU.8.33.C11.1.454.CMB.2.raw
tcagctcgcgtgtccacgaccggtgctcgatttagagtgagctcgtttgggtttggggctgggagaggagcccagcactagaagtcggcggtgtttccattcggtgatcagcactgaacacagaggactcaccatggagtttgggctgaacttgggtttttcctcgttgcttcttttaagaggtgtccagtgtcaagtgcaagtggtggagtcgtggggagcgtagtccagccgtgggaggtcacagagactctcctgtgcagcctcgtggttccaccttcagtagctacggcagtcgccgtacgtcgggtccccaccaaaccgtcccgaagggccgaaagggggtagtttgggggacgggttgggggtacggcgtttaaggttttcgtttacagttccccgttaggggacggggtcgtaggtttaggtttaaccaaaggtttggggttaaagtcggtaccgttacgggaacccgggttaccgggtagggaaacggggtcctaacgttaccaaccgtactacccgtaccgaagaacgtaaccaaaccgtaccgaaacggtaaacctaaacgtaacgtttaggggttaacgttttaccggggaaacccttacggaaaacctaccgtaacccgttaaaggtaccccgttaagggaacgggtaaccgtaaccggggttagttaaaccgttaacgttaaaccgggtaggggttaaaccgggggaaaagggggtcgggggaaaacccgttgggaacccgggggttaaactacccggttaaaacggttccgttaccggttacgggtaacccgggttaacggggtaacccgggg

SEQ ID NO: 419531 - DNA, 623 bp, Homo sapiens
  misc_feature: GZ8MTXP01DHR1S.8.33.C11.1.454.CMB.2.raw
  modified_base (259)..(259): a, c, t, g, unknown or other
  modified_base (291)..(291): a, c, t, g, unknown or other
  modified_base (301)..(301): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccaccctgttctttgtctccgaaggggaaagacgccaccctctcctgcagggccagtcagaatgttggcgcttgaanctagacaacacaactggcaggctccagccctnatctatggtncatccaacagggccactggcactcccagccaggtcagtcggcagtggtatgggaacagtcttcactctcaccatcatcagccgtggacgctagaaagtattgttgtactagtttattacttcgtacaactagttaccgtaccggtaggtcgggtccccggtccgggggtacccttaccggtttccgggaccccggttacggggaacccgtaaaggggttcgggaacggtaaccgttaacgaaaaccgggtaaacgttcggggttcggaccgttcgggaccctaacccggtattccgttacggtttccgtttccgttaacccg

SEQ ID NO: 419532 - DNA, 590 bp, Homo sapiens
  misc_feature: GZ8MTXP01EI6V4.8.33.C11.1.454.CMB.2.raw
  modified_base (335)..(335): a, c, t, g, unknown or other
  modified_base (410)..(410): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtagtccagccgtgggagtcacgagagactctcctgtgcagcctcgtggttcaccttcgagtagctacggcatgcacgtcggtacccgaccaaactcgaggacaaagggggtnttgggagtgggtgcttagttgttcatccgtggaggctagtgtacaagtgtatgctgacgcgtagacggcatcacntcacagagaacactacgagaacacaattcggtatttacggacctagaaacacgtacctaacgtccgtagacggacgtacgggtagtaataccgttaggtaggttaaacgggaagggggaacggggaacgaggacggggtaattacgaagttctcgttacgtaacggttcggtaaccgggg

SEQ ID NO: 419533 - DNA, 744 bp, Homo sapiens
  misc_feature: GZ8MTXP01BYWZM.8.33.C11.1.454.CMB.2.raw
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtagtccagccgtgggagtcacagagactctcctgtgcacgcctcgtggttcaccttcagtagctacggcatgcacgtcgggtcccaccaaactccgagggcgaaaggggtagttggggaggtgggggtggcttaggtttgttcagtccgtgggaggtctagttgttaacaaagttggtatggcttggaccggtccgggtagggaaccggggtccgagtttccaaccgtactcctaccgaacgaacgaaccaaaccgtaccgaaacgaaaccaactaaagtttcggggttaacgttttacgggaaacccttaaggaaaccgtacgtaacccgttaaacggtaccccgtagggtaacgggtaccggtaaacggggttgttaaacgttaacgttaaccggttaggggaaaccgggtaaaggggggaaccggggggttaaaccgcggggttaccggggttaacgttacccggtaacggtttaacccgttcggtttacggtaaccggtttccgggttaaccggggg

SEQ ID NO: 419534 - DNA, 671 bp, Homo sapiens
  misc_feature: GZ8MTXP01BVF9Z.8.33.C11.1.454.CMB.2.raw
  modified_base (212)..(212): a, c, t, g, unknown or other
  modified_base (262)..(262): a, c, t, g, unknown or other
  modified_base (285)..(285): a, c, t, g, unknown or other
  modified_base (294)..(294): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccttgttctttgtcctccgaagggaaancgcccaccctctcctgcaggccagtcagatgtgctcttgagctagacaanacaactgacagctccacgccctnatctatggncactccaaacgcgggaccacgtcgccacgtccccagccctaggttccaggttcggcgtagggtgggtagacgggaactaagtcttcaacttcaccaccatccatccaacgccgtaggacgtaccaggaaatgttgttcgacgttaagtttacttacgtcgtaactaaaacgtcgttaaccgggtacctagggtcccggtccccgggtccgggggtacccttaccgggttacccgggtacccggtacgggggaaacccgtaaagggggttcggaaacgtaaacgttaaccggaaaaaccgtacgttcggggacgggttacttccggaacccgtaaccgttcttaccgtttcggttaacccgtttaactttaaccccgg

SEQ ID NO: 419535 - DNA, 816 bp, Homo sapiens
  misc_feature: GZ8MTXP01DIBKF.8.33.C11.1.454.CMB.2.raw
  modified_base (176)..(176): a, c, t, g, unknown or other
  modified_base (180)..(180): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttggctgaactgggttttcctcgttgctcttttaagnggtntccagtgtcaagtgcaacgtggtggagtcgtggggagcgtagtccagccgtgggagtcacagagactctcctgtgcagcctcgtggttcaccttcgagtagctacggcatcgcacgtcgggtacccaccaaacctccgaaggacgtaaagggggtagttggggaacggtttgggggtcggtacgttaaggtttgtttaccagttcccgtagggacggggtctaggttgttaacaagttgggtatcgggaccttaggacccgtccgggtagggaaacgggtcccgtaacgttccaaccgtaacgtcctaacccgaaggaacgtaacctaaaccgtaccgaaacgggaaaccaaacgtaaacgttacgggttaaacgtttaccgggaaaccgttaacgaaaccgtaaccgtacccgttaaacggtacccgtaaggtaaccggtaaccggtaaccgggggttaatttaaacgttaaccggttaaaccggttaacggggttaaaccggggaaaacggggggtaaccggggggttaaaaccccgttagggggttaaccggggtaaacccggtttaacccgtaaacggtttaacccgttaccggtttacgggtaacccgggtttccgggtaaccccgggggg

SEQ ID NO: 419536 - DNA, 527 bp, Homo sapiens
  misc_feature: GZ8MTXP01CX9XN.8.33.C11.1.454.CMB.2.raw
  modified_base (208)..(208): a, c, t, g, unknown or other
  modified_base (245)..(245): a, c, t, g, unknown or other
  modified_base (250)..(250): a, c, t, g, unknown or other
  modified_base (257)..(257): a, c, t, g, unknown or other
  modified_base (262)..(262): a, c, t, g, unknown or other
  modified_base (268)..(268): a, c, t, g, unknown or other
  modified_base (270)..(270): a, c, t, g, unknown or other
  modified_base (274)..(276): a, c, t, g, unknown or other
  modified_base (279)..(279): a, c, t, g, unknown or other
  modified_base (281)..(282): a, c, t, g, unknown or other
  modified_base (284)..(284): a, c, t, g, unknown or other
  modified_base (287)..(287): a, c, t, g, unknown or other
  modified_base (292)..(292): a, c, t, g, unknown or other
  modified_base (300)..(300): a, c, t, g, unknown or other
  modified_base (321)..(321): a, c, t, g, unknown or other
  modified_base (338)..(338): a, c, t, g, unknown or other
  modified_base (357)..(357): a, c, t, g, unknown or other
  modified_base (366)..(366): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacctgtctttgctccgaaggggaanacgcccaccctctcctgcagggccagtcagatgtgcnctganctgacancaacngcagcncngccnnncangnnancanggcangcatccanccagtcagtcgcaggtggtanggaacagtcttcactcncacatcatcagcctggacnctagaagtntgtagcttagtttatactgtacaaactagtccgtaacgaggtcggcccggttccgggggacctacgtttccggcccgtagggaaccctaaggggtgaagtacacgaaaacgtcttaggttcggactcggacctaaccgattcgttcgttccttcgtaaccg

SEQ ID NO: 419537 - DNA, 575 bp, Homo sapiens
  misc_feature: GZ8MTXP01C00HE.8.33.C11.1.454.CMB.2.raw
  modified_base (209)..(209): a, c, t, g, unknown or other
  modified_base (245)..(245): a, c, t, g, unknown or other
  modified_base (250)..(250): a, c, t, g, unknown or other
  modified_base (256)..(256): a, c, t, g, unknown or other
  modified_base (261)..(261): a, c, t, g, unknown or other
  modified_base (267)..(267): a, c, t, g, unknown or other
  modified_base (270)..(270): a, c, t, g, unknown or other
  modified_base (276)..(279): a, c, t, g, unknown or other
  modified_base (281)..(282): a, c, t, g, unknown or other
  modified_base (284)..(284): a, c, t, g, unknown or other
  modified_base (287)..(287): a, c, t, g, unknown or other
  modified_base (290)..(291): a, c, t, g, unknown or other
  modified_base (294)..(294): a, c, t, g, unknown or other
  modified_base (296)..(296): a, c, t, g, unknown or other
  modified_base (300)..(300): a, c, t, g, unknown or other
  modified_base (311)..(311): a, c, t, g, unknown or other
  modified_base (357)..(357): a, c, t, g, unknown or other
  modified_base (375)..(375): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgtgcnctgantgacancaacngcagcnccngccctnnnngnnancangcnngcncnccancagtcagtcgnaggtggtatggaacagtctcactctacacatcatcacgctaggacncctagaagtagttgttanacgttagtttacttacgttacgtaacgtaactacgttaccgtaccggtacggtccggcccggttaccggggacccttaccggtttccggacccggtacgggaacccggtaagggtcggaaagtaacgttaaccgaaaacggtacgttacggggttccgacgtaacggacctaaccgtacttcgttcgttccttcgtaacc

SEQ ID NO: 419538 - DNA, 622 bp, Homo sapiens
  misc_feature: GZ8MTXP01B0QMB.8.33.C11.1.454.CMB.2.raw
  modified_base (183)..(183): a, c, t, g, unknown or other
  modified_base (426)..(426): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgcttcttttaagaggtntccagtgtcaagtgcaactggtggagtcgtgggggagcgtagtccagccgtgggaggtcacagagactctcctgtgcagcctcgtggttcaccttcagtacgctacggcatgccacgtcgggccacccaaactccgaaggacgaagggtagttggaggttgggtggcttagtttgttcagttccgtaggagggctaggttgttaacaagtggtatgctgacgcggtagacggcgtataccacntcaccagacgaccaactacgaacgaacaactaataggttactttaggaacctagaaccagcctaagtcctaggacggacgtacgggtataacgtacttagtacggttaacggaaacgggggaacggggaaccgacgggttaccgggtaacgttaccgaacgttcgttccgttacggtaaccggttcggtaacgggg

SEQ ID NO: 419539 - DNA, 644 bp, Homo sapiens
  misc_feature: GZ8MTXP01BPDA2.8.33.C11.1.454.CMB.2.raw
  modified_base (210)..(210): a, c, t, g, unknown or other
  modified_base (245)..(245): a, c, t, g, unknown or other
  modified_base (251)..(251): a, c, t, g, unknown or other
  modified_base (264)..(264): a, c, t, g, unknown or other
  modified_base (279)..(279): a, c, t, g, unknown or other
  modified_base (289)..(289): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagcccaccctgtctttgtctccgaggggaaancgccaccctctcctgcagggccagtcagatgtgcncttganctgacacacaacngcagctccagccctnatctatggtncactccaagtacgggccacgtggaccactccccgagcctaggttcaggtcggcaggtgggtatgggaacagtcttcactctcaccatcatcagtcctggacgcctagaacgtagttgttgacgttagtttaacttacgttacgtacctaaacgttacgttacccggtaaccgggtacggttccggggtccccggttcccggggggtacccttacccgggttttccccggggaccccggttacgggggaacccgtaaagggggttcggaacgtaacgttaaccgaaaaccggtaacgttcgggttcgggccttggaccctaaccgtacgttccgttacgttcctttccgtaacccg

SEQ ID NO: 419540 - DNA, 573 bp, Homo sapiens
  misc_feature: GZ8MTXP01A2EYA.8.33.C11.1.454.CMB.2.raw
  modified_base (404)..(404): a, c, t, g, unknown or other
  modified_base (407)..(407): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtagtccagcctgggaggtcacagagactctcctgtgcagcctctgggttcaccttcagtagctacggcatgcacgtgggtcccaccaaactccgaggcgaaagggattgggagtggggtggctaggttgttcagtctggaggcagtgttacaagtggtatgctgacgcgtgaacggcatcacntcncagacgacactaccagaacagaatcggtattaggacctagaacagacctaagtacctggaggtacgacgggtgtaatacttacgtaggttacggaaaggggacgggggaaccgttgggaccgggaagtacccgaaggtaccttcgttacgaacgttcgtccggggg

SEQ ID NO: 419541 - DNA, 687 bp, Homo sapiens
  misc_feature: GZ8MTXP01AHFS3.8.33.C11.1.454.CMB.2.raw
  modified_base (181)..(181): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtntccagtgtcaagtgcaacgtggtggagtcgtgggggagcgtagtccagccgtgggagtcacagagactctcctgtgcagcctcgtggttcacttcagtagctacggcagtgcctacgtcgggtccccacctaaaaccgtccgaaggcgaaaggggtgtttggggaggttggggtggctaggtttgttacagtccgtggagggctaggtgttaacaagttggtatgctaggacgtcggtaggacgggtacctataccgacacgtcctacgaagacgaaccaacctacccgaaaggaaacctaacgtaaacgttaggggttaactttaccggaaccttacgaaaccgacgtacctaaacggtacccgtaggtaacggtaaccgtacgggtacgtaactaacgttaacggtacggttaaacggggaaacgggggtaacgggggaacccgagggttaccgggtaacgttaccgaagttaccgtcgttaggtaaccgttcggtaaccgggg

SEQ ID NO: 419542 - DNA, 571 bp, Homo sapiens
  misc_feature: GZ8MTXP01C6BAU.8.33.C11.1.454.CMB.2.raw
  modified_base (208)..(208): a, c, t, g, unknown or other
  modified_base (403)..(403): a, c, t, g, unknown or other
  modified_base (419)..(419): a, c, t, g, unknown or other
  modified_base (428)..(428): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaanagccaccctctcctgcagggccagtcagaatgttggcgtcttgtaagctaggtaccaacacaaacctggccaggcctcccgacggcccctcatctatcggtgactataccaagtacggggccacgtggcctatccccagcccgtaggttcaggtggctaggtgggtatggggaactagcttcacgttctacaccntcatcagccgtggacnctagaagtntgttagctagtttattactgtacaactgtacgtacgagtcggccgtccggggcctacgttccggccgtgggaccgtaagggtgagacttacgaaacgtacgttaggttcgcgtgacctaactacgtcttcgttcttcgtaacc

SEQ ID NO: 419543 - DNA, 616 bp, Homo sapiens
  misc_feature: GZ8MTXP01DU66R.8.33.C11.1.454.CMB.2.raw
  modified_base (214)..(214): a, c, t, g, unknown or other
  modified_base (290)..(290): a, c, t, g, unknown or other
  modified_base (301)..(301): a, c, t, g, unknown or other
  modified_base (310)..(310): a, c, t, g, unknown or other
  modified_base (422)..(422): a, c, t, g, unknown or other
  modified_base (471)..(471): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagttttcagataccaccggagagattgtgttgacacagtctccagcccaccctgttctttgtctccgaaggggaaanacgcccaccctctcctgcagggccagtcagatgttggcgtccttgaagctgaccacacaactgcagctccagcccnatctagtggtncatccaacncggccagtggcatcccagccaggttcaggtcggcaggtggggtatgggaacagtaacttcaaatcctacacccattcaatccgaagtccctagggactcctaggaaaggttnttgtacgacttagtttactacgtacgtacgtaactacgtaccggtacgnggtccggcccggttaccggggtaccttaccggttcccgggacccgtacgggaaccgtaagggtcggaacgtaacgttaaaccgaaacggtgttcggttcggttacctcgaccgtaacttcgttcgttacgttcctttcgtaaccg

SEQ ID NO: 419544 - DNA, 507 bp, Homo sapiens
  misc_feature: GZ8MTXP01DBHKO.8.33.C11.1.454.CMB.2.raw
  modified_base (208)..(208): a, c, t, g, unknown or other
  modified_base (242)..(242): a, c, t, g, unknown or other
  modified_base (247)..(247): a, c, t, g, unknown or other
  modified_base (254)..(254): a, c, t, g, unknown or other
  modified_base (260)..(260): a, c, t, g, unknown or other
  modified_base (275)..(275): a, c, t, g, unknown or other
  modified_base (368)..(368): a, c, t, g, unknown or other
  modified_base (381)..(381): a, c, t, g, unknown or other
  modified_base (393)..(393): a, c, t, g, unknown or other
  modified_base (413)..(413): a, c, t, g, unknown or other
  modified_base (490)..(490): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagttttcagataccaccggagagattgtgttgacacagtctccagccaccctgtctttgtctccaggggaanagccacctctcctgcagggccagtcagatgtgcnctganctgacanacaacngcagctccagccctnatctatggtgcatccaatacgggccacgtggcaactccccagcccaggttcaggtcggcagtgggtatggggaaccaggcttcactctcaccntcatcagcctganctagaagatgtnactagttatactgtcaactntcgtacgagtcggccgtcggggcctacgttcgccgtggaccgaaggtcggagacacgaaacgacttggttggctgcncatcttgtcttcgtaac

SEQ ID NO: 419545 - DNA, 634 bp, Homo sapiens
  misc_feature: GZ8MTXP01A9NHG.8.33.C11.1.454.CMB.2.raw
  modified_base (247)..(247): a, c, t, g, unknown or other
  modified_base (256)..(256): a, c, t, g, unknown or other
  modified_base (278)..(278): a, c, t, g, unknown or other
  modified_base (347)..(347): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctccagtttcagataccacggagagattgtgttgacacagtctccagccaccctgtctttgtctccgagggaaagacgccacctctcctgcagggccagtcagatgtgctctganctagacaanacaactgcagctccacgccctnatctatgtgcatccaacgacggcacgtgccactcccagccgtaggttcgaggtcggcgaggtgggtagngggaacagtcttcaactcctacactactcactcacggctagggacgcgtagaaagtattgttagacttagtttacttagtcgtacaactacgtccgtaccggtacggttccggacccggttcccgggggaccttaccggtttacccgggcccgggtaacgggaacccgggtaagggttacgggaacggtaaccttaaacggtaaaaccgggtaacgttcgggttcgggttacctaagggtacccctaaccttacgtccgtttccggttaacctttcgtttaaccccg

SEQ ID NO: 419546 - DNA, 688 bp, Homo sapiens
  misc_feature: GZ8MTXP01DRIGH.8.33.C11.1.454.CMB.2.raw
  modified_base (277)..(277): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggagcgtagtccagccgtgggagtcacagagactctcctgtgcagcctcgtggttcaccttnagtagctacggcagtcgcacgtcgggtccccaccaaactccgaggacgaaggggtattgggaggtggggtgtctaggtttcgttcagttcccgtggacggggtctaggttcgttaacgaaagttgggtatcgggcttacgggaccggtccggtagggaaacgggcccgtattaccacctatcctacgaaggaacgtaaccaaccgtaccgaagaacaacgtaagttacgggttaagtttacggaaccttaacgaaacgtaacgtaccgtaacgtaccgtaggacggtacgtacgggttagtaactaacgttacgtagggttaaacggaaacgggggaacgggggaaccgacgggacgggtaacgttaccgtaaacgttcgtaccgtttacgaaccggttcggtaaccgggg

SEQ ID NO: 419547 - DNA, 752 bp, Homo sapiens
  misc_feature: GZ8MTXP01DIDIY.8.33.C11.1.454.CMB.2.raw
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtagtccagcctgggagtcacagagactctcctgtgcagcctcgtgggttcaccttcagtagctacggcatgccacgtcgggtcccacccaaactccgaaggacgaaaggggtagttgggaggttgggggtggcttaggtttgtttacagttcccgtgggagggctagtgttaacaaagttgggtatcggcgtacggaccggtccgggtagggaaacggggcccgtaattccaacctactcctacccgaagaacgaacctaaaccgtacccgaaagggaaacctaaacgtaaacgttaggggttaaacgtttttacggggaaaccccttaaggaaaacccgtaacggtaacccgttaaacggttacccgtaagggaaacgggtaaccgtaaccggggttagttaaacgtaaccgttaccgtaagggttaaacgggaaagggggaacggggggaaacccgaggggttaccggggtaacgttaccgtaaacgttaccgttccgtttacgggaaccggttcgggtaacccggggg

SEQ ID NO: 419548 - DNA, 616 bp, Homo sapiens
  misc_feature: GZ8MTXP01C3PDI.8.33.C11.1.454.CMB.2.raw
  modified_base (262)..(262): a, c, t, g, unknown or other
  modified_base (285)..(285): a, c, t, g, unknown or other
  modified_base (296)..(296): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaaggggaaagacgcccaccctctcctgcagggccagtcagatgtgctctgagctgtaccaanacaactgacagctccacgccctnatctagtggtncataccaagtacgggccacgtggccactcccagccgaaggttcgaggtcggctaggtggtagtgggaaacagtctcgactctacacctatcaatcacgcgtaggacgaccgtagaaacgtattgttacgacttaagtttactacttagtacgaaacttacgtccgtacggagtcggtcccggtccggggtaccttacggttcccggccgtacgggaaacccgtaagggtcgggaacgtaacgaacgtaaaaacggtcgttagggcggttactaacggaacctaaccgttaacgttccttcggtttccttaacgtaacccg

SEQ ID NO: 419549 - DNA, 607 bp, Homo sapiens
  misc_feature: GZ8MTXP01B7TR2.8.33.C11.1.454.CMB.2.raw
  modified_base (209)..(209): a, c, t, g, unknown or other
  modified_base (297)..(297): a, c, t, g, unknown or other
  modified_base (368)..(368): a, c, t, g, unknown or other
  modified_base (410)..(410): a, c, t, g, unknown or other
tcagctcgcgtgtccacgaccggtgctcgatttagagtgagctcgttgggtttgggggaggaactgctcagttaggaccagagggaaccatggaagccccagctcagcttctcttcctcctgctactctggctcccagtttcagataccaccggagagattgtgttgacacagtctccagccacctgtctttgtctccgaaggggaaanacgccaccctctcctgcagggccagtcagaatgttggcgtccttgtaagctaggaccaacacaaactgaccaggctcccaggcccctnatctatggtgcactcccaagacgggcccagtcggcaactccccagccaggttcagtcggctaggtgggtanggggaacagtcttcacttcacacatcaactcagccgtggacnccgtagaaagtagttgttacgacttagtttaacttactacggtacaactagttccgtaacggtagtcgggtccccgtcgggggtcccctacggtttccggccccgttagggacccgtaaggggtcgaagtacgttacgaaaacgacgttcggttcgggcctaacggcctaaacgtctcgttcgtcctttcctaaccg

SEQ ID NO: 419550 - DNA, 553 bp, Homo sapiens
  misc_feature: GZ8MTXP01ETUZE.8.33.C11.1.454.CMB.2.raw
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctaggtaccaacacaaacctggccaggctcccaggcccctcatctatggtgcatccaatagggccactggcatccccagccaggttcagtcggcaggtgggtatggggaacagcttcactctcaccatcatcagcctggagcctgaaagattgttgactagtttattactgtacaaactagtcgtaccgagtcgcccttccgtcggggccctacgtttccggcccgtggggaaccctaagggttggagacgtacgaaacgttacgttgttcgggctgccacattctaagttcttaac

SEQ ID NO: 419551 - DNA, 793 bp, Homo sapiens
  misc_feature: GZ8MTXP01EQTXL.8.33.C11.1.454.CMB.2.raw
  modified_base (332)..(332): a, c, t, g, unknown or other
  modified_base (365)..(365): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtagtccagccgtgggagtcacagagactctcctgtgcagcctctgggttcaccttcagtacgctacggcatcgcacgtcgggtcccaccaaactccgaggcaaaggggtnttgggagtggggtggctagtttgttcagtccgnggagggcaggttgttaacaagttgggtatggctcggacggtccggtagggaaacgggtccgtacttccaccgtatcctaccgaacggaacgaacctaaaccgtacccgaaacggaaacctaaaccgtaaagtttaggggtttaaacgttttaccggggtaaacccttaacgggaaaacctaaccgggtaccccgtttaaaacgggttccccgttaagggaaacggggtacccggttaaaccgggggttagtttaaacgttaaaccgttaaccgggttaaggggttaaaccggggaaacggggggtaaaccggggggggaaacccggaacgggggttacccgggggttaacggtttaaccccggttaaacggtttaacccgttcccgggttttacggggtaaccggtttccggggttaaccccgggggg

SEQ ID NO: 419552 - DNA, 722 bp, Homo sapiens
  misc_feature: GZ8MTXP01ATZC5.8.33.C11.1.454.CMB.2.raw
  modified_base (669)..(669): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagtcgtgggggagcgtagtccagccgtgggagtcacagagacctctcctgtgcagcctcgtgggttccaccttcgagtacgctacggcagtcgccacgtcgggaccccaccaaaccgtccgaggacgaaagggtattgggaggtggggtcggtcgtagtttcgttacgagttccgtaggaggggtctaggttcgtttaacgaagttggtagtcgacgtacggaccggtaccgggtagggaaacccggggtccgtaactttacccgaactaccgttaccgtacccggaaacggtaaaccgaaaccgtaaacccgtaaccgaaacggaaactaaacgtaacgttacgggttaacgtttacgggaaccttaacggaaacctacgtaccgtaacggtaccgtaggaacggtaccgtagggtataacgttacgttacggtaggttaacggaaaggggaacggggacgngggacgggtaactaccgtaagttaccttcggttacgtcggttcggtaacgggg

SEQ ID NO: 419553 - DNA, 574 bp, Homo sapiens
  misc_feature: GZ8MTXP01BIFQA.8.33.C11.1.454.CMB.2.raw
  modified_base (208)..(208): a, c, t, g, unknown or other
  modified_base (244)..(244): a, c, t, g, unknown or other
  modified_base (279)..(279): a, c, t, g, unknown or other
  modified_base (341)..(341): a, c, t, g, unknown or other
  modified_base (363)..(363): a, c, t, g, unknown or other
  modified_base (391)..(391): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccagggaaangccaccctctcctgcagggccagtcagatgttggcncttgaagctgacacacaactgcagctccagccctnatcatggtgcatccaacacgggccactggcatcccagccaggtcagtcggctaggtgggtanggggaacagctcactctcaccntcactcagcctggacgcctagaaacgtnttgtgacgttagtttacttacttgtacaactatccgtaccgaggtccggaccgtcccgggggccctaccggtttcccggcccgtacgggtacccgaagggttcggttagacgttacgaaaccgtaagttcgggttcggccgttggccctaaccgtacgtcgttacgttcccgttcgttaaccg

SEQ ID NO: 419554 - DNA, 574 bp, Homo sapiens
  misc_feature: GZ8MTXP01AGUWK.8.33.C11.1.454.CMB.2.raw
  modified_base (208)..(208): a, c, t, g, unknown or other
  modified_base (248)..(248): a, c, t, g, unknown or other
  modified_base (261)..(261): a, c, t, g, unknown or other
  modified_base (264)..(264): a, c, t, g, unknown or other
  modified_base (276)..(277): a, c, t, g, unknown or other
  modified_base (283)..(283): a, c, t, g, unknown or other
  modified_base (292)..(292): a, c, t, g, unknown or other
  modified_base (297)..(297): a, c, t, g, unknown or other
  modified_base (391)..(391): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgctccgagggaagngccaccctctcctgcaggccagtcagatgtgcgcttgtanctgacacacaacngcngctccagccctnntcatgncatcaacgnggccnctgcactcccagccaggttcaggtcggcaggtgggtatcggggaaacagtccttcacttctacacctatcactcagccgtggacgctagaagtntgtgcttagtttacttacgtgtactaacgtacgttccggtaccgaggtccggccccggtccgggggtccctacccggtttccgggaccccgtggggtaacccgtaaggggtacggaagtacgacgaaaaccggtcgttaggttcggctaacggccaacgttatccgttcttccgttcgtaacc

SEQ ID NO: 419555 - DNA, 578 bp, Homo sapiens
  misc_feature: GZ8MTXP01EAXEU.8.33.C11.1.454.CMB.2.raw
  modified_base (244)..(244): a, c, t, g, unknown or other
  modified_base (258)..(258): a, c, t, g, unknown or other
  modified_base (265)..(265): a, c, t, g, unknown or other
  modified_base (277)..(277): a, c, t, g, unknown or other
  modified_base (332)..(332): a, c, t, g, unknown or other
  modified_base (363)..(363): a, c, t, g, unknown or other
  modified_base (403)..(403): a, c, t, g, unknown or other
  modified_base (534)..(534): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtagtccagccgtgggagtcanagagactctcctgncagcctntggttcaccttnagtagctacggcatcgcacgtgggtacccaccaaactccgaaggcgaaaggggtnttgggagtggggtggctagttgttcatccgngagggctagtgttacaatggtatgctgacgcgtgacggcntcacactcacagacgacaacacagaacactaatgtatttcggacctagaacacgtcgtaaacgtccgtaggaacggacgtacgggtagtaactacgttactagggttacggaaaggggaacgggggaacgnggacgggtaagttaccaagttactccgttgtcggttcgtcgggg

SEQ ID NO: 419556 - DNA, 642 bp, Homo sapiens
  misc_feature: GZ8MTXP01CGMJS.8.33.C11.1.454.CMB.2.raw
  modified_base (558)..(558): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtagtccagcctgggagtcacagagactctcctgtgcagcctctgggttcaccttcagtagctacggcatgcacgtggtcccaccaaactccgaggacgaagggatggaggtggggtgctagtttgttcatccgtggaggctagtgttacaagttggatgctgaccgcgtaggaacggccgtatcacagtctacgagacgacaactcaagaacacaagttgtattaggacctagaaccagacccgtaagtacccgtagaacggtacgtaacggggtctaacgttaacgttacggtacggttaaaccgggaaaacgggggaacggggggaaaacccgnggggttaacccgggggtaacgtttaccgtaaacggtttaccgttcccgggttttacgaacccggggttcggttaacccgggggg

SEQ ID NO: 419557 - DNA, 577 bp, Homo sapiens
  misc_feature: GZ8MTXP01CIJVF.8.33.C11.1.454.CMB.2.raw
  modified_base (209)..(209): a, c, t, g, unknown or other
  modified_base (245)..(245): a, c, t, g, unknown or other
  modified_base (250)..(250): a, c, t, g, unknown or other
  modified_base (257)..(257): a, c, t, g, unknown or other
  modified_base (278)..(278): a, c, t, g, unknown or other
  modified_base (288)..(288): a, c, t, g, unknown or other
  modified_base (377)..(377): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgctccgaggggaaanacgccaccctctcctgcagggccagtcagatgtgcnctganctgacanacaactgcagctccagccctnatctatggtncatccaacgaggccactggcatcccagccaggtcagtcggcaggtgggtatgggaacagtcttcactctcacatcatcagcctaggacnctagaatatgtgcttagtttactacgtgtactaactacgttccgtaaccgtaggtccggcccggttccgggggaccctaccggtttccggggcccgtacggggtaacccgaaggggtcgggaaacgtaacgttaaccgaaaacggtaccttgggttcggcttcggaccaacccgtattccgttacgttccttctaacccg

SEQ ID NO: 419558 - DNA, 630 bp, Homo sapiens
  misc_feature: GZ8MTXP01CIAO9.8.33.C11.1.454.CMB.2.raw
  modified_base (260)..(260): a, c, t, g, unknown or other
  modified_base (266)..(266): a, c, t, g, unknown or other
  modified_base (272)..(272): a, c, t, g, unknown or other
  modified_base (283)..(283): a, c, t, g, unknown or other
  modified_base (292)..(292): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctccagtttcagataccaccggagagattgtgttgacacagtctccagcccaccctgtctttgtcctccgaaggggaaagacgcccaccctctcctgcaggccagtcagatgtgctctgagctgacanacaacngcagcnccgacgccctnatctatgtncatccaacgacggccaacgtcggacactcccgagccgtaggttcaggttcggactaggtcgggtagtggggaaccaaggttccttcaccttcgtccaactacgtcatcgacgccctagggacgccgtaggtaacgtacttggttgacgttagtttaacttacgtagtaacctaacgtacgttacccggtaaccggtacggttcccgggacccgggttccggggtacccttacggttcccggggacccgttacggggaacccgtaagggtacggacgtaacttacgaaaacgtcgttggcgcgtaacgacctctacgtcgttcgttaacttcgtaaccc

SEQ ID NO: 419559 - DNA, 662 bp, Homo sapiens
  misc_feature: GZ8MTXP01ATOUN.8.33.C11.1.454.CMB.2.raw
  modified_base (329)..(329): a, c, t, g, unknown or other
  modified_base (616)..(616): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaacgtggtggagtcgtgggggagcgtagtccagccgtgggagtcacagagactctcctgtgcagcctctgggtcaccttcagtagctacggcatcgcacgtcgggtcccgaccaaactccgaggacaagggnttgggagtgggtgctagttgttcatccgtggaggctagtgttaacaagttgggtactcgcgtcggaccggtccggtaggaaacggggcccgtaacttaccaaccctacttacccgtacccgaagacgaaccaaacctacccgaaacggaaaccaacctaaagttaggttaagtttacggaacccttacgaaacctacggtaccctaaacggttcccgtaggaacggaccgtacgggtagtaactaacgttacgtaggttaaccgggaaaggggtacgggggaaccgngggacgggtaagtaccaagttactcgttcgaacggttcggtcgggg

SEQ ID NO: 419560 - DNA, 622 bp, Homo sapiens
  misc_feature: GZ8MTXP01ADD52.8.33.C11.1.454.CMB.2.raw
  modified_base (254)..(254): a, c, t, g, unknown or other
  modified_base (326)..(326): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctcctgngcacgcctacgtggttcaccttcagtagctacggcatgcacgtcgggtcccacaaactccgaggcgaagggnttggaggtgggtggctagtttgttcatccgtggagggctagtgttaacaagtggtatgctgacggccgtaggaacgggccgtattccacctactcctaccgagacgactaaccaccgaggaaacacaagtacggttacttcggacctagaacacgtacgtaacgtcctaggacgacgtacgggtgtaactaacgttacgtaggttaaacggaaagggggaacggggaaccgacgggcgggtaacgttaccgaaacggttcgttcccgttaggtaaccggttccggtaacccggggg

SEQ ID NO: 419561 - DNA, 558 bp, Homo sapiens
  misc_feature: GZ8MTXP01A7YO2.8.33.C11.1.454.CMB.2.raw
  modified_base (421)..(421): a, c, t, g, unknown or other
  modified_base (532)..(532): a, c, t, g, unknown or other
  modified_base (540)..(540): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccaccctgtctttgtctccgaaggggaaagacgccaccctctcctgcagggccagtcagatgtgcgtcttgaagctgtacaacacaacctggcaggctcccaggcccctcatctatggcgcatccaaacgacgggccacgtgggaccaacgtccccgagcccgtaggttcaggtcggcaggtcggggtatcgggggaaacagtcttcactctacaccatcatcagctgagcctgaagtntagtgactagttatacgtgtacaacgtcttacgtacgagtcggcccggtccgggggtacctacgttccggccgtcgggaccgaagggtggagattacgaaacgacgttcgngactgacnccatcttgtcttgtaacc

SEQ ID NO: 419562 - DNA, 579 bp, Homo sapiens
  misc_feature: GZ8MTXP01EZH1T.8.33.C11.1.454.CMB.2.raw
  modified_base (327)..(327): a, c, t, g, unknown or other
  modified_base (423)..(423): a, c, t, g, unknown or other
  modified_base (527)..(527): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggagcgtagtccagccgtgggagtcacagagactctcctgtgcagcctctgggttcaccttcagtagctacggcatgcacgtgggtcccaccaaactccgaggcgaaagggnttgggaggtggggtggctagttgttcagtcctggaggctagtgttaacaagtggtatgctgacgcggtgaacggcgatcacatcacagagacaacncagaacacaatggttattagacctagaacacgacctaagtcctaggagacgtacgggtataatacgttacgtaggttaaacggaagggggaacgggggaaccgngggacgggtaagtaccgtaacgttactccgttagtaaccggttcggtcgggg

SEQ ID NO: 419563 - DNA, 752 bp, Homo sapiens
  misc_feature: GZ8MTXP01DMIX1.8.33.C11.1.454.CMB.2.raw
  modified_base (279)..(279): a, c, t, g, unknown or other
  modified_base (335)..(335): a, c, t, g, unknown or other
  modified_base (371)..(371): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagccgtgggaggtcacagagactctcctgcgcacgcctcgtggttccaccttnagtgctacggcatcgccacgtcgggtccccaccaaacctccgaaggacgaaggggnttgggaggttggggtggctaggtttgttcattccgngggaggtctagttgttaacgaagtgggtatggcttacggaccggtccggtagggaacggggtccgtacttaccaccgtacttacctaccgaacggtaacgaaacctaaacccgtaccgaaacggaaacctaaaccgtaaagttacggggtttaacgtttaccgggaaacccttaacggaaaccgtaacgtacccgttaaacggttacccgtaggtaacgggtaaccgtacggggttacgttaaactaacgttacggttaacgggttaaacggggaaacgggggaacggggggaaaccgcgggggttaccgggtaaccggttaaccgtaacggtttacccgtttaccggtttacgggtaaccggttcgggttaacccggggg

SEQ ID NO: 419564 - DNA, 556 bp, Homo sapiens
  misc_feature: GZ8MTXP01A3NMR.8.33.C11.1.454.CMB.2.raw
  modified_base (209)..(209): a, c, t, g, unknown or other
  modified_base (280)..(280): a, c, t, g, unknown or other
  modified_base (290)..(290): a, c, t, g, unknown or other
  modified_base (385)..(385): a, c, t, g, unknown or other
  modified_base (397)..(397): a, c, t, g, unknown or other
  modified_base (535)..(535): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanacgccaccctctcctgcagggccagtcagatgtgcgcttgaagctgacacacaactgcagctccagccctnatctatggtncatccaagtcgggccacgtggcatcccagccaggttcaggtcggcaggtggtatgggaacagtcttcactctacactatcatcagtcctgggacnccgtagaaagtnttggttcgacgttagtttattactagtacaactgtacgtacgaggtccggccgttccgggggcctacggttccggcccgtagggaccgtaagggtggaagtacgacgtaaacgtacgttggttcgcgtcgctaacgtntcgttacgttccttaacgtcc

SEQ ID NO: 419565 - DNA, 625 bp, Homo sapiens
  misc_feature: GZ8MTXP01A8X1X.8.33.C11.1.454.CMB.2.raw
  modified_base (209)..(209): a, c, t, g, unknown or other
  modified_base (291)..(291): a, c, t, g, unknown or other
  modified_base (301)..(301): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaanacgccaccctctcctgcagggccagtcagaatgttgctcttgtaagctgaccaacacaactggccaggcctccaggcccctnatctatggtnacactaccaacgacgggccacgtggaccctacgtccccagccgtaggttcacggtcggctaagggtgggtatacggggaacacggtcttcacttcacacctatcactcacgtccgtaggacgccgttaggaaacgtgttggttacgacgttaagtttatacgtacggtactaacgtagttaccgtaaccgtcggttccggtcccggttaccgggggtaccctaaccggtttcccgggacccgttcgggaaccgtaacgggtagttacgacgttacgaaacgtacgttggttcgcgtcgccaacgtctcttcgttcttctaaccg

SEQ ID NO: 419566 - DNA, 677 bp, Homo sapiens
  misc_feature: GZ8MTXP01BQVBE.8.33.C11.1.454.CMB.2.raw
  modified_base (374)..(374): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagaatgttggcgtccttcgtaagctggtaccaacacaaacctggccaggctccccaggccccctcatctatggtgcatccaacaggggccacgtggcactcccagccaggttcagtcggcaggtgggtatggggaacngtcttcactctcaccatcatcagtcccgtagggcggaccctaggaacgtagttggttacgacctttagtttaacttacttggtacctaacgttaacgtacccggtaccggtacgggttccggccccggttccccggggggtaccccttaccgggtttccccgggtccccggtacgggggaaccccggtaagggggttacgggaaacggtaaccgttaccggtaaaaacggtaaccgttcggggttcgggttaccgtcggacccgtaacccttacgttcgttcggtttccgtttaacttccccg

SEQ ID NO: 419567 - DNA, 605 bp, Homo sapiens
  misc_feature: GZ8MTXP01A2LZA.8.33.C11.1.454.CMB.2.raw
  modified_base (328)..(328): a, c, t, g, unknown or other
  modified_base (420)..(420): a, c, t, g, unknown or other
  modified_base (494)..(494): a, c, t, g, unknown or other
  modified_base (545)..(545): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtggggggaggcgtagtccagccgtgggagtcacagagactctcctgtgcagcctctgggttcaccttcagtagctacggcatgcacgtgggtcccaccaaactccgaggcaaggggtnttgggaggtgggggtggctaggtttgtttcatccgtggagggtcagtgttaacaagttggtatgctggacgcggtagacgggcatcacatcncagacgacaacacgagaacacatggtattaggacctagaacagcctaagtcctaggaacggtacgtacggggtntaactaacgttacgtacggttaacgggaaagggggtaacgggggaaaccgngggacggggtaacgttcccgtaacggttaccttcgtttcggaaccggttcggtccggggg

SEQ ID NO: 419568 - DNA, 628 bp, Homo sapiens
  misc_feature: GZ8MTXP01AFHEZ.8.33.C11.1.454.CMB.2.raw
  modified_base (206)..(206): a, c, t, g, unknown or other
  modified_base (248)..(248): a, c, t, g, unknown or other
  modified_base (269)..(269): a, c, t, g, unknown or other
  modified_base (278)..(278): a, c, t, g, unknown or other
  modified_base (287)..(287): a, c, t, g, unknown or other
  modified_base (382)..(382): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacctgtcttgtctccgagggaanacgccaccctctcctgcagggcagtcagatgtggctcttganctgtacacacaactgcaggcnccagccctnatctatggncatccaacgacggccacgtggccactccccgagcctaggttccaggtcgggaccagggtcggggtagtggggaaactaggtaacttcgaaccctntaccacctatcaactcacgtccgtgggacgtccgtaggaacgtagttgttcgtacttagtttacttacgtcgttacaacgtacgttcggaaccgtcggtaccggtcccggtccgggggtcctaccggtttcccggacccggtaggggaacccgtaaggggtcggaaacggtacttaccggaaaacggttacgttgggttcggttactaacggcctaaccgtgtccgttacgttccgttaactcccg

SEQ ID NO: 419569 - DNA, 751 bp, Homo sapiens
  misc_feature: GZ8MTXP01B3EON.8.33.C11.1.454.CMB.2.raw
  modified_base (266)..(266): a, c, t, g, unknown or other
  modified_base (283)..(283): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaagggaaagacgcccaccctctcctgcaggccagtcagatgtgctcttgagctagacacacaacngcagctcccacgccctnactctagtgtgaccactaccaaacgacgggccctaacgtcggccaacgtcccccgaaggtccccgtagggtttccgaaggtccgggacgtaggggttaggggtacgtacgggggaaacctaacgggtaaccctttaccgaccctttccgaaccctacccgtaacttacacttacccgacgtccccgttaggggaccgtaacccgttaggaaagttagttacggtttacggaccgtttaagtttaactttacgtacgttaactaaacgtaagttacccggtaaccggtcgggtacccggtccccgggtccccggggggtaccttacccgggttttcccgggacccgggtaaccgggggtaacccgtaaagggggttcggaaacggtacgttaaaccggtaaaacggtaacggttcggttacgggccctaacggtcctaacctcgtcgttacgtttccttaacgttcccg

SEQ ID NO: 419570 - DNA, 628 bp, Homo sapiens
  misc_feature: GZ8MTXP01BUJ39.8.33.C11.1.454.CMB.2.raw
  modified_base (277)..(277): a, c, t, g, unknown or other
  modified_base (335)..(335): a, c, t, g, unknown or other
  modified_base (420)..(420): a, c, t, g, unknown or other
  modified_base (423)..(423): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctcctgtcgcagcctcgtgggttcaccttnagtagctacggcatcgcacgtcggggtcccaccaaaacgtccgaaggcgaaaggggtnttgggaggtggggtggctaggtttgtttcagtccgtggaggggcaggtgttacaagtggtatgctgacgcgtgaacggcatcacntcncagacgacaactccgagaacacaatggttacttcgggacctagaaacagtacccgtaaagtcccgtaggaacggacgtacgggtagtaactaacgttacgagggttaaccggaaaggggacgggggaaaccgagggttaccggggtaacggttacccgaaacggttacccgttccggtttacggtccggttaaccggtccggggg

SEQ ID NO: 419571 - DNA, 629 bp, Homo sapiens
  misc_feature: GZ8MTXP01DUU1S.8.33.C11.1.454.CMB.2.raw
  modified_base (209)..(209): a, c, t, g, unknown or other
  modified_base (298)..(298): a, c, t, g, unknown or other
  modified_base (308)..(308): a, c, t, g, unknown or other
  modified_base (425)..(425): a, c, t, g, unknown or other
  modified_base (437)..(437): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgtttacacagtctccagccaccctgtctttgtctccgaggggaangccaccctctcctgcagggccagtcagaatgttggctccttgaagctggtaccaacacaaaccgtggccaggcctcccgaggccccctnatctatggtncatccaacgcggggccagtggaccactccccgagcccgtaggttccaggtcggacctagggttggggtatcggggacaacggtacttcactcctacaccatcatcacgtcctggacnccgtagaaagtnttgtgacttagtttatactgtacaagtcgttacgtaccggagtccggtcccgtccgggggccttaaccggtttccggccccgttagggaaaccctaagggtggtaacttacggtaaaccgaaacggtacgttgggcggttcttcggaacccaaccttcgttccgtcgttaccttccgttaacgtttcccccg

SEQ ID NO: 419572 - DNA, 547 bp, Homo sapiens
  misc_feature: GZ8MTXP01DG67L.8.33.C11.1.454.CMB.2.raw
  modified_base (300)..(300): a, c, t, g, unknown or other
  modified_base (320)..(320): a, c, t, g, unknown or other
  modified_base (465)..(465): a, c, t, g, unknown or other
  modified_base (471)..(471): a, c, t, g, unknown or other
  modified_base (507)..(507): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtagtccagcctgggagtcacagagactctcctgtgcagcctctgggtcaccttcagtagctacggcatgcactgggtcccnccaaactccaggcaaagggnttgggagtggggtggctagtttgttcattcccgtggaggggctaggtgttacaagttggtatgctgacgcgtgggaagggcgattcacatctcagacgacaactccagaacacaatgtattggactgacagcctagctgaggacncgggtntaatacttacgtgttacggaagggagggggaaccgnggacgggaagttacaagtctcttcgtaacgttcgtcgggg

SEQ ID NO: 419573 - DNA, 650 bp, Homo sapiens
  misc_feature: GZ8MTXP01C730W.8.33.C11.1.454.CMB.2.raw
  modified_base (426)..(426): a, c, t, g, unknown or other
  modified_base (514)..(514): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtggggagcgtagtccagcctgggagtcacagagactctcctgtgcagtcctcgtggttccaccttcagtacgctacggcatgccacgtcgggtcccgaccaaacgtccgagggcgaaaggggtcgtgggaggttgggggtgcgttagtttgttcagtccgtggagggctagttgtaacaagtggtatgcgtagacgcgtggaacggctatcacntctacagacgacaactcgaagaacacaagttggttaacttcggaactacgaactacgtacctacgtcctagaacggtacgtacgggtntaactaacgttacggttacggttaaacggggaaagggggaacgggggaaaccgttcggggttacggggtaaccgttaacccggtaacggtttaccgttacccggtttagggaaccgggttccgggtaaccgggggg

SEQ ID NO: 419574 - DNA, 778 bp, Homo sapiens
  misc_feature: GZ8MTXP01BQDP4.8.33.C11.1.454.CMB.2.raw
  modified_base (332)..(332): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctcctgtgcagcctcgtgggttcaccttcagtagctacggcatgccacgtcgggtccccaccaaactcccgaggaccgaaagggnttgggaggtgggggtggctaggtttgtttcatcccgtggagggctagttgttaacaaagttggtaatcggctggaccgccggtaggaacgggcccgtagttccaccgtactacctaccgaacgaacgaacctaaaccgtaccgaaacggaaacctaacgtaaacgtttaggggttaacgttttacggggaaaccccttaacgggaaaaccgtaacgtaccccgttaaaacggttaccccgttaagggaaccggggtaaccgtaaccgggggttagttaaacgttaacccggttaacggttacgggttaaaccgggggaaacgggggtaacggggggggaaaccccgttagggggttacccgggggtaacggtttaaccccggtaaacggtttaccccggttacccggtttaccgggtaacccgggtttaaccggggtcccgggggg

SEQ ID NO: 419575 - DNA, 624 bp, Homo sapiens
  misc_feature: GZ8MTXP01ERJ6I.8.33.C11.1.454.CMB.2.raw
  modified_base (301)..(301): a, c, t, g, unknown or other
  modified_base (333)..(333): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagcccaccctgttctttgtctccgaaggggaaagacgccaccctctcctgcagggccagtcagaatgttggcgtccttacgtaagtctaggtaccaaacacaaacctggccaggctcccgacngccctcatctatgtgcataccgaactaggccnacccctacggcactcccacgtaccacggttcgacgtagggtcggaggtggggtacgtagggactacgacttcactactacaccactacactcacgccgtcggagacgtaggtaagtagtgttagttactagtttagttactacgtacgtaacgtacgtacggtaccggtaacggtccgggttcccggtacccgggggttcccggtacccggttaccgggttacccggttacggggttaccggtaacgggtacgggtaacggtaacgtacgttaaacggtaacgttcgtcgg

SEQ ID NO: 419576 - DNA, 562 bp, Homo sapiens
  misc_feature: GZ8MTXP01C6P1U.8.33.C11.1.454.CMB.2.raw
  modified_base (206)..(206): a, c, t, g, unknown or other
  modified_base (243)..(243): a, c, t, g, unknown or other
  modified_base (271)..(271): a, c, t, g, unknown or other
  modified_base (291)..(291): a, c, t, g, unknown or other
  modified_base (416)..(416): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacctgtcttgtctccgagggaanagccacctctctgcaggccagtcagatgtgcgctganctgacacacaactgcagctccagccctnatctatggtgcatccaacgngggcccacgtggccactccccgagtccctaaggttccaggtcggctagggtcggggtaagtcggggaaacagtaaccttcaaccttcctaccaccatcaatcagccgtaggacgccttagaagtnttgttgcttaagtttattactgtacaaactgttacgaccgaggttcggcccgtccggggcctacgttccggccgtgggacctaagggtgaagacgttaacgaaacgtcgttaggttgctgaccaacgtatcttgtccttctaaccg

SEQ ID NO: 419577 - DNA, 684 bp, Homo sapiens
  misc_feature: GZ8MTXP01BY52G.8.33.C11.1.454.CMB.2.raw
  modified_base (293)..(293): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccacctgtctttgtctccgaaggggaaagacgccaccctctcctgcagggccagtcagaatgtgcgtcttgtaagctgtacaacacaaacctggccaggctcccgacgccctnatctatggtgacactccaagtacgggcctacgtggacctactccccagcccgaggttccaggtcggacgtaggtgggtactggggaaacagtcgttacacgtcctaccgaccatcactcacgtaccgtaggacgccgtagaacgtagttagttgtacgttaagtttaacgttaacgttacgttacggtaaacgtacgttaccggtaaccggtaacgggtccgggtacccgggttacccgggggtaccccgttaaccggtttcccgggtaccccggtaccggggtttttaacccggaaacggggttacgggaacggtaacgttaacgtaaaaccggtaacgttacggttcggacgtcgaccgtaacctacgtcttcgttccttcgtaacccg

SEQ ID NO: 419578 - DNA, 664 bp, Homo sapiens
  misc_feature: GZ8MTXP01DZVM1.8.33.C11.1.454.CMB.2.raw
  modified_base (570)..(570): a, c, t, g, unknown or other
  modified_base (614)..(614): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtggggagcgtagtccagccgtgggagtcacagagactctcctgtgcagccttcgtgggttccaaccttgagtagcgtacggcagtcgccacgtcggtacccaccaaacctccgagggacgtaaagggggtgttaggggacggttgggggtgcgttaggtttgttcagttcccgtggagggctagttgtaacaagttggtatcggtctaggccggccgtagggaacgggtccctagttaccaccgtactccgtaccgaaagtacgaaccaaccgtaccgaaacgaacaacctaaagttcggggttaattcgggaacctagaaacgacgtcctaaacgtcctaggacgtacgtacggttntaatacttacggtaggttaaacggaaagggggaacgggaaccgnggaccgggtaatccgtaagttccgtcgttacggtcggttcgtaacggggg

SEQ ID NO: 419579 - DNA, 673 bp, Homo sapiens
  misc_feature: GZ8MTXP01BPFKW.8.33.C11.1.454.CMB.2.raw
  modified_base (554)..(554): a, c, t, g, unknown or other
  modified_base (607)..(607): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaacgtggtggagtcgtgggggagcgtagtccagccgtgggagtcacagagactctcctgtgcagcctcgtgggttcaccttcgagtgctacggcatgcactgggtaccccaccaaacctccgaaggacgaagggatttgggaggttggggtgctagtttgttcatcgtggaggctagttgtaacaagtggtatgctggaccgtcgggtaggaacgggccgtattccgacctacgtcctacccgaagacgaaccaaccgtaccgaaacggtaaaccaacgtaaagttcgggttaacgtttacgggaacctaagtaaccacgtaccgtaacgttccgaggtaacggtacgtacgggttntaacgttaacgttacgtacggttaacgggaaacggggacgggggttaaaccgngggttaccggggtaacgttaccgtaacgttccgttccggttacgtccggttcgggttaacccgggg

SEQ ID NO: 419580 - DNA, 743 bp, Homo sapiens
  misc_feature: GZ8MTXP01A1HGB.8.33.C11.1.454.CMB.2.raw
  modified_base (340)..(340): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggagcgtagtccagccgtgggagtcacagagactctccgtgtgcagcctcgtggttcaccttcgagtacgctacggctagtcgccacgttcgggtccccaccaaactccgaggacgaaaggggtnttgggagttgggggtcggcttaggtttcgtttacagttacccgtgggaggggcctaaggttgtttaaacaagttggtatcgacgtcggaccgtcccggtagggaaacggggccctaagttccaacgtactaccgtaccgaagacgaaccaaaccgtaccgaaagaaaccaacgtaacgttagggttaaacgtttacggggaaccccttaagaaaccgtaccgacccgttaaacggtcccgtaggaaccgggtaccgtaacgggttacgtaaacgttaccgttaacggtaaacggttaaaccggggaaagggggtaaccgggggaaaccgttcggggaccgggtaacgttaccgtaacggttacctttacccggtttagtaaccgggttccggttaaccggggg

SEQ ID NO: 419581 - DNA, 522 bp, Homo sapiens
  misc_feature: GZ8MTXP01D4PLR.8.33.C11.1.454.CMB.2.raw
  modified_base (248)..(248): a, c, t, g, unknown or other
  modified_base (274)..(274): a, c, t, g, unknown or other
  modified_base (289)..(289): a, c, t, g, unknown or other
  modified_base (387)..(387): a, c, t, g, unknown or other
  modified_base (400)..(400): a, c, t, g, unknown or other
  modified_base (493)..(493): a, c, t, g, unknown or other
  modified_base (500)..(500): a, c, t, g, unknown or other
  modified_base (502)..(502): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagaatgttggcncttcgtaagctggaccaacacaaacngcagctccagccctnatctatggtgcatccaaacgagggccacgtggcaatcccagccaggtcagtgcagtgggtatggggaacagcttcactctcaccatcaatcagctcgngctgaagatgtgntagtttattaatgtcgaacatacgtacgagtggccgtccggggaccgtacgttcggtccgtcgggacgaaaggtaggagagttacaaacgaanagttggngngcaacactcttctcgttctc

SEQ ID NO: 419582 - DNA, 629 bp, Homo sapiens
  misc_feature: GZ8MTXP01ALICQ.8.33.C11.1.454.CMB.2.raw
  modified_base (276)..(276): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtagtccagccgtgggagtcacagagactctcctgtgcagcctctggtcaccttnagtagctacggcatgcacgtgggtcccaccaaacgtccgaggacaaggggtattgggaggtggggtggctaggtttgtttcagtccgtggagggtctagttgttaacaagtgggtatgggctcgacggtcgtaggaacgggccgattccacactccgtacgaacgacgaaccaacgtccgaaggtaacaacgtaagttacgggttagtttacggacctaggaaccacgtacctaacgtcgtagacggacgtacgggtgtaactagttacgtaggaacggaaaggggaacgggggacgacgggcgggtaacgtaccgtaacgtcctccgttaggtaaccgttcggtaaccgggg

SEQ ID NO: 419583 - DNA, 634 bp, Homo sapiens
  misc_feature: GZ8MTXP01ANUFT.8.33.C11.1.454.CMB.2.raw
  modified_base (209)..(209): a, c, t, g, unknown or other
  modified_base (250)..(250): a, c, t, g, unknown or other
  modified_base (265)..(265): a, c, t, g, unknown or other
  modified_base (282)..(282): a, c, t, g, unknown or other
  modified_base (301)..(301): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgctccgaggggaaangcccaccctctcctgcagggccagtcagatgtgctcttganctgaccaacacaacngcaggctcccagccctnatctatgtgcatccaaacngggccatggcatcccagcctaggttcagtcggctaggtgggtatgggaactagtcttcgactctccactactcaatcgagcctaggacgtaccgtaggaaggtattcggttcgtacgttaagttttacttacgttacgtaccgtaaacgtacgttaccggtaaaccggtcggtaccgggttcccggtacccggggggtacccttaccgggtttccccggggacccgttacgggggaacccgtaaaggggttcgggaacggtaacttaaccgaaaacgtacgttcgggttacggttcgtaaggctaaccgtactcgttacggtcttcgtaaccg

SEQ ID NO: 419584 - DNA, 620 bp, Homo sapiens
  misc_feature: GZ8MTXP01ATQ5W.8.33.C11.1.454.CMB.2.raw
  modified_base (325)..(325): a, c, t, g, unknown or other
  modified_base (353)..(353): a, c, t, g, unknown or other
  modified_base (401)..(401): a, c, t, g, unknown or other
  modified_base (547)..(547): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctcctgtgcagcctcgtgggttccaccttcagtagctacggcatgcacgtgggtcccaccaaactccgaggcaagggnttggagtgggtgctagttgttcatccgnggaggctagtgttacaagtggtatgctgacgcgtagacggtcatcacntctcagacgacaacgaccagaacactaagtcggtaagtttcggaacctagaaacctacgaccgtaaacgtccgtaggtaacgggacgtaaccgggtgtaactaaccgttacgtaggaaccgggaaagggggaacgggggaacccgnggggaccggggtaacgttaccccggtaagttaaccgttccggtttacggaaccggtttcgggtaacccggggg

SEQ ID NO: 419585 - DNA, 786 bp, Homo sapiens
  misc_feature: GZ8MTXP01EIG0U.8.33.C11.1.454.CMB.2.raw
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaacgtggtggagtcgtgggggagcgtagtccagccgtgggagtcacagagactctctgtgcagcctcgtggttcacttcagtagctacggcatcgcacgtcgggtcccaccaaactccgaggacgaagggtgttggggaggttgggggtggtcttaggtttcgtttacagttccgtagggaggtcgtaggttgttaaacgaaagttgggttaagtcggtcgttagggaacccgggtccggtaggggaaacgggtcccgtactttaccaaccgtactaccgtaccaaacggtaacgaaacctaaacccgtaccgaaaacggtaaaccaaacttaagtttacggggttaacgtttacgggtaaacccgtaacggtaaaccgtaacgttaaccccgttaaacggttacccgtaagggtaacgggtaaaccggttaacgggggttaattaaaccgttaacgttaacggttaacggggttaaacggggaaacgggggtaaacgggggaacccgttacggggacggggttaaccgttaacggtaacgtttaccggttaccggtttaggtaacccgggtttcgggtaacccggggg

SEQ ID NO: 419586 - DNA, 597 bp, Homo sapiens
  misc_feature: GZ8MTXP01CB089.8.33.C11.1.454.CMB.2.raw
  modified_base (361)..(361): a, c, t, g, unknown or other
  modified_base (376)..(376): a, c, t, g, unknown or other
  modified_base (502)..(502): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaacgtggtggagtcgtgggggagcgtagtccagcgtgggagtcacagagacttctcctgtgcagcctcgtgggttcaccttcacgtagcctacggcatgcacgtcgggtcccaccaaactccgaggtacaagggagttggagtgggtgctagttgttcattcgnggaggctagtgtaanaagtcggtatgactgaccgccgtagaacgggccaattcgactatccacagacgacaacgcagaaacataaagtgtaacgttggacctacgaaccagtccctaaagttcccagtaaggactacgggnttaataccgttagtacgaacggaaacggggaacgggaccgagttaccggggaattaccgaacggttactacttcgggaaccgttcggtaaccggg

SEQ ID NO: 419587 - DNA, 687 bp, Homo sapiens
  misc_feature: GZ8MTXP01CJDKQ.8.33.C11.1.454.CMB.2.raw
  modified_base (280)..(280): a, c, t, g, unknown or other
  modified_base (346)..(346): a, c, t, g, unknown or other
  modified_base (568)..(568): a, c, t, g, unknown or other
  modified_base (623)..(623): a, c, t, g, unknown or other
  modified_base (636)..(636): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggagcgtagtccagccgtgggagtcacgagagctctcctgtgcagcctcgtcgggttccaccttnagtacgctacggcagtcgccacgttcgggtaccccaccctaaacgtccgagggaccgaaaggggtnttgggaggtggggtggcttaggtttgttcagtccgtggagggtctagttcgttaacaagtggtatggcgtggaccggccggtaggaacgggtccctagttccaccgattaccaccgaagacgaacctaaccgaccgaaacgaaactacgtaagttgggttaacgtttacggaacctaggaaacacgtacctaaacgtccgtaggaacggtaccgtacggttntaacgttacgttaccggtaggttaaaccggggaaagggggacggggttaacccgngggaaccggggtnttaacccgtaagttcccgttacgttacggtaaccggttcggtaacccgggg

SEQ ID NO: 419588 - DNA, 541 bp, Homo sapiens
  misc_feature: GZ8MTXP01DD7J3.8.33.C11.1.454.CMB.2.raw
  modified_base (322)..(322): a, c, t, g, unknown or other
  modified_base (351)..(351): a, c, t, g, unknown or other
  modified_base (409)..(409): a, c, t, g, unknown or other
  modified_base (416)..(416): a, c, t, g, unknown or other
  modified_base (432)..(432): a, c, t, g, unknown or other
  modified_base (454)..(454): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggaggtcacagagactctcctgtgcagcctctgggttcaccttcagtagctacggcatgcactgggtcccaccaaactccaggcaagggnttggagtgggtgctagttgttcattccgnggagggcagtgttacaatggtatgctgacgcgtgaggcatcacatctcagacgacacncagacanatgtattgacctgacngcaagtctgacggacacgggtntaatacgttacgtagttacggaaacgggagggggaaccgttcggacgggaacgttacgtaacgtactccgttagtcgttcgtcgggg

SEQ ID NO: 419589 - DNA, 574 bp, Homo sapiens
  misc_feature: GZ8MTXP01CGEX7.8.33.C11.1.454.CMB.2.raw
  modified_base (207)..(207): a, c, t, g, unknown or other
  modified_base (295)..(295): a, c, t, g, unknown or other
  modified_base (305)..(305): a, c, t, g, unknown or other
  modified_base (314)..(314): a, c, t, g, unknown or other
  modified_base (396)..(396): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgtttacacagtctccagccaccctgtctttgtctccaggggaanagccaccctctcctgcagggccagtcagaatgttggcgccttcgtaagctggtaccaacacaaacctggccaggctcccaggcccctnatctatggtncatccaacngggccactggcatcccagccaggttcagtggcaggtggtatggggacaagacttcactctcaccatcatcagccctgggacncctagaagtattggttgctagtttatactgtactaacgagttcgtaccgagtcggcccgtccgggggcctcgttccgggcccgtaggggacccaaggggtcggaagttagtaccgaaaacggtacgttggagggttcttcggcaccgaattcgtcgttacctttccgaactttccccg

SEQ ID NO: 419590 - DNA, 623 bp, Homo sapiens
  misc_feature: GZ8MTXP01DZX9P.8.33.C11.1.454.CMB.2.raw
  modified_base (248)..(248): a, c, t, g, unknown or other
  modified_base (331)..(331): a, c, t, g, unknown or other
  modified_base (347)..(347): a, c, t, g, unknown or other
  modified_base (538)..(538): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtagtccagccgtgggagtcacaganactctcctgtgcagcctcgtggttcaccttcagtagctacggcatgcacgtgggacccaccaaactccgaggacgaaggggtnttgggaggttgggggnggtctaggtttgtttcagttccgtaggaggggtctaggttgttaacaaagttgggtatcgcgtggaaccggcgtgggaacggccgtattccgacatctccaagacgaacaactcaaacgaacaacgtaattacgggttaattacgggaacctacgaaactcgacctaacgtacgtggaacgacgtacggtntaagtacttagtacgttaacggaaagggacggggaacgttggacggtaacgtaccgtaagtacgtcgttgtcggttcgtccgggg

SEQ ID NO: 419591 - DNA, 643 bp, Homo sapiens
  misc_feature: GZ8MTXP01AYNTP.8.33.C11.1.454.CMB.2.raw
  modified_base (207)..(207): a, c, t, g, unknown or other
  modified_base (281)..(281): a, c, t, g, unknown or other
  modified_base (292)..(292): a, c, t, g, unknown or other
  modified_base (382)..(382): a, c, t, g, unknown or other
  modified_base (402)..(402): a, c, t, g, unknown or other
  modified_base (416)..(416): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccacctgtctttgtctccgagggaaancgccaccctctcctgcagggccagtcagatgtgctcttgagctgacaacacaactggccaggctccacgccctnatctagtggcnctactccaagtacgggccacgtcggacacgtcccgagccgtaggttcaggtcggcgaggtggatgggaaacacgtctcactcacacctanctaatcagtccgtagggacnccgtagaaacgttnttgttacgtacgttaagtttaactacgttacgtaactaacgtacgtaccggtaaccggtacggtcccgggtccccggtaccggggtcccgttaccgggttcccggacccggtagggtaacccggtaaagggtcggaaaccgtaaacgttaaaccggaaaccggtacgttgggttccgacctaacgtacctaaccgtcttcgttaccgttaacccgttaacctaaccg

SEQ ID NO: 419592 - DNA, 754 bp, Homo sapiens
  misc_feature: GZ8MTXP01AG36S.8.33.C11.1.454.CMB.2.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccaccctgtctttgtctccgaaggggaaagacgcccaccctctcctgcgagggccagtcagaatgtggcgtccttagaagctgtaaccaacacaaccgtggaccacggcctcccgacggcccctacatcctagtcggtcgccactaccgaaacgacggggacctaacgtcggaccctaccgtaccccgacggtacccgtaacggggttcacggggttacggggcgtaacgggggtttggggtaacgttcgggggaaacctacgtaaccgtttccaacccttactacccaacctactcgtaactcgaacgtcccgtagggacgtccgtaaggaaagtattggttacgtacttaaggttttaacttacttcggtaaccgtaaacgttacgttaccggtaaccggtaggtcccgggtcccggtaccgggggtacccttaaccgggttttcccgggaccccggttacgggaacccggtaagggtcgggaacgaaccgttacggaaaaccgtcgttcgggttaccggttcgtaacggacctaaccgtcgttcttacggttaaccttccttaacccgg

SEQ ID NO: 419593 - DNA, 763 bp, Homo sapiens
  misc_feature: GZ8MTXP01DW34I.8.33.C11.1.454.CMB.2.raw
  modified_base (162)..(162): a, c, t, g, unknown or other
  modified_base (179)..(179): a, c, t, g, unknown or other
  modified_base (283)..(283): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttccncgttgcttcttttaagnggtgtccagtgtcaagtgcaacgtgggtggagtcgtgggggagcgtagtccagccgtgggagtcacagacgactctcctgtgctagcctcgtggttccaccttnagtagctacggcagtcgactacgtcgggtacccacccaaacgtccgaggacgaaaggggtcttgggaggttgggcgtctagtttggttacagttccgtggagggtctagttgttaacgaagttcgggtatcggcgtacggaccgggtccgggtagggtaaaccgggtcccgtatttacccgaacccgtacttaccgtaccgaaacggaaccgtaaacctaaaccgtacccgaaaacggtaaaccctaaataaacgtttagggttaaacgttacgggaaacccgttagaaacccgtaacgtaccgtaaacgttccggtaacggaacggtaaccggtacggttaagtaaacttaaccgttaacggtaacgggttaaacggggaaaacggggaacgggggttaaacccgttaggggacccgggttaacgttaacccgtaaggttacccgttacgtttacggtaaccggttcgggtaaccgggg

SEQ ID NO: 419594 - DNA, 625 bp, Homo sapiens
  misc_feature: GZ8MTXP01CJEJZ.8.33.C11.1.454.CMB.2.raw
  modified_base (281)..(281): a, c, t, g, unknown or other
  modified_base (338)..(338): a, c, t, g, unknown or other
  modified_base (353)..(353): a, c, t, g, unknown or other
  modified_base (538)..(538): a, c, t, g, unknown or other
  modified_base (578)..(578): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttggctgaacttgggttttcctcgttgcttcttttaagaggtgtccagtgtcaagtgcaacgtgggtggagtcgtgggggagcgtagtccagccgtgggagtcacagagactctcctgtcgcagcctcgtgggttcaccttnagtagctacggcatcgcacgtcggtcccgaccaaaccgtccgaggacgaaaggggtnttgggagttcggggnggtctaggtttgttcaagtccgtgggaggtctaggtgttaacgaattgggatcggcttgggacccgtccggtaggaacggccgtattccgacactactacgagtacgacaaccgtaccgaacgaacacgaattacggtacgttacggacctagaacacgtaccgtacgtacgtgaagcgtacggngtaatacccgttagtacgaacggtaagggacggggaccgnggcggtaacgtacgaacgttcgtcgttacgtaacgttcgtaaccggg

SEQ ID NO: 419595 - DNA, 753 bp, Homo sapiens
  misc_feature: GZ8MTXP01D5TER.8.33.C11.1.454.CMB.2.raw
  modified_base (332)..(332): a, c, t, g, unknown or other
  modified_base (344)..(344): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtagtccagccgtgggagtcacagagactctcctgtgcagcctcgtggttcaccttcagtagctacggcatcgcacgtcgggacccaccaaactccgaggcgaaagggtnttgggagtgggngtctagtttcgttacagttccgtaggagggtctaggtgttaacaagttgggtatcgctaggaccggtccgtagggaaacggtccgtaattccgaacctataccgtaccgaacgtaacgaacctaaaccgccgaaaacggtaaccaacttaagttaggggtttaacgtttacgggaaacccttagaaaccgtaaccgtacccgttaaacgttcccgaaggtaaccgggtaacccgtacggggttaagtaaacgttaaccggttaacgggttaacgggttaaaacccgggggtaaaggggggtaaaccggggggaaaccgttacgggggttaccggggttaacgttacccggtaaacggtttccggttaccccggttttagggaacccgggttttcgggtaaccccggggg

SEQ ID NO: 419596 - DNA, 726 bp, Homo sapiens
  misc_feature: GZ8MTXP01B3X33.8.33.C11.1.454.CMB.2.raw
  modified_base (179)..(179): a, c, t, g, unknown or other
  modified_base (261)..(261): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgcttcttttaagnggtgtccagtgtcaagtgcaacgtgggtggagtcgtgggggagcgtagtccagccgtgggagtcacagagactctcctgtcncacgcctcgttcgggttcaccttcgagtagctacggcagtcgcacgttgggaccccgaccaaacgtccgaaggcgaaaggggtgttgggagtgggggtcggcttagtttgtttcagttccgtggagggctagttgttaacaagttgggtactcggcgttcggacggtcccgggttagggaaaccgggtccgtattaccgaaccgtatccgtacccgaaggaacgtaacccaacgtaccgaaagggaacctaaacgtaaactttacggggtttaacgttttaccgggaaacccgtttacggaaacccgttacggtaacccgttaacggttacccgttaggaacgggtaacgtacggggttgttaaacgttaacgttaacggttacggttaacgggaaacggggtacgggggaacgcgggttacggtaacgtaccgaagttctccgttgtaacgttcggtaaccggg

SEQ ID NO: 419597 - DNA, 736 bp, Homo sapiens
  misc_feature: GZ8MTXP01AWYRM.8.33.C11.1.454.CMB.2.raw
  modified_base (206)..(206): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacctgtctttgctccgagggaancgccaccctctcctgcagggccagtcagatgtggctccttgagctacggacaacacaacgtggccaggcctcccgacggccccctagactccgtagtcgggtcacctaactcccgaaacggacggggtcccaacgtcgggacctaccgtcccgaacgtcccgtaagggtttccgagggttccgggactagggggttgggggtaacgtcgggggaaacctaacgggtaacctttccaaccttccctaccaacctactactactaccgtaacggtccccgttaaggggaccgtaaccgtaggtaaacgtgtttgttacggcttaagttttaactacgttacgacgtaaacgttacgttacccgggacggtacgggttcccgggacccggttcccgggggtacctaccgggtttcccgggacccgggtacgggtaaccgtaaaggggtcgttaaacgtacgttaaaccgaaacggtacggttcggttcggacgtccgaccgtaactcggttccttaggttcccttcgtaaccg

SEQ ID NO: 419598 - DNA, 749 bp, Homo sapiens
  misc_feature: GZ8MTXP01BAMNK.8.33.C11.1.454.CMB.2.raw
  modified_base (177)..(177): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagnggtgtccagtgtcaagtgcaactggtggagtcgtgggggagcgtagtccagccgtggggagtcacagagactctcctgtgcagcctcgtgggttccaccttcagtagcctacggcagtgccacgtcggggtaccccaccaaaaccgtccgaagggcgaaaggggtgttggggagttcgggggtagctaggtttcgtttcagttcccgtaggacggggtctagggttcttaacgaaagttgggtactcggtcgttacgggacggtcccggtagggaaacggggtccctattacccgacctacgttccacccgaagaacgaacctaaactacccgaaacggaaacctagtaacgttaggggttaacgtttacgggaaccttacggaaaccctaacggtaaccgttaacggtacccgtaagggacggtaaccggtaacgggttacgtaaactaccgttaacggtacggttaaggtaacgggggaaaggggaacgggggaccgttacggggtaacggggttaccgttaacccgtaacggttacccgtttaccggttcggttaacccggttccgggg

SEQ ID NO: 419599 - DNA, 550 bp, Homo sapiens
  misc_feature: GZ8MTXP01BFWHW.8.33.C11.1.454.CMB.2.raw
  modified_base (275)..(275): a, c, t, g, unknown or other
  modified_base (289)..(289): a, c, t, g, unknown or other
  modified_base (293)..(294): a, c, t, g, unknown or other
  modified_base (296)..(296): a, c, t, g, unknown or other
  modified_base (299)..(299): a, c, t, g, unknown or other
  modified_base (304)..(304): a, c, t, g, unknown or other
  modified_base (310)..(310): a, c, t, g, unknown or other
  modified_base (313)..(314): a, c, t, g, unknown or other
  modified_base (319)..(319): a, c, t, g, unknown or other
  modified_base (330)..(330): a, c, t, g, unknown or other
  modified_base (359)..(359): a, c, t, g, unknown or other
  modified_base (381)..(381): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacctgtcttgtctccgaagggaaagacgccaccctctcctgcgacgggccagtcaagaatgttggcgtccttcgaagctggacaacacaacngcagctccagcccnatcnngncancaagnggcagngcnnccgancagtcagcgcnggtggtatggaacagtctcactcacactncatcagcctggactctagaagnttagttcgactagtttactactgtacaatacgtcgtacgagtccggccggtaccggggcctacgttccggacccgtcggggaacgaacggggttggaagacttaaccggaaacgtagttcgggcgacgtaacgccgtaaccctaagttcgttcgttaactttcgtaacc

SEQ ID NO: 419600 - DNA, 682 bp, Homo sapiens
  misc_feature: GZ8MTXP01EPS7U.8.33.C11.1.454.CMB.2.raw
  modified_base (179)..(179): a, c, t, g, unknown or other
  modified_base (628)..(628): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgcttcttttaagnggtgtccagtgtcaagtgacaacgtggtggagtcgtgggggagcgtagtccagccgtgggagtcacagagctctctgtgcagcctcgtggttccaccttgagtacgctacggcagtcgccacgtcggtacccgaacccaaactccgaaggacgaaagggtgtttcgggagttggggtcgaccttagttcgtttcgagttccgtagggagggtctaaggttcgttaacgaaagttgggttaatcgggtaccgtacggacccggtccgggttagggaaacccgggtccctaagttccaacgtacttccgacgaagacgaactaaccaccgaagaacaactaagtacggttacgtttacggacctaggaacctacggacctagtacccgtagaacggtacgtagggtactaactaacgttacgtaggaacgggaacggggaacgggaaccgngggacggtaacgtacgtaacgttccgttacgttacgccggttaacggtccgggg

SEQ ID NO: 419601 - DNA, 707 bp, Homo sapiens
  misc_feature: GZ8MTXP01EJ27T.8.33.C11.1.454.CMB.2.raw
  modified_base (447)..(447): a, c, t, g, unknown or other
  modified_base (497)..(497): a, c, t, g, unknown or other
  modified_base (671)..(671): a, c, t, g, unknown or other
  modified_base (688)..(688): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgagggaaagcgccaccctctcctgcagggccagtacagtaatgttggcgtccttggtagctcggtacaaacacaaacctggccaggcctcccacggccccctgatcctaagtggttcgctaacaccccgaaacgcggggcccaacgtcgggaccaacttccccgagacccgtagggtttcccaaaggttccggaccgtaggggtagggtacgtacgggggtaaccaggttaaccctttcaccgtacnccactaactcaaccgttacacggtccctggggacaccgtaggaaacggtnttaggtttacgacgttacgttttaattacggttacgaaccgtaactacgtttccggtacccggtaacgttcccgggacccgggtcccggggtaccgtaccggtttcccgggccccgtacgggtaaccgaagggttcacgggaacttaacggaaaaccgtaagttcggttaccgngtaacgccgtaaccgtntcttacgttccttctaacg

SEQ ID NO: 419602 - DNA, 507 bp, Homo sapiens
  misc_feature: GZ8MTXP02HUANG.8.33.C11.1.454.CMB.2.raw
  modified_base (250)..(250): a, c, t, g, unknown or other
  modified_base (257)..(257): a, c, t, g, unknown or other
  modified_base (263)..(263): a, c, t, g, unknown or other
  modified_base (269)..(269): a, c, t, g, unknown or other
  modified_base (278)..(278): a, c, t, g, unknown or other
  modified_base (288)..(288): a, c, t, g, unknown or other
  modified_base (340)..(340): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagatgtgcgcttganctgacanacaacngcagcnccagccctnatctatggtncatccaacaggccactggcatcccagccaggtcagtgcagtggtatgggacngcttcactctcaccatcatcagcctgagcctagaagatgttgctagttattactgtacaacattcgtaccgagtcggcccgtccgggggcctacgtttccggccctggggacccaaggtcggagactacgaaaacggactgtggactgcaccatcgtgtctttacac

SEQ ID NO: 419603 - DNA, 675 bp, Homo sapiens
  misc_feature: GZ8MTXP02JNMCW.8.33.C11.1.454.CMB.2.raw
  modified_base (208)..(208): a, c, t, g, unknown or other
  modified_base (298)..(298): a, c, t, g, unknown or other
  modified_base (310)..(310): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgctccaggggaaanagccaccctctcctgcagggccagtcagaatgttggcgcttcgtaagctggtaccaacacaaacctggccaggcctcccaggccccctanatctagtggtcncactaccaacgacggccacgtcggaccacgtcccagccgtaggttcaggtcggacgtaggtgggtagtcgggacagtacttcactccaccaactactacatacgacgtcccgtaggacgtaccgtaagaaacgtcgttaggttacgtacttaaagttttacttacgtgtaaacctaaacgtacgttacccggtaaccggtacggtccgggtcccgggtacccgggggtaccttaccggtttcccgggacccggtaacggggaaccgtaaacggggtcggaaacgtaacgtaaaccggaaaacgttacgtacggtcggtacgtaacggaccctaacgtacgttaccgttcgtttaccttactaccg

SEQ ID NO: 419604 - DNA, 539 bp, Homo sapiens
  misc_feature: GZ8MTXP02GT8S8.8.33.C11.1.454.CMB.2.raw
  modified_base (297)..(297): a, c, t, g, unknown or other
  modified_base (307)..(307): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttgtaagctggtaccaacacaaacctggccaggcctcccaggcccctnatctatggtncatccaacaggggccacgtggcatcccagccaggttcagtcggcagtgggtatggggacaggcttcactctcaccatcatcagcctggacgcctgaagtatgttgctagtttattactgtacaactatcgtacgagtcggccgtccgggggcctacgtttccggcccgtgggaccgaagggtggagacgtacgaaacgtacgtggcgcgtgccaactctcgtcttcttactc

SEQ ID NO: 419605 - DNA, 515 bp, Homo sapiens
  misc_feature: GZ8MTXP02GX5ER.8.33.C11.1.454.CMB.2.raw
  modified_base (297)..(297): a, c, t, g, unknown or other
  modified_base (307)..(307): a, c, t, g, unknown or other
  modified_base (316)..(316): a, c, t, g, unknown or other
  modified_base (391)..(391): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgtttacacagtctccagccaccctgtctttgtctccaggggaaagagccaccctctcctgcagggccagtcagaatgttggcgccttcgtaagctggtaccaacacaaacctggccaggctcccaggcccctnatctatggtncatccaacngggccactggcatcccagccaggtcagtgccagtggtatgggacagacttcactctcaccatcatcagcctggancctgaagatgtgctagtttatactgtcaatatcgtacgagtcggccgtccgggggcctacgtttcggcccgtgggaccaaggtcggagatacaaacgactgtcgctgcacatctgtctcactcc

SEQ ID NO: 419606 - DNA, 549 bp, Homo sapiens
  misc_feature: GZ8MTXP02IZKVP.8.33.C11.1.454.CMB.2.raw
  modified_base (289)..(289): a, c, t, g, unknown or other
  modified_base (299)..(299): a, c, t, g, unknown or other
  modified_base (309)..(309): a, c, t, g, unknown or other
tcagctcgcgtgtccacgaccggtgctcgatttagagtgagctcgttggggtttgggggaggaactgctcagttaggacccagagggaaccatggaagccccagctcagcttctcttcctcctgctactctggctcccagttttcagataccaccggagagattgtgttgacacagtctccagccaccctgtcttgtctccaggggaagagccacctctcctgccagggccagtcagaatgttggcgccttgaagctggtacaacacaaactgccagctccagcccctnatctatggtncatccaacgnggccagtggcatcccagcctaggtacagtggcagtgggtactgggacagcttcgaactctcaccgatcgatcagcctggacgcctagaagtctgtagactagttattactgtacaactgtccgtacgagtcggccgtcggggctacgttcggccgtagggaccgtaagggttgagtactacgaaacggtacgtaggtcgtacgtgacctaacgtacttcctggtttcctttacgttaccg

SEQ ID NO: 419607 - DNA, 684 bp, Homo sapiens
  misc_feature: GZ8MTXP02H8E8Z.8.33.C11.1.454.CMB.2.raw
  modified_base (210)..(210): a, c, t, g, unknown or other
  modified_base (294)..(294): a, c, t, g, unknown or other
  modified_base (305)..(305): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgcctttgtctccagggggaaanagccaccctctcctgcagggccagtcagaatgttggcgcttgtagctggtaccaacacaactggccaggctcccaggccccctnatctagtggcncactacccaacgacggccacgtggaccactcccgagccgtaggttcaggtcggacgtagggtggtagtgggacacgtaccttcactcctaccaaccatcactcacgccgtggacgtccgtagtaagtagtagttacgtacgttagtttaacttacgttacgtaactaacgtacgttaccggtaacggtacggttccgggtcccgggttacccgggggtacccgttacccgggtttacccgggacccggttaaccgggggtaaacccggtaacggggtacgggtaacgtaaacgtaaaccggaaaaccggtaacgttacggtacggtaccgtaacgtaccgtaaccgtacgttaccgtttacgttacctttaccgtaccg

SEQ ID NO: 419608 - DNA, 527 bp, Homo sapiens
  misc_feature: GZ8MTXP02F2M6A.8.33.C11.1.454.CMB.2.raw
  modified_base (209)..(209): a, c, t, g, unknown or other
  modified_base (246)..(246): a, c, t, g, unknown or other
  modified_base (291)..(291): a, c, t, g, unknown or other
  modified_base (301)..(301): a, c, t, g, unknown or other
  modified_base (401)..(401): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagatgttggcnccttgtaagctggtacaacacaactgccaggctcccaggcccctnatctatggtncatccaacaggggccactggcactccccgagccaggttcagtcggcagtgggtatggggacagtccttcactctcaccatcatcagcctgagctagaagntgtgctagtttattactgtacaactactcgtaaccggagtcggcccgtccgggggcctacgttccggcccgtgggacctagggtgagacgtacaaacgtactgtggctgccacatcctgtctctac

SEQ ID NO: 419609 - DNA, 586 bp, Homo sapiens
  misc_feature: GZ8MTXP02JQYFZ.8.33.C11.1.454.CMB.2.raw
  modified_base (210)..(210): a, c, t, g, unknown or other
  modified_base (246)..(246): a, c, t, g, unknown or other
  modified_base (253)..(253): a, c, t, g, unknown or other
  modified_base (259)..(259): a, c, t, g, unknown or other
  modified_base (265)..(265): a, c, t, g, unknown or other
  modified_base (271)..(271): a, c, t, g, unknown or other
  modified_base (280)..(280): a, c, t, g, unknown or other
  modified_base (289)..(289): a, c, t, g, unknown or other
  modified_base (339)..(339): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctctaaggggaaanagcccaccctctcctgcagggccagtcagatgtgcncttgagntgacanacaacngcagcnccagccctnatctatggncatccaacaggccactggcactcccagccaggtcagtcggcagtgggtangggacagtcttcactctacacatcatcagtcctggacgcctagaagtagtgttagacttagtttacttaacgttgtactaactagttaccggtaccgaggtccggtcccggtcccgggggtacccttaccggtttcccgggccccggttacggggaacccggtaaggggttcgggaaacgtacgtaaaccgtaaaacggtacgtaggtcggacgtaacgacctaacgtcttcgtacgttctactccg

SEQ ID NO: 419610 - DNA, 520 bp, Homo sapiens
  misc_feature: GZ8MTXP02GWHZ3.8.33.C11.1.454.CMB.2.raw
  modified_base (209)..(209): a, c, t, g, unknown or other
  modified_base (245)..(245): a, c, t, g, unknown or other
  modified_base (259)..(259): a, c, t, g, unknown or other
  modified_base (265)..(265): a, c, t, g, unknown or other
  modified_base (282)..(282): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagatgttgcncttgagctgtacanacaacnggcagctccagcccctnatctatggtgcatccaacagggccacgtggcactcccagccaggttcagtcggcagtgggtatggggacagcttcactctcaccatcatcagcctggacgcctagaagatgttgctagtttatactgtacactatcgtacgagtcggcgtccggggctacgttcggcccgtgggaccgaaggtcggagacgtacgaaacgtaacgtggtacggctgcacctagtctcgtcttactacc

SEQ ID NO: 419611 - DNA, 610 bp, Homo sapiens
  misc_feature: GZ8MTXP02HG6W2.8.33.C11.1.454.CMB.2.raw
  modified_base (209)..(209): a, c, t, g, unknown or other
  modified_base (296)..(296): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttgcgcttcgtaagctggtaccaacacaaacctggccaggctcccaggccccctnatctatggtgcatcccaaacgaggggcccaacgtggccactcccagcccaaggttcagtcggcagtgggtatggggacagactttcaactctacaccatcatcagcctggacgcctagaagatgttgctagtttatactgtacaactatacgtaccgagtcggccgtccgggggacctaccgtttccgggcccgttacggggaacccgtaaggggttacgggagtaaacgtaacggaaaacccgtaaacgtacggttaggggaccttaacggacccgaacccgtacttaccttacggtttcctttacgtaaccc

SEQ ID NO: 419612 - DNA, 518 bp, Homo sapiens
  misc_feature: GZ8MTXP02IMLF4.8.33.C11.1.454.CMB.2.raw
  modified_base (287)..(287): a, c, t, g, unknown or other
  modified_base (296)..(296): a, c, t, g, unknown or other
  modified_base (385)..(385): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccagggggaaagagccaccctctcctgcagggccagtcagatgttgcgcttcgaagctggtacacacaactgccagctccaggcccctnatcatggtncatccaacaggccactggcatcccagccaggttcagtgcagtgggtatgggacagcttcactctcaccatcatcagcctgagctgaagntagttgctagtttattactgtacaactatcgtacgagtcggccgtccgggggcctacgtttcggcccgtgggacccgtaacggtggtagactacgaaacgtacgtagtgcgtgcaccatctagttcttactac

SEQ ID NO: 419613 - DNA, 535 bp, Homo sapiens
  misc_feature: GZ8MTXP02J3QWM.8.33.C11.1.454.CMB.2.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggcccaggcctccccaggccccctcatctatggtgcatccaaacagggccactggcatcccagccaggttcagtggcagtgggtatggggacagcttcactctcaccatcaatcagccctggagcctgaagatgttgctagtttattactgtacactatcgtaccgagtcggccgtccgggggccaccgtttcggcccgtggggaccgaaggtggagataccgaaacgaacgtgtggctgcaccactctcgtcttctac

SEQ ID NO: 419614 - DNA, 549 bp, Homo sapiens
  misc_feature: GZ8MTXP02JQK57.8.33.C11.1.454.CMB.2.raw
  modified_base (317)..(317): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggccccctcatctatggtgcatccaacngggccacgtggcatcccagccaggttcagtcgcagtggatggggacagcttcactctcaccatcatcagcctggacgcctgaagatgttgctagtttattactgtacaactatacgtaccgagtcggccgtccgggggcctacgtttccggcccgtgggaccgtagggtacggagacgtacgaaacgtacgtacgtcggactcggacacctacgtctacgtccttactaccg

SEQ ID NO: 419615 - DNA, 522 bp, Homo sapiens
  misc_feature: GZ8MTXP02HQB2V.8.33.C11.1.454.CMB.2.raw
  modified_base (211)..(211): a, c, t, g, unknown or other
  modified_base (248)..(248): a, c, t, g, unknown or other
  modified_base (293)..(293): a, c, t, g, unknown or other
  modified_base (303)..(303): a, c, t, g, unknown or other
  modified_base (311)..(311): a, c, t, g, unknown or other
  modified_base (385)..(385): a, c, t, g, unknown or other
  modified_base (393)..(393): a, c, t, g, unknown or other
  modified_base (409)..(409): a, c, t, g, unknown or other
  modified_base (425)..(425): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagngccaccctctcctgcagggccagtcagaatgttggcnccttgtagctggtacaacacaaactggccaggccccaggcccctnatctatggtncatccaanagggccatggcatcccagccagtcagtgcagtggtatgggacagacttcactctcaccatcatcagcctggacncagaagtntgtgatagttatactntacaatatacgtacgngtcgccgtccgggctacgttcggccgtaggacgaaggtcgagtactaacgaaacgtacgtgtacgctacgaacctacacttctgttctactactccg

SEQ ID NO: 419616 - DNA, 532 bp, Homo sapiens
  misc_feature: GZ8MTXP02H26WL.8.33.C11.1.454.CMB.2.raw
  modified_base (210)..(210): a, c, t, g, unknown or other
  modified_base (294)..(294): a, c, t, g, unknown or other
  modified_base (391)..(391): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagcccaccctgtctttgtctccagggggaaanagccaccctctcctgcagggccagtcagaatgttgcgcttgaagctggtaccaacacaaacctggccaggctcccaggcccctnatctatggtgcatccaatagggccatggcatccccagccaggtcagtcgcaggtgggtatgggacagcttcactctacaccatcatcagcctggacncctgaaagatgttgctagtttattactgtacaactatcgtacgagtcggcccgtccgggggcctacgtttccggcccgtgggacccgaagggtggacgtactacgaaaacgacgtgtggctgcaacactctcgtcttacac

SEQ ID NO: 419617 - DNA, 547 bp, Homo sapiens
  misc_feature: GZ8MTXP02JHDEK.8.33.C11.1.454.CMB.2.raw
  modified_base (209)..(209): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcgcttgtaagctggtaccaacacaaacctggccaggcctcccaggccccctcatctatggtgcatccaaacagggccactggcatcccagccaggttcagtcggcagtggtatggggacagcttcactctcaccatcatcagccctggagcctagaagatgttgctagtttattactgtacaactattcgtaccgagtcgggaccgtccgggggacctacgtttccggacccgttcggggaccctaagggtcggagacgtacgaaacgtacgtaggtcggactcgcacatcgtcgtctctac

SEQ ID NO: 419618 - DNA, 549 bp, Homo sapiens
  misc_feature: GZ8MTXP02FSQON.8.33.C11.1.454.CMB.2.raw
  modified_base (299)..(299): a, c, t, g, unknown or other
  modified_base (309)..(309): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggcctcccaggccccctnatctatggtncatcccaaacagggccacgtggccactccccagccaggttcagtcggcaggtgggtatggggacagcttcactctcacctatccatcagcctggacgcctagaagattgttgactagtttattactgtacaactagttaccgtaccggagtcggccgtccgggggcctacgttccggcccgtcgggaccgaggtggagactacgaaacgacgtcgtgctgacacactctacgtcttctac

SEQ ID NO: 419619 - DNA, 550 bp, Homo sapiens
  misc_feature: GZ8MTXP02H9XWO.8.33.C11.1.454.CMB.2.raw
  modified_base (207)..(207): a, c, t, g, unknown or other
  modified_base (286)..(286): a, c, t, g, unknown or other
  modified_base (390)..(390): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctccagtttcagataccaccggagagattgtgttgacacagtctccagccacctgtctttgtctccaggggaaanagccaccctctcctgcagggccagtcagatgtgcgcttgaagctggtaccaacacaactggccaggctcccagcccctnatctatggtgcatccaaacgagggccaacgtggcatccccagcccaggttcagtcggcaggtgggatggggacagcttcactcacaccatcatcacgctggacnccgtagaagagttgttgcttagtttattactgtacaactactcgtacgagtcggccgtccgggggccctacgtttccggaccgtacggggaccgtaagggtcggagtacgtaacgaaacgtacgtgtcgcgtaagccaccacttcgtcgttcttactacg

SEQ ID NO: 419620 - DNA, 501 bp, Homo sapiens
  misc_feature: GZ8MTXP02JUQYE.8.33.C11.1.454.CMB.2.raw
  modified_base (209)..(209): a, c, t, g, unknown or other
  modified_base (243)..(243): a, c, t, g, unknown or other
  modified_base (249)..(249): a, c, t, g, unknown or other
  modified_base (256)..(256): a, c, t, g, unknown or other
  modified_base (262)..(262): a, c, t, g, unknown or other
  modified_base (268)..(268): a, c, t, g, unknown or other
  modified_base (277)..(277): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcaggccagtcagatgtgcncttganctgacanacaacngcagcnccagccctnatctatggtgcatccaacagggccacgtggcactcccagccaggttcagtcggcagtgggtatgggacagcttcactctcacatcatcagcctggagcctagagatgtgctagtttattactgtacaactatcgtacgagtcggccgtccgggggctacgttcggccgtgggaccaggtagagactacgaaacgactagtggctgccacactctcgtcttctac

SEQ ID NO: 419621 - DNA, 600 bp, Homo sapiens
  misc_feature: GZ8MTXP02FP2A7.8.33.C11.1.454.CMB.2.raw
  modified_base (429)..(429): a, c, t, g, unknown or other
  modified_base (570)..(570): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagaatgttggcgtccttgtaagctggtaccaacacaaacctggccaggcctcccacggcccctcactctatggtgcactcccgaaacgaggggcccacgtcggccactccccaggcctaggttcaggtcggactaggtggggtatggggaacaggtacttcactctaccaacctatccaatcacgcctggacnccgtagaagattgttgctaagtttattactgtacaactataccgtacggagtccggtaccggtccgggggcctacggttccggacccgtcgggaacccgtaagggtcggagtacgtacgaaaacgtaacgtggtcggtacncgaccactacgtctacgttccttactaccg

SEQ ID NO: 419622 - DNA, 545 bp, Homo sapiens
  misc_feature: GZ8MTXP02H0W4Y.8.33.C11.1.454.CMB.2.raw
  modified_base (244)..(244): a, c, t, g, unknown or other
  modified_base (250)..(250): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagatgtgcncttganctgtacaacacaactgccagctcccagccctcatctatggtgcatccaacagggccactggcatccccagccaggtcagtggcagtgggatgggacagcttcactcctcaccatcatcagccctggagcctgaaagatgttgctagtttattactgtactaactatcgtaccggagtcggccgtccgggggtccacgtttccggcccgtgggacccgtaaagggtcggaagacgtacgaaaacgtaacgtaggtcggtccgtggccgaaccgtactccgttcgttcctttcaccg

SEQ ID NO: 419623 - DNA, 526 bp, Homo sapiens
  misc_feature: GZ8MTXP02GKLCX.8.33.C11.1.454.CMB.2.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggccccctcatctatggtgcatccaaacagggccaactggcatccccagccaggttcagtggcagtggggtatggggacagacttcactctcaccatcatcagcctggagcctgaagatgttgcagtttattactgtcaacatcgtaccgagtggccgtccgggggcctacgttcggccctgggacccaaggttcggagatacaaacgaactagtggctgcaccatctgtcttctac

SEQ ID NO: 419624 - DNA, 711 bp, Homo sapiens
  misc_feature: GZ8MTXP02IOLKU.8.33.C11.1.454.CMB.2.raw
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccacctctcctgcagggccagtcagaatgttgcgccttgaagctggtacaacacaaacctggccaggctcccaggcccctcatctatggtgcatccaaatacgggccacgtggccactccccagccccgtaggttcaggtcggactagggttgggtagtgggacagtcttcactctaccacctatcactcacgcccgtagggacgccgtagaaagtagttggttgacgttagtttactttaacgttgttaaccaaacgttacgttacccggttaaccgggtaaccggttccggggtaccccgggttcccggggggtaccctttaacccggggttttccccggggtaccccggggttaccgggggaaaccccggttaaacgggggtacggggtaaacggtaaaccggttaaaccggaaaaaccgggtaaccgttacgggtcgggtaccgttcgggacccgtaacctacggtttactttacggtttcccgtttaccttacccg

SEQ ID NO: 419625 - DNA, 534 bp, Homo sapiens
  misc_feature: GZ8MTXP02JNOWY.8.33.C11.1.454.CMB.2.raw
  modified_base (293)..(293): a, c, t, g, unknown or other
  modified_base (303)..(303): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagatgttgcgcttgtaagctggtaccaacacaaacctggccaggctcccaggccccctnatctatggtncatccaatacgggccactggcatcccagccaggttcagtcggcaggtgggtatggggacagcttcactctcaccatcatcagccctggagccctagaagtatgttgctagtttattacgtgttagaactattcgtaccgagtcggccgtccgggggctacgttcggcccgtgggacctaaggtggagactacgaaacgtactggtgactgcaccgatcgtcgtcttctacc

SEQ ID NO: 419626 - DNA, 513 bp, Homo sapiens
  misc_feature: GZ8MTXP02GNFEA.8.33.C11.1.454.CMB.2.raw
  modified_base (281)..(281): a, c, t, g, unknown or other
  modified_base (292)..(292): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttgtaagctggtacaacacaaactgccaggcncccagcccctnatctatggtgcatccaacagggccactggcatcccagccaggttcagtggcagtgggtatgggacagacttcaactctcaccatcatcagcctggagcctgaagatgttgcagtttattaactgtcaaacatcgtaccgagtggcctcgggggccacttcgccgtcggaccgaaggtggaggatacaaaacgaactagtgctgcacactactctctactac

SEQ ID NO: 419627 - DNA, 618 bp, Homo sapiens
  misc_feature: GZ8MTXP02JOZ03.8.33.C11.1.454.CMB.2.raw
  modified_base (299)..(299): a, c, t, g, unknown or other
  modified_base (309)..(309): a, c, t, g, unknown or other
  modified_base (320)..(320): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagaatgttggcgcttcgtaagctggtaccaacacaaacctggccaggcctcccacggcccctnatctatggtncatccaaacgngggccacgtggcactcccagccaggttcagtcggcaggtgggtatggggacaggtcttcactctcaccatcatcacgcccgtggacgccgtagaagtagtaggttgtactagttttaacttactgttacaaacgtagttaccggtaccggtaggtcgggtcccggtcccgggggtccctacggtttcccgggcccgtacggggaacccgtaaaggggtcggaacggtaacgtacgaaaaccggtacgtacgggtacggcgtaacgccgaacccgtactccgttcgttccgttacgtac

SEQ ID NO: 419628 - DNA, 539 bp, Homo sapiens
  misc_feature: GZ8MTXP02JMHMU.8.33.C11.1.454.CMB.2.raw
  modified_base (295)..(295): a, c, t, g, unknown or other
  modified_base (305)..(305): a, c, t, g, unknown or other
  modified_base (402)..(402): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagatgttggcgccttgtaagctggtaccaacacaaacctggccaggctcccaggccccctnatctatggtncatccaatagggccactggcatcccagccaggttcagtcggcaggtgggtatggggacagcttcactcacacatcatcagccctggacgcctagaanatgttgctagtttattactgtacaactatacgtacgagtcggtccgtccgggggcctacgttccggcccgtcgggaaccgaagggtcggagacgtacgaaacgactacgtcggactgcacactctacgtctactacc

SEQ ID NO: 419629 - DNA, 520 bp, Homo sapiens
  misc_feature: GZ8MTXP02HZ7ZC.8.33.C11.1.454.CMB.2.raw
  modified_base (365)..(365): a, c, t, g, unknown or other
  modified_base (385)..(385): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtagtccagcctgggaggtcacagagactctcctgtgcagccctctgggttcaccttcagtagctacggcatgcactgggtcccgccaaactccaggcaagggattggagtgggtgcagttgtcatctgaggcagtgtcaatggtangctgacgcgtgaggcgatcncatctcagagacaactccagaacacaatgtatttgacctagaacagcctaagtcctgaggacacgggtagtactactactagtacgaaggacgggggaacagcgggaagtcgagtactcgttcgacgttcgcggg

SEQ ID NO: 419630 - DNA, 531 bp, Homo sapiens
  misc_feature: GZ8MTXP02GJCPC.8.33.C11.1.454.CMB.2.raw
  modified_base (245)..(245): a, c, t, g, unknown or other
  modified_base (258)..(258): a, c, t, g, unknown or other
  modified_base (264)..(264): a, c, t, g, unknown or other
  modified_base (279)..(279): a, c, t, g, unknown or other
  modified_base (289)..(289): a, c, t, g, unknown or other
  modified_base (504)..(504): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagatgtggcncttgagctgacanacaacngcagctccagccctnatctatggtncatcccaacgacgggccacgtggcactcccagccaggttcaggtcgcagtgggtatggggacagcttcactctacacctatccatcagccgtggacgcctagaagagttgttgctagtttattactgtacaatatcgtacgagtcggccgtcggggcctacgttcggccgtcgggaccgtaaggtcggagtacgacgaaacgtaccgtgacgcgngtccacgtactcgtcgtcttactaccg

SEQ ID NO: 419631 - DNA, 536 bp, Homo sapiens
  misc_feature: GZ8MTXP02GUMEW.8.33.C11.1.454.CMB.2.raw
  modified_base (428)..(428): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctccccaggccccctcatctatggtgcatccaacagggccactggcatcccagccaggttcagtcggcagtgggtatggggacagtcttcactctcaccatcatcagccctggacgcctgaagatgttgctagtttattactgtanaactatcgtaccgagtcggccgccgggggccacgtttcggcccgtgggaccgaaggtcggagacgtacaaaacgaacgtgtggcctggccaccatctcgtcttactac

SEQ ID NO: 419632 - DNA, 692 bp, Homo sapiens
  misc_feature: GZ8MTXP02H99MQ.8.33.C11.1.454.CMB.2.raw
  modified_base (207)..(207): a, c, t, g, unknown or other
  modified_base (298)..(298): a, c, t, g, unknown or other
  modified_base (310)..(310): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctccagtttcagataccaccggagagattgtgttgacacagtctccagccacctgtctttgtctccaggggaaanagccaccctctcctgcagggccagtcagaatgttggcgcttcgtaagctggtaccaacacaaacctggccaggcctccccaggccccctanatctagtggtcncactacccaaacgagggccaacgtcggacactcccgagccgtaaggttcaggtcggcgaggtagggtaggtaggacgacgtactactactacctacctacctactactactaccacgaccgtacggacgtaccgtacgtaagtaagttacggttacgtacgttacgtttaacgtttaacgttacgttacgtaaactaacgtacgttaaccggtacggtacgggtaccgggtacccggggtacccggtaccggtttaccgggtacccggtaccggggtaaccggtaaacgggtacgggtacggtaacgtaaacgtaaaacgtaaacgtacggtacggtacgtaacgtacgtaccgtacgtacgttacgttacgtttacgtacg

SEQ ID NO: 419633 - DNA, 573 bp, Homo sapiens
  misc_feature: GZ8MTXP02HH7HF.8.33.C11.1.454.CMB.2.raw
  modified_base (299)..(299): a, c, t, g, unknown or other
  modified_base (309)..(309): a, c, t, g, unknown or other
  modified_base (408)..(408): a, c, t, g, unknown or other
  modified_base (418)..(418): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggcctcccaggccccctnatctatggtncatcccaaacaggggcccaacgtggccatccccagcccaggttcagtcggcagtgggtatggggacagcttcactctcaccatcatcagccctgggacncctagaagtntgtgtattagtttatactgtacactacgtacgtacgaggtccggcccggtccgggccttacggttccggccggtacgggaacgtacgggtacggaacgtacgtaacgaaacgtacgtcggtacgacgtcgacacgtcgtcgtcgttccttactcg

SEQ ID NO: 419634 - DNA, 499 bp, Homo sapiens
  misc_feature: GZ8MTXP02F3TP9.8.33.C11.1.454.CMB.2.raw
  modified_base (244)..(244): a, c, t, g, unknown or other
  modified_base (249)..(249): a, c, t, g, unknown or other
  modified_base (278)..(278): a, c, t, g, unknown or other
  modified_base (374)..(374): a, c, t, g, unknown or other
  modified_base (382)..(382): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagatgtgcnctganctgacacacaactgcagctccagcccctnatctatggtgcatccaacagggccactggcatcccagccaggttcagtggcagtgggtatggggacagcttcactctcaccatcatcagcctggancctgaagntgtgctagtttattactgtacaacatcgtaccgagtcggccgtcgggggcctacgttcggcccgtgggaccaaggtggagatacgaaacgacgtgtggctgcaccatctgtctctac

SEQ ID NO: 419635 - DNA, 540 bp, Homo sapiens
  misc_feature: GZ8MTXP02GN1WM.8.33.C11.1.454.CMB.2.raw
  modified_base (322)..(322): a, c, t, g, unknown or other
  modified_base (369)..(369): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtagtccagcctgggaggtcacagagactctcctgtgcagcctctgggttcaccttcagtagctacggcatgcactgggtcccgccaaactccaggcaaggggnttggagtgggtgcagttgttcatcctgaggcagtgttacaatggtangctgacgcgtgaagggcattcacatctccagagacaactccagaacacaatgtatttgacctagaacagacctaagtcctagaggacgacgggtatactactactgtaacgaaagggacgggggaaaccgaggacggaagtcgaacgtactccgttagacgtcgtacgggg

SEQ ID NO: 419636 - DNA, 548 bp, Homo sapiens
  misc_feature: GZ8MTXP02GD2YO.8.33.C11.1.454.CMB.2.raw
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgaagctggtaccaacacaaacctggccaggcctcccaggcccctcatctatggtgcatccaagtacgggccacgtggcatccccagcccaggttcagtcggcaggtgggtatggggaccagcttcactctcaccatcatcagcctggacgccgtagaagatgttgctagtttattactgtacaactatacgtaccgagtcggtcccgtccgggggcctacgtttccggcccgtgggaccgaaggtcggagactacgaaacgacgtagtcggctgcgacctatcgtcgtacttcgtac

SEQ ID NO: 419637 - DNA, 517 bp, Homo sapiens
  misc_feature: GZ8MTXP02FZG2V.8.33.C11.1.454.CMB.2.raw
  modified_base (209)..(209): a, c, t, g, unknown or other
  modified_base (245)..(245): a, c, t, g, unknown or other
  modified_base (267)..(267): a, c, t, g, unknown or other
  modified_base (273)..(273): a, c, t, g, unknown or other
  modified_base (282)..(282): a, c, t, g, unknown or other
  modified_base (383)..(383): a, c, t, g, unknown or other
  modified_base (391)..(391): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgtgcncttgaagctgtacaacacaacngcagcnccagccctnatctatggtgcatccaaacacgggccacgtggcactcccagccaggttcagtcggcaggtggtatgggacagtctcactctcaccatcatcagcctggacnctagaagntgttgctagtttattacgtgtacaactatcgtacgagtcggccgtccgggggctacgttcggccgtcgggaacaggtgagactacgaaacgacgtgtcggctcgcacgactcgtacgtcttactac

SEQ ID NO: 419638 - DNA, 523 bp, Homo sapiens
  misc_feature: GZ8MTXP02GCFY8.8.33.C11.1.454.CMB.2.raw
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaaacctggccaggctccccaggcccctcatctatggtgcatccaacagggccactggcatcccagccaggttcagtggcagtgggtatggggacagcttcactctcaccatcatcagcctggagcctgaagatgttgctagtttattactgtcaacatcgtaccgagtcggccgtccgggggctacgtttcggccctgggaccaaggtggagactacaaaacgactagtggctgcaccatcctgtccttctac

SEQ ID NO: 419639 - DNA, 559 bp, Homo sapiens
  misc_feature: GZ8MTXP02F0IK9.8.33.C11.1.454.CMB.2.raw
  modified_base (210)..(210): a, c, t, g, unknown or other
  modified_base (259)..(259): a, c, t, g, unknown or other
  modified_base (265)..(265): a, c, t, g, unknown or other
  modified_base (279)..(279): a, c, t, g, unknown or other
  modified_base (287)..(287): a, c, t, g, unknown or other
  modified_base (295)..(295): a, c, t, g, unknown or other
  modified_base (380)..(380): a, c, t, g, unknown or other
  modified_base (387)..(387): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagccaccctctcctgcagggccagtcagatgtgcgcttgagctgacaanacaacngcagctccagcccnatcatgtncatccaanggccactggcatcccagccaggtcaggtcggacaggtgggtatggggaactaggacttcactctacaccatcatcagcctggacnctgaagnttgtgactagtttattactgtacaactacgttcgtaaccgagttccggcccggtaccgggggacctacgtttccgggacccgttagggggaaccctaaaggggtcggaagtacgtaacgtaaaacgaccgttaggcggacttggaccacctattcgtacgttccttacgtac

SEQ ID NO: 419640 - DNA, 577 bp, Homo sapiens
  misc_feature: GZ8MTXP02JTGWH.8.33.C11.1.454.CMB.2.raw
  modified_base (307)..(307): a, c, t, g, unknown or other
  modified_base (328)..(328): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtagtccagccgtgggaggtcacagagactctcctgtgcagcctcgtgggttcaccttcagtagctacggcatgcacgtgggtcccnccaaactccgaggcgaagggnttgggagtggggtgctagtttgttcatccgtgagggcagtgtacaatgggtatgcgtgaccgcgtaggacgggccgattcaccatcctaccagacgaaccaactaccgagaacacaatagtattcggacctagaaacacgtacctaagtccgtaggacggaacgtacgggtagtactactagtacggtaacggaacgggacgggggaacgaggacggaacgtacgaacgtactcgtcgacgtcgtcggg

SEQ ID NO: 419641 - DNA, 546 bp, Homo sapiens
  misc_feature: GZ8MTXP02HEOQ9.8.33.C11.1.454.CMB.2.raw
  modified_base (245)..(245): a, c, t, g, unknown or other
  modified_base (251)..(251): a, c, t, g, unknown or other
  modified_base (264)..(264): a, c, t, g, unknown or other
  modified_base (280)..(280): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagatgtgcncttganctgacacacaacngcagctccagcccctnatctatggtgcactccaacgagggccacgtggcactcccagccaggttcagtcggacaggtggtatcggggacaggtaccttcactcctacacctatcatcacgccctggacgccgtagaacgtatgttagacttagtttattactgttacaactagtcgtacgagtcggccgtcggggcctacgtttccggccgtgggacctaagggtcgagtacgtacgaaacgacgtcgtcggactgaccaccgtactctcgttcttctaccg

SEQ ID NO: 419642 - DNA, 525 bp, Homo sapiens
  misc_feature: GZ8MTXP02JWKVR.8.33.C11.1.454.CMB.2.raw
  modified_base (209)..(209): a, c, t, g, unknown or other
  modified_base (243)..(243): a, c, t, g, unknown or other
  modified_base (248)..(248): a, c, t, g, unknown or other
  modified_base (255)..(255): a, c, t, g, unknown or other
  modified_base (277)..(277): a, c, t, g, unknown or other
  modified_base (364)..(364): a, c, t, g, unknown or other
  modified_base (380)..(380): a, c, t, g, unknown or other
  modified_base (509)..(509): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcaggccagtcagatgtgcnctganctgacancaactgcagctccaggcccctnatctatggtgcatccaacagggccacgtggcactcccagccaggttcagtcggcaggtgggtatgggacagtaccttcactctcacntcactcagcctggacnccgtgaagtatgttcgactagtttattactgtacaactatcgtaccgagtcggccgtccgggggcctacgttccggccgtgggaccgtaggtcggagacgtacgaaacgacgtgtaggctgcgtaaccncgtactcgtctactac

SEQ ID NO: 419643 - DNA, 546 bp, Homo sapiens
  misc_feature: GZ8MTXP02JJ3YY.8.33.C11.1.454.CMB.2.raw
  modified_base (247)..(247): a, c, t, g, unknown or other
  modified_base (294)..(294): a, c, t, g, unknown or other
  modified_base (304)..(304): a, c, t, g, unknown or other
  modified_base (399)..(399): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcncttgaagctggtaccaacacaaacctggccaggctcccaggcccctnatctatggtncatcccaacaggggccacgtggcatccccagccaggttcaggtcggcaggtggtatggggacagtcttcacttctcaccatccatcagcctggancctgaagatgttgctagtttattactgtacaactatcgtacgagtcggccgtccgggggtcctacgtttccggcccgtgggaccgtaacgggtcggagacgtacgaaacgacgtcggtcggactcgcaccgactcgtcgtcttctac

SEQ ID NO: 419644 - DNA, 534 bp, Homo sapiens
  misc_feature: GZ8MTXP02HWVFC.8.33.C11.1.454.CMB.2.raw
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctccccaggccccctcatctatggtgcatccaatgggccactggcatcccagccaggttcagtggcagtggtatggggacagcttcactctcaccatcatcagcctggagcctgaacgattgttgactagtttattactgtacaactatcgtaccgagtcggccgtccgggggccacgtttcggcccgtgggaccgagggtggacgactacgaaacgacgtaggtgcgtggcaccgactctcgtctttacac

SEQ ID NO: 419645 - DNA, 552 bp, Homo sapiens
  misc_feature: GZ8MTXP02GS5V4.8.33.C11.1.454.CMB.2.raw
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggcctcccaggccccctcatctatggtgcatccaaatacgggccactggcactccccagccaggttcagtcggcaggtgggtatggggacagcttcactctcaccatcatcagcctggacgcctagaagatgttgactagtttattaactgtacaactatacgtacggagtcggcccgtccgggggcctaccgttccggcccgtagggacccgtaagggtcggagacgtacgaaacgacgtacgtcgctggacaccactctcgtcttactac

SEQ ID NO: 419646 - DNA, 565 bp, Homo sapiens
  misc_feature: GZ8MTXP02HYZQJ.8.33.C11.1.454.CMB.2.raw
  modified_base (211)..(211): a, c, t, g, unknown or other
  modified_base (246)..(246): a, c, t, g, unknown or other
  modified_base (265)..(265): a, c, t, g, unknown or other
  modified_base (271)..(271): a, c, t, g, unknown or other
  modified_base (279)..(279): a, c, t, g, unknown or other
  modified_base (287)..(287): a, c, t, g, unknown or other
  modified_base (295)..(295): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccaccctgtctttgtctccgaggggaaanagccaccctctcctgcagggccagtcagatgtgcncttgagctgacacacaacngcagcnccagcccnatcatggncatccaanggccacgtggcactcccagccaggttcagtcggcaggtgggtatgggacagtcttcactcctcaccatcatcacgccctgggacgcctagaaagtgttgttgacttagttttactacgttgtaccaactagtaccggtaaccggaggtcgggtcccggttccgggggtccctacgtttcccggcccgtacggggaccgaagggtcggaacgtactaccgaaaacgacgtaggtcggactcggaccaactcgttcgtcgttccttactccg

SEQ ID NO: 419647 - DNA, 556 bp, Homo sapiens
  misc_feature: GZ8MTXP02H20AH.8.33.C11.1.454.CMB.2.raw
  modified_base (378)..(378): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccaccctgtctttgtctccagggggaaagagccaccctctcctgcagggccagtcagaatgttgcgccttgaagctggtaccaacacaaacctggccaggcctcccaggcccctcatctatggtgcatccaacagggccactggcatcccagccaggtcagtgcagtgggtatggggacagcttcactcctcaccntcatcagcctgacgcctagaagatgttgctagtttattactgtactaactatacgtaccgagtcggcccgtccgggggtccacgtttccggcccgtcgggaccgaacgggtggagacgtacgaaaacgtaaccgtggtacggcgtaacgccaaccgtactccgttcgtctttactacg

SEQ ID NO: 419648 - DNA, 518 bp, Homo sapiens
  misc_feature: GZ8MTXP02F3FOX.8.33.C11.1.454.CMB.2.raw
  modified_base (209)..(209): a, c, t, g, unknown or other
  modified_base (245)..(245): a, c, t, g, unknown or other
  modified_base (257)..(258): a, c, t, g, unknown or other
  modified_base (262)..(262): a, c, t, g, unknown or other
  modified_base (268)..(268): a, c, t, g, unknown or other
  modified_base (270)..(270): a, c, t, g, unknown or other
  modified_base (275)..(279): a, c, t, g, unknown or other
  modified_base (281)..(283): a, c, t, g, unknown or other
  modified_base (286)..(286): a, c, t, g, unknown or other
  modified_base (289)..(290): a, c, t, g, unknown or other
  modified_base (292)..(293): a, c, t, g, unknown or other
  modified_base (297)..(297): a, c, t, g, unknown or other
  modified_base (299)..(299): a, c, t, g, unknown or other
  modified_base (307)..(308): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagatgttgcnctgagctgacannaacngcagcncngcccnnnnngnnncangcnngnnccancngtcagtgnngtggatggacagcttcacttcacaccatcatcagccgtaggacgcctagaagtagttgtagtactaagtttattactagtacaactagtcgtacgagtcggccgtcggggtcctacgttccggccgtacgggacgtaggtcgagtaactacgaaaacggacgtaggtacggcgtaacgcctaaccgtacttcgttacgtccttacgtccg

SEQ ID NO: 419649 - DNA, 567 bp, Homo sapiens
  misc_feature: GZ8MTXP02G9UX2.8.33.C11.1.454.CMB.2.raw
  modified_base (208)..(208): a, c, t, g, unknown or other
  modified_base (288)..(288): a, c, t, g, unknown or other
  modified_base (376)..(376): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagatgttgcgcttgagctgtaccaacacaactggccaggctcccgaggcccctnatctatggtgcatccaagtacgggccacgtggcactcccagccaggttcagtcggacaggtgggtatgggacagcttcactctcaccntcatcagcctggacgcctagaagtagtgttgacttagtttattacgtgtacaactacgttcgtaccggagtcggcccgtccgggggtacctacggtttcccgggcccgtacggggacccgtaagggtcggacgacgtacgaaaacgtaccgtaggtcgacgtgaccaacctatcgtcgttccttactaccg

SEQ ID NO: 419650 - DNA, 577 bp, Homo sapiens
  misc_feature: GZ8MTXP02GCNM7.8.33.C11.1.454.CMB.2.raw
  modified_base (290)..(290): a, c, t, g, unknown or other
  modified_base (300)..(300): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagacgccaccctctcctgcagggccagtcagaatgttggcgccttgagctggaccaacacaactggcaggctcccagcccctnatctatggtncatccaaagtgggccacgtggcactcccagccaggttcaggtcgcaggtgggtatgggacagtcttcactctcaccatcatcagtccgtggacgccctagaaagtagttgttcgactaagtttattaccgtagtactaaacgtattaccgtaccggagtccgggtcccggtacccgggggtccctacggtttcccggcccgtacggggacccgtaagggtcggaacgtactacgaaaacgtacgtgtacgctaacgcacgactcgtcgtcttactac

SEQ ID NO: 419651 - DNA, 548 bp, Homo sapiens
  misc_feature: GZ8MTXP02IQETJ.8.33.C11.1.454.CMB.2.raw
  modified_base (297)..(297): a, c, t, g, unknown or other
  modified_base (307)..(307): a, c, t, g, unknown or other
  modified_base (396)..(396): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctnatctatggtncatccaacagggccactggcatccccagccaggttcagtcggcagtgggtatgggacagacttcactctcaccatcatcagcctggacncctgaagatgttgctagtttatactgtacaactatcgtaccgagtcggccgtcgggggcctacgtttccggcccgtacgggaccctaagggtcggagacgtacgaaaacgaacgtgtacggctcggacaccgacgtctcgttccttactacg

SEQ ID NO: 419652 - DNA, 526 bp, Homo sapiens
  misc_feature: GZ8MTXP02J2561.8.33.C11.1.454.CMB.2.raw
  modified_base (208)..(208): a, c, t, g, unknown or other
  modified_base (304)..(304): a, c, t, g, unknown or other
  modified_base (402)..(402): a, c, t, g, unknown or other
  modified_base (427)..(427): a, c, t, g, unknown or other
  modified_base (517)..(517): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcagggccagtcagaatgttggcgcttcgtaagctggtaccaacacaaacctggccaggctcccaggcccctcatctatggtncatcccaatacgggccaacgtggcatcccagccaggttcagtggcagtgggtatgggacagctcactctcaccatcatcagcctggacgcctagaagntgttgctagtttatactgtacaacntcgaccgagtgcccgttccgggggctacgttcggcccgtgggaccaacggtgagacgtacaaacggactttggacgctgccaccattcgntcttcaccg

SEQ ID NO: 419653 - DNA, 544 bp, Homo sapiens
  misc_feature: GZ8MTXP02GJ5VL.8.33.C11.1.454.CMB.2.raw
  modified_base (397)..(397): a, c, t, g, unknown or other
  modified_base (462)..(462): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtagtccagcctgggaggtcacagagactctcctgtgcagcctctgggtcaccttcagtagctacggcatgcacgtgggtcccgaccaaactccaggcaagggattggagtgggtggctagtttgttcatcctggagggcagtgtcaatggtatgctgacgcgtgaggcgatcacatcnccagagacaactcagaacacaatgtattgactagaacagacctaagtcctagaggacgacgggtntatactacgtacgtaacggaagggacgggggaaccaggacgggaagttaccgaacgtaccttacgttcgacgtcgtacgggg

SEQ ID NO: 419654 - DNA, 610 bp, Homo sapiens
  misc_feature: GZ8MTXP02GN561.8.33.C11.1.454.CMB.2.raw
  modified_base (209)..(209): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcgccttcgtaagctggtaccaacacaaacctggccaggctcccaggcccctcatctatggtgcatcccaaacgaggggcccaacgtcggacactccccaagccctagggttccaggtcggctaaggtggggtaatggggaccagccttcactctcaccatcatcagcctggacgcctagaagtagtgttgactagtttaattactgtacaactatacgtaccgtaggtacggcccgtccgggggcctaccgtttccggcccgttacggggaaccgtagggtacggtagtacgtaaccgaaacgtaacgtacggtcggtacgtaacggaccctaacctacgttaccgtcgttactttccgttaccg

SEQ ID NO: 419655 - DNA, 587 bp, Homo sapiens
  misc_feature: GZ8MTXP02JXRY4.8.33.C11.1.454.CMB.2.raw
  modified_base (209)..(209): a, c, t, g, unknown or other
  modified_base (308)..(308): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagtcaccctctcctgcagggccagtcagaatgttggcgccttcgtaagctggtaccaacacaaacctggccaggcctcccaggcccctcatctatggtncatccaacacgggccacgtggcactcccagcccaggtcagtggcagtgggtatgggacagcttcactctcaccatcatcagccctggacgcctagaagattgttagactagtttattactgtacaactatacgtacgagtcggcccgtccgggggacctacgtttccggacccgtcgggacccgtaagggtcggaaggtacgttaaccgaaaacggtaaccgtaggttacgggacctcggaccaaccgtacgttccttacggtttcctttacctaaccg

SEQ ID NO: 419656 - DNA, 546 bp, Homo sapiens
  misc_feature: GZ8MTXP02HGYJY.8.33.C11.1.454.CMB.2.raw
  modified_base (296)..(296): a, c, t, g, unknown or other
  modified_base (306)..(306): a, c, t, g, unknown or other
  modified_base (402)..(402): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttgtaagctggtaccaacacaaacctggccaggctcccaggcccctnatctatggtncatccaacagggccactggccatcccagccaggttcagtcggcagtgggtatgggacagcttcactctcaccatcatcagcctggacgcctagaanagtgttgctagtttattactgtacaactagtccgtacgagtcggcccgtccgggggcctacgtttccggcccgttggggacccgtaaagggtcggaagacgtacgaaaacgacgtgtcggctgcacgactcgtcgtcttactac

SEQ ID NO: 419657 - DNA, 541 bp, Homo sapiens
  misc_feature: GZ8MTXP02GO2CO.8.33.C11.1.454.CMB.2.raw
  modified_base (245)..(245): a, c, t, g, unknown or other
  modified_base (258)..(258): a, c, t, g, unknown or other
  modified_base (264)..(264): a, c, t, g, unknown or other
  modified_base (279)..(279): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagatgtgcncttgagctgacanacaacngcagctccagccctnatctatggtgcatccaagaggccactggcactcccagccaggtcagtcggcagtgggatgggacagcttcactctacaccatcatcagcctggacgctagaagtagtgtgacttagtttacttactgttacaactagtccggtacgtaggtcggcccgtcgggggaccctacgtttccggacccgtgggaaccgtaagggtcggaagtactacgaaacgtaacgtggtcgctcgaccacgtactcgtcgttccttactaccg

SEQ ID NO: 419658 - DNA, 545 bp, Homo sapiens
  misc_feature: GZ8MTXP02G2HLT.8.33.C11.1.454.CMB.2.raw
  modified_base (209)..(209): a, c, t, g, unknown or other
  modified_base (244)..(244): a, c, t, g, unknown or other
  modified_base (259)..(259): a, c, t, g, unknown or other
  modified_base (284)..(284): a, c, t, g, unknown or other
  modified_base (294)..(294): a, c, t, g, unknown or other
  modified_base (387)..(387): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccagggggaaanagccaccctctcctgcagggccagtcagatgtgcncttgagctgtacaanacaactgccagctcccaggcccctnatctatggtncatccaacagggccactggcatcccagccaggtcagtggcagtgggtatgggacagcttcactctcaccatcatcagcctggacgcctgaagntgtgctagtttattactgttacaactatcgtacgagtcggccgtccgggggtctacgtttccggcccgttcggggaaccgtaacgggtacggaagtacgtacgaaaacggtaaccgtaggtcggcgtggacctaccgacttcgtcgttaccttctacc

SEQ ID NO: 419659 - DNA, 551 bp, Homo sapiens
  misc_feature: GZ8MTXP02FWV97.8.33.C11.1.454.CMB.2.raw
  modified_base (304)..(304): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctcctgtgcagccctctgggttcaccttcagtagctacggcatgcacgtgggtcccnccaaactccaggcaagggattggagtgggtggctagttgtttcatcctgagggcagtgttcaatggtatgctgacgcgtgacggcattcacatctcagacgacaactaccagaacacaatgtattgacctagaacagcctaagctagagacgtacgggtgtaactactacgtaggtaacggaagggacgggggaaaccgaggacgggtaacgtaccgaacgtacttccgttagacggtcgtacgggg

SEQ ID NO: 419660 - DNA, 527 bp, Homo sapiens
  misc_feature: GZ8MTXP02GYWHM.8.33.C11.1.454.CMB.2.raw
  modified_base (208)..(208): a, c, t, g, unknown or other
  modified_base (243)..(243): a, c, t, g, unknown or other
  modified_base (248)..(248): a, c, t, g, unknown or other
  modified_base (254)..(254): a, c, t, g, unknown or other
  modified_base (260)..(260): a, c, t, g, unknown or other
  modified_base (266)..(266): a, c, t, g, unknown or other
  modified_base (275)..(275): a, c, t, g, unknown or other
  modified_base (281)..(281): a, c, t, g, unknown or other
  modified_base (284)..(284): a, c, t, g, unknown or other
  modified_base (292)..(292): a, c, t, g, unknown or other
  modified_base (354)..(354): a, c, t, g, unknown or other
  modified_base (384)..(384): a, c, t, g, unknown or other
  modified_base (424)..(424): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgctccaggggaaanagccaccctctcctgcagggccagtcagatgtgcnctgantgacanacaacngcagcnccagccctnatctanggncatccaanggccatggcactcccagccaggtcagtcggcaggtggtatggggacagcttcactctcaccntcatcagtccgtaggacgtcctagaaagtntgttgacgttagtttattactgtaccaatacgtcgtacgngtacggccgtccgggggcctacgttcggcccgtgggaccgaagggtcgagacgtacgaaacgtacgtgtgacgtcgacgaacgtctcgtcgtacttacgtacc

SEQ ID NO: 419661 - DNA, 566 bp, Homo sapiens
  misc_feature: GZ8MTXP02JXH7S.8.33.C11.1.454.CMB.2.raw
  modified_base (303)..(303): a, c, t, g, unknown or other
  modified_base (322)..(322): a, c, t, g, unknown or other
  modified_base (372)..(372): a, c, t, g, unknown or other
  modified_base (398)..(398): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtagtccagcctgggaggtcacagagactctcctgtgcagccctctgggttcaccttcagtagctacggcatgcacgtgggtccnccaaactccaggcaagggnttggagtggggtggctagttgttcatcctgagggcagtgttcaatggtangctgccgcgtagaggccatcacatcncagacacactccgagaacacatgtattgacctagaacacgacctaacgtccgtaggacggtacgacgggtataactactacgtacggtaaacggaagggggacggggaaccgaggacggggtaacgttaccgaacgtaccgttccgttacggaccgtcggtaccgggg

SEQ ID NO: 419662 - DNA, 558 bp, Homo sapiens
  misc_feature: GZ8MTXP02F1HW4.8.33.C11.1.454.CMB.2.raw
  modified_base (305)..(305): a, c, t, g, unknown or other
  modified_base (327)..(327): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtagtccagcctgggaggtcacagagactctcctgtgcagccctctgggttcaccttcagtagctacggcatgcactgggtcccnccaaactccgaggcaaaggggnttggagtggggtggctagttgttcatccgtgagggcagtgttacaatggtatgctgacgcgtgaaggcgatcacatctccagagacactcagacacaatgtattagacctagaacacgacctaagtcctagaggacgacgggtagtaactactacgtagtaacggaagggacgggggaaccgaggacgggaagtaccgaaagtaccgtacgtttacggacgtcgtacgggg

SEQ ID NO: 419663 - DNA, 567 bp, Homo sapiens
  misc_feature: GZ8MTXP02IJPUH.8.33.C11.1.454.CMB.2.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaagagccacctctcctgcagggccagtcagaatgttggcgcttgtaagctggtacaacacaaacctggccaggcctcccaggcccctcatctatggtgcatccaacgacgggccacgtggccactccccagccaggttcaggtcggcaggtgggtatggggacaggtacttcactctcacctatcatcagcctggacgcctagaagatgttgactagtttattacgtgtacaactagtcgtacgagtcggccggtccgggggtcctacgttccggaccgtacgggaccgtaagggtcggagtacgtaacgaaacgtacgtacggtcggacgtcgacctacctactcgtacgtccttactacg

SEQ ID NO: 419664 - DNA, 611 bp, Homo sapiens
  misc_feature: GZ8MTXP02H9DS4.8.33.C11.1.454.CMB.2.raw
  modified_base (211)..(211): a, c, t, g, unknown or other
  modified_base (246)..(246): a, c, t, g, unknown or other
  modified_base (252)..(252): a, c, t, g, unknown or other
  modified_base (260)..(260): a, c, t, g, unknown or other
  modified_base (265)..(265): a, c, t, g, unknown or other
  modified_base (282)..(283): a, c, t, g, unknown or other
  modified_base (285)..(285): a, c, t, g, unknown or other
  modified_base (287)..(287): a, c, t, g, unknown or other
  modified_base (289)..(289): a, c, t, g, unknown or other
  modified_base (292)..(292): a, c, t, g, unknown or other
  modified_base (299)..(299): a, c, t, g, unknown or other
  modified_base (306)..(306): a, c, t, g, unknown or other
  modified_base (311)..(311): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccaccctgtctttgtctccagggggaaanagccaccctctcctgcagggccagtcagatgtgcncttgantgtaccancaacngcagctcccagcccctnntntngncanccaacgnggccagngcacnccagccgtaggtcaggtcggctaggtgggtagtgggacagtccttacactcctaccacctatcatcacgccgtggacgtccgtagtaagtagttgttacgtacgttagtttacttacgttgtacctaacgtagtaccggtacggaggtccggcccggtcccgggggtacccgtaccggtttcccgggccccggtacggggaaccgtaaggggtacggtacgtaacgtaaccgaaaacggtaacgtcggtacggaccgtaacgacctaaccgtacgtcgttacgttacctttaccgtaccg

SEQ ID NO: 419665 - DNA, 548 bp, Homo sapiens
  misc_feature: GZ8MTXP02JU97T.8.33.C11.1.454.CMB.2.raw
  modified_base (301)..(301): a, c, t, g, unknown or other
  modified_base (318)..(318): a, c, t, g, unknown or other
  modified_base (353)..(353): a, c, t, g, unknown or other
  modified_base (390)..(390): a, c, t, g, unknown or other
  modified_base (395)..(395): a, c, t, g, unknown or other
  modified_base (400)..(400): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctcctgtgcagcctctgggttcaccttcagtagctacggcatgcactgggtccncaaactccaggcaaggnttggagtgggtgcagttgttcatcctgaggcagtntcaagtggtatgctgacgcgtgaacggcatcacatcncaganacacncagaacacatagtattgactgaacacgcctaagtcctagacgacgtacgggtagtacgtactacgtaggtaaaccggaaagggacgggggaaccagggacgggtaacgtaccgaagttactaccgtttacgtaccggtacgtcggggg

SEQ ID NO: 419666 - DNA, 534 bp, Homo sapiens
  misc_feature: GZ8MTXP02I8QD3.8.33.C11.1.454.CMB.2.raw
  modified_base (208)..(208): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagatgttggcgccttgaagctggtaccaacacaaacctggccaggctcccaggccccctcatctatggtgcatccaatagggccactggcatcccagccaggttcagtggcagtggtatggggacagcttcactctcaccatcatcagcctggagcctgaagatgttgctagtttattactgtacaactatcgtaccgagtcggccgtccgggggcctacgtttccggcccgtggggaccctaagggtcggagacgtacgaaaacgaacgtggtacggctggcacactctcgtcttctac

SEQ ID NO: 419667 - DNA, 529 bp, Homo sapiens
  misc_feature: GZ8MTXP02F3GS2.8.33.C11.1.454.CMB.2.raw
  modified_base (301)..(301): a, c, t, g, unknown or other
  modified_base (319)..(319): a, c, t, g, unknown or other
  modified_base (371)..(371): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtagtccagcctgggaggtcacagagactctcctgtgcagcctctgggttcaccttcagtagctacggcatgcactgggcccncaaactccaggcaagggnttggagtgggtgctagttgttcatcctgaggcagtgtcaatggatgctgacncgtgacggcgatcacatctcagagacactcagacacaatgtattgactagaacagactaatccgtgagacgacgggtgtactactacgaggtacggaacgggagggggaaccagggacggaagtaccgaagtaccgtaccgtttgaccgtcgtcgggg

SEQ ID NO: 419668 - DNA, 554 bp, Homo sapiens
  misc_feature: GZ8MTXP02GWUYD.8.33.C11.1.454.CMB.2.raw
  modified_base (210)..(210): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccaccctgtctttgtctccaggggaaanagcccaccctctcctgcagggccagtcagaatgttggcgccttcgtaagctggtaccaacacaaacctggccaggcctcccaggccccctcatctatggtgcatcccaacgacggggccactggccatccccagccaggttcaggtcggcaggtgggtatggggacagcttcactctcaccatcatcagccctggacgcctagaagattgttgctagtttattactgtacaactagtacgtaccgtagtcggcccgtccgggggcctacgttcggcccgtcgggaccgtagggtggagactacgaaacgacgtcggacgctgccaccgactctcgtcttactac

SEQ ID NO: 419669 - DNA, 550 bp, Homo sapiens
  misc_feature: GZ8MTXP02HNRUK.8.33.C11.1.454.CMB.2.raw
  modified_base (207)..(207): a, c, t, g, unknown or other
  modified_base (240)..(240): a, c, t, g, unknown or other
  modified_base (246)..(246): a, c, t, g, unknown or other
  modified_base (252)..(252): a, c, t, g, unknown or other
  modified_base (258)..(258): a, c, t, g, unknown or other
  modified_base (264)..(264): a, c, t, g, unknown or other
  modified_base (272)..(272): a, c, t, g, unknown or other
  modified_base (282)..(282): a, c, t, g, unknown or other
  modified_base (332)..(332): a, c, t, g, unknown or other
  modified_base (371)..(371): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccacctgtctttgctccgaggggaaangccacctctcctgcagggccagtcagatgtgcncttgantgacanacaacngcagcnccagcccnatctatggtnctatccaagtacggccagtggcatccagcctaggtcagtcgcagtggtanggacagcttcactctacactatcatcacgccgtaggacncgtagaaagtagtgttacgacgttagtttacttactgtactaacgtataccggtacgagtccggccggtaccgggggacttaaccgtttccgggacccgttacggggaaccgtaagggtacggacgaactacgaaaacgtacgtgtacgcgtcgccaactcgtcttcgtacttcgtacc

SEQ ID NO: 419670 - DNA, 601 bp, Homo sapiens
  misc_feature: GZ8MTXP02GRJ4S.8.33.C11.1.454.CMB.2.raw
  modified_base (208)..(208): a, c, t, g, unknown or other
  modified_base (244)..(244): a, c, t, g, unknown or other
  modified_base (266)..(266): a, c, t, g, unknown or other
  modified_base (281)..(281): a, c, t, g, unknown or other
  modified_base (291)..(291): a, c, t, g, unknown or other
  modified_base (300)..(300): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgctcgaggggaaanagccaccctctcctgcagggccagtcagaatgtgcnccttgaagctgacaacacaacngcagctccagccctnatctatggtncatccaacnggccacgtggcactcccagccaggttcagtcggcaggtgggtatggggacagcttcactctacaccatcatcagtccctggacgcctagaaagattaggttgacgttaagtttacttaacgttgtaacaaactacgtacgtaaccggtaggtaccggtcccggtacccgggggtcctaaccggtttccgggaccccgtagggggaaccctaaggggttacggaaacgtaacgtaacgaaaacggtacgtacggtcgggactaacggacctaacccgtaatccgttcgtcctttacgtaccg

SEQ ID NO: 419671 - DNA, 552 bp, Homo sapiens
  misc_feature: GZ8MTXP02JS056.8.33.C11.1.454.CMB.2.raw
  modified_base (209)..(209): a, c, t, g, unknown or other
  modified_base (384)..(384): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccagggggaaanagccaccctctcctgcagggccagtcagaatgttggcgcttcgtaagctggtaccaacacaaacctggccaggctcccaggcccctcatctatggtgcatccaatacggggccactggccatccccagccaggttccagtcggcaggtggtatggggacagcttcactctcaccntcatcacgcctggacgcctagaagatgttgctagtttattactgtactaacatcgtacgagtcggccgtaccgggggcctacgttccggccgtcgggacccgtagggtcggagactacgaaacgtacgtacggtcggctcggacacctactcgtcgttcctactaccg

SEQ ID NO: 419672 - DNA, 522 bp, Homo sapiens
  misc_feature: GZ8MTXP02FPVFW.8.33.C11.1.454.CMB.2.raw
  modified_base (208)..(208): a, c, t, g, unknown or other
  modified_base (244)..(244): a, c, t, g, unknown or other
  modified_base (267)..(267): a, c, t, g, unknown or other
  modified_base (284)..(284): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgtgcncttcgtaagctgtacacacaacngcagctcccagcccctnactctatggtgcatccaatacggccactggcactcccagccaggttcagtcggcagtggtatggggacagcttcactctcaccatcatcagcctggagcctgaagatgttgctagtttacttactgtacaactatcgtaccgagtcggccgtccgggggcctacgttccggccctcgggaccgtaaggtggagactaccgaaacgacgtcgtggcgtaacgcacactctcgtcttctc

SEQ ID NO: 419673 - DNA, 588 bp, Homo sapiens
  misc_feature: GZ8MTXP02GLJFH.8.33.C11.1.454.CMB.2.raw
  modified_base (209)..(209): a, c, t, g, unknown or other
  modified_base (266)..(266): a, c, t, g, unknown or other
  modified_base (280)..(280): a, c, t, g, unknown or other
  modified_base (289)..(289): a, c, t, g, unknown or other
  modified_base (299)..(299): a, c, t, g, unknown or other
  modified_base (386)..(386): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgagggaaanagccaccctctcctgcagggccagtcagaatgtgcgcttgagctgtacaacacaacngcagctccagcccnatctatgtncatccaacgnggccacgtggcactcccagcctaggtcagtcggcaggtgggtatgggacagaccttcactctacaccatacatcagtccgtaggacnctagaagattgtagacttagtttattacttgtacaacgtacgtacgtacgtagtccggcccggtccgggggcccttacggtttcccgggaccccgttaggggacccgtaaggggtcggaaagtacgttaaccgaaaacggtaacgtcgggtacggtaccgtggacccaccgtacgttccgtacggttcctttaacgtacccg

SEQ ID NO: 419674 - DNA, 511 bp, Homo sapiens
  misc_feature: GZ8MTXP02F5TG6.8.33.C11.1.454.CMB.2.raw
  modified_base (207)..(207): a, c, t, g, unknown or other
  modified_base (216)..(216): a, c, t, g, unknown or other
  modified_base (241)..(241): a, c, t, g, unknown or other
  modified_base (246)..(246): a, c, t, g, unknown or other
  modified_base (253)..(254): a, c, t, g, unknown or other
  modified_base (275)..(275): a, c, t, g, unknown or other
  modified_base (285)..(285): a, c, t, g, unknown or other
  modified_base (293)..(293): a, c, t, g, unknown or other
  modified_base (347)..(347): a, c, t, g, unknown or other
  modified_base (376)..(376): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgctccaggggaaangccaccctntcctgcagggccagtcagatgtgcnctganctgacannaactgcagctcccagcccctnatctatggtncatccaanggccatggcatcccagccaggttcagtcgcagtggtatgggacagcttcactcncaccatcatcagcctgacgcctagaacgntgttgctagtttacttactgtacaactatcgtacgagtacgccgtccggggcctacgttcggaccgtgggacctacggtacggagtacgtacgaaacgtacgtgtacggcgtgacacctatcgtcgtcttctacg

SEQ ID NO: 419675 - DNA, 543 bp, Homo sapiens
  misc_feature: GZ8MTXP02HOKIA.8.33.C11.1.454.CMB.2.raw
  modified_base (208)..(208): a, c, t, g, unknown or other
  modified_base (288)..(288): a, c, t, g, unknown or other
  modified_base (384)..(384): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagatgtgcgcttgaagctggtaccaacacaaacctgccagctcccaggcccctnatctatggtgcatccaatagggccactggccatcccagcctaggtcagtcggcagtgggatgggacagcttcactctcaccatcatcagcctggancctgaagattgttgctagtttattactgtacaacgtatcgtaccgagtcggaccgtccgggggctacgtttccggcccgtaggggaaccctaagggtcggagaaactacgaaaacgtaacgtggtacgactaacgcaacctatcctcgtactttcgacc

SEQ ID NO: 419676 - DNA, 522 bp, Homo sapiens
  misc_feature: GZ8MTXP02G8NV9.8.33.C11.1.454.CMB.2.raw
  modified_base (245)..(245): a, c, t, g, unknown or other
  modified_base (302)..(302): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagatgttgcnccttgaagctggtaccaacacaaactggccaggctcccaggcccctcatctatggtncatccaacaggccactggccatcccagccaggtcagtgcagtggggtatggggacaggcttcaactctcaccatcatcagcctggagcctgaagatgttgctagtttatactgtacaactatcgtacgagtcggccgtccgggggccacgtttcggcccgtgggaccgaacggtggaggactacgaaacgactacgtggctgcacactcctgtcttctac

SEQ ID NO: 419677 - DNA, 551 bp, Homo sapiens
  misc_feature: GZ8MTXP02JPLX6.8.33.C11.1.454.CMB.2.raw
  modified_base (365)..(365): a, c, t, g, unknown or other
  modified_base (408)..(408): a, c, t, g, unknown or other
  modified_base (437)..(437): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagatgttggcgcttgaagctggtaccaacacaaacctggccaggctcccaggcccctcatctatggtgcactccaacgagggcccactggccatccccagccaggtcaggtcgcagtgggtatggggacnggcttcactcctcaccatcatcagcccgtggacgcctagaagntgttgactagtttattactgttacaactntacgtaccgagtcggccggtccgggggcctacgtttccggccgtcgggacccgtagggtcggagacgtacaaacgtacgtcggtaggctggccaccactctcgtacttctaccg

SEQ ID NO: 419678 - DNA, 607 bp, Homo sapiens
  misc_feature: GZ8MTXP02FUYO2.8.33.C11.1.454.CMB.2.raw
  modified_base (247)..(247): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcnccttcgtaagctggtaccaacacaaacctggccaggcctcccaggccccctcatctatggtgcatcccaaacgaggggcccactggccatccccaagccagggtttccaggtcggctaggtggggtatggggaaccaggtccttcgacttctccaaccattccaattcagccctagggacgcctagaaagattggttagcttaagtttattaactgtacaacattcggtaaccggagtcggcccgtccgggggcctacgttccgggccctggggaccctaaagggtcggaagtacgtacgaaaacggtaccgtaggtcggcgtaacggacctaccgtattccgtgtttaccttctaaccg

SEQ ID NO: 419679 - DNA, 540 bp, Homo sapiens
  misc_feature: GZ8MTXP02JK0DN.8.33.C11.1.454.CMB.2.raw
  modified_base (245)..(245): a, c, t, g, unknown or other
  modified_base (266)..(266): a, c, t, g, unknown or other
  modified_base (280)..(280): a, c, t, g, unknown or other
  modified_base (299)..(299): a, c, t, g, unknown or other
  modified_base (416)..(416): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagatgttgcncttgagctgacaacacaaacngcagctccagcccncatctatggtgcatccaanagggccactggcatcccagccaggttcagtcggcaggtgggtatggggacatacttcactctcaccatcatcagcctggagcctagaagatgttgctagtttattactgtacaactntaccgtacgagtcggccgtccgggggcctacgtttccggcccgtaggggaccgaagggtcggaagacgtacgaaaacgaacgttggtacgggctggacctaccgtatcctggtccttactaccg

SEQ ID NO: 419680 - DNA, 581 bp, Homo sapiens
  misc_feature: GZ8MTXP02G986O.8.33.C11.1.454.CMB.2.raw
  modified_base (410)..(410): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggagcgtagtccagcctgggagtcacagagactctcctgtgcagcctcgtgggtccaccttcagtagctacggcatgcacgtgggtcccaccaaactccaaggcaagggattggaggtggggtgctagtttgttcatccgtggagggctaggttgttacaagttggtatgctgacgcgtgaacggcatcacatcncagacacaactcagaacacaatgtattacgactagaacacgacctaagtcctaggacggaacgtacgggtataactacgttacgtacggtaacggaaaggggaacgggggaaccgagggaccgggtaagtaccgaaacggtactaccgtttacgaccggtcggtacggggg

SEQ ID NO: 419681 - DNA, 644 bp, Homo sapiens
  misc_feature: GZ8MTXP02G9BTT.8.33.C11.1.454.CMB.2.raw
  modified_base (303)..(303): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctcctgtgcagcctctgggttcaccttcagtagctacggcatgcacgtgggtcccnccaaactccaggcaagggattggagtgggtggcagttgttcatccgtgagggcaggttgttacaattgggtatggacgtgaccgccggtaggaacgggcccgtattccgacctactcctccagacgaaccaactaccaacggaaacaacctaaagtcgttaagtttcggaacccttaggaaaccacgtacccgtaaagtcccgtaggaacggaacgtacggggtagttaacgttacgtacgttacggtaacgggaaaggggacggggggaaaacccgagggaccggggaacgttacccgaaacggttaccgtccgtttacggaccggttcggtaccggggg

SEQ ID NO: 419682 - DNA, 581 bp, Homo sapiens
  misc_feature: GZ8MTXP02JZZ56.8.33.C11.1.454.CMB.2.raw
  modified_base (292)..(292): a, c, t, g, unknown or other
  modified_base (302)..(302): a, c, t, g, unknown or other
  modified_base (392)..(392): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgcttcgaagctgtaccaacacaacctggccaggctcccaggcccctnatctatggtncatccaatcgggccagtggcactcccagccaggtcagtcggcaggtgggtatgggacagtcttcactctacaccatcatcagcctggacnccgtagaagtagttgttagtacttagtttaattacgttgtactaactagtacggtaccggtaggtcggtcccggttcccgggggaccttaccgtttccgggcccgtacgggtacccgtaagggtcgggaagacgtaaccgaaacggtaacgtcggtcggactcggaccacctatctcgtccttctaccg

SEQ ID NO: 419683 - DNA, 545 bp, Homo sapiens
  misc_feature: GZ8MTXP02GYP37.8.33.C11.1.454.CMB.2.raw
  modified_base (244)..(244): a, c, t, g, unknown or other
  modified_base (256)..(256): a, c, t, g, unknown or other
  modified_base (278)..(278): a, c, t, g, unknown or other
  modified_base (288)..(288): a, c, t, g, unknown or other
  modified_base (297)..(297): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagacgccaccctctcctgcaggccagtcagatgtgcnctgagctgacanacaactgcagctccagcccctnatctatggtncatccgaanggccagtggcactcccagccgaggttcaggtcggacaggtgggatggggacagtccttcactctcacatcatcagcctggacgcgtagaacgatgttgactagtttattactgtacaactagtacgtacgagtccggcccgtccgggggcctaccgtttccggacccgtacggggaccgtaagggtcggagtactacgaaaacgtacgtggtacgcgtcgaccaaccgtcttcgtcgttccttactac

SEQ ID NO: 419684 - DNA, 576 bp, Homo sapiens
  misc_feature: GZ8MTXP02II9UU.8.33.C11.1.454.CMB.2.raw
  modified_base (211)..(211): a, c, t, g, unknown or other
  modified_base (296)..(296): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccaccctgtctttgtctccagggggaaanagccaccctctcctgcagggccagtcagaatgttggcgccttcgaagctggtacaacacaaactggccaggctcccaggcccctnatctatggtgcatcccaaacgacggggccacgtggaccactccccgagcccaggttccaggtcggcaggtggggtatggggacagcttcactctccaccatcatcagcctggacgcctagaacgattgttgactagtttattacttgtactaactacttccgtaccgtagtcgggtacccgtccgggggtacctacgtttccggacccgtgggaacccgtaagggtggagacgtacgaaacgacgtacggtcggctggcaccgtattctcgttcttctac

SEQ ID NO: 419685 - DNA, 543 bp, Homo sapiens
  misc_feature: GZ8MTXP02GFG2S.8.33.C11.1.454.CMB.2.raw
  modified_base (286)..(286): a, c, t, g, unknown or other
  modified_base (296)..(296): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccaccctgtctttgtctccgaggggaaagacgccaccctctcctgcagggccagtcagaatgttggcgtctgagctgacaacacaactgcagctccacgccctnatctatggtncactccaacgacgggccacgtcggcacgtcccagccaggttcaggtcggctaggtgggtagtgggacagtccttcactctccacctatcatcagtccgtggactcgtagagattgtagctagtttactactgtacactatcgtacgagtccggccgtccggggctacgttccggaccgtgggaaccgagggtgaagacgtacgaaacgtacgtggtcgctcgactacgtactcgtcgtcttactccg

SEQ ID NO: 419686 - DNA, 589 bp, Homo sapiens
  misc_feature: GZ8MTXP02JPFHK.8.33.C11.1.454.CMB.2.raw
  modified_base (305)..(305): a, c, t, g, unknown or other
  modified_base (327)..(327): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggaggtcacagagactctcctgtgcagccctgtggttccaccttcagtagctacggcatgcacgtgggtcccnccaaactccgaggcaaggggtnttgggaggtggggtgctaggtttgttcattccgtggagggcaggttgttacaagttgggtatggctgaccgcgtaggaacgggccattcactatctaccgagacgacaactaccagaacaacaatgtaattggacctagaacagacctaagtcctaggacggtacgacgggtgtaactactacgtaggtaacggaaagggacgggggaaccagggacggtaagtacccgaaacgtactaccgttacgtacggtcgtacgggg

SEQ ID NO: 419687 - DNA, 501 bp, Homo sapiens
  misc_feature: GZ8MTXP02FWIWL.8.33.C11.1.454.CMB.2.raw
  modified_base (243)..(243): a, c, t, g, unknown or other
  modified_base (248)..(248): a, c, t, g, unknown or other
  modified_base (255)..(256): a, c, t, g, unknown or other
  modified_base (260)..(260): a, c, t, g, unknown or other
  modified_base (266)..(266): a, c, t, g, unknown or other
  modified_base (274)..(274): a, c, t, g, unknown or other
  modified_base (283)..(283): a, c, t, g, unknown or other
  modified_base (370)..(370): a, c, t, g, unknown or other
  modified_base (461)..(461): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagtcaccctctcctgcaggccagtcagatgtgcnctganctgacannaacngcagcnccagcccnatctatgtncatccaacaggccactggcatcccagccaggttcagtcggcagtggtatggggacagcttcactctcaccatcatcagccctggacncctgaagatgttgctagtttattactgtcaactatacgtaccgagtcggccgtccgggggcctacgttcggcccgtgggaccagggtgganacgtacaaacgactgacgctgcacacgtctgtcttcgtac

SEQ ID NO: 419688 - DNA, 527 bp, Homo sapiens
  misc_feature: GZ8MTXP02G2RPI.8.33.C11.1.454.CMB.2.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgtgcgccttcgaagctggtacaacacaaactggcaggctcccaggcccctcatctatggtgcatccaacagggccactggcatcccagccaggttcagtggcagtgggtatggggacagcttcactctcaccatcatcagcctggagcctgaagatgttgctagtttattactgtacaactatacgtaccgagtcggccgtccgggggtcctacgtttcggccgtggggaaccaacgggtggagactacgaaacgaacgtgtaggctgacacactctcgtctactac

SEQ ID NO: 419689 - DNA, 569 bp, Homo sapiens
  misc_feature: GZ8MTXP02IOFRE.8.33.C11.1.454.CMB.2.raw
  modified_base (209)..(209): a, c, t, g, unknown or other
  modified_base (244)..(244): a, c, t, g, unknown or other
  modified_base (258)..(258): a, c, t, g, unknown or other
  modified_base (282)..(282): a, c, t, g, unknown or other
  modified_base (288)..(288): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccagggggaaanagccacctctcctgcagggccagtcagatgtggcncttgagctgtacanacaaactgcagctccaggcccctnatctanggtgcatccaatacgggccacgtcggcatccccagccaggttcagtcggcaggtcgggtatggggacagtcttcactctcaccatcatcagcctgacgcctagaagatgttgctagtttattaacttgtacaaactagttacgtacgacgtcggccgttccgggggcctacgtttccgggcccgttacggggacccgtaaggggttggaagacgttaaaccgaaaacggtacgtacggtcggtacgtcgaccgacctacgttcgttacgttccttctaccg

SEQ ID NO: 419690 - DNA, 564 bp, Homo sapiens
  misc_feature: GZ8MTXP02FOL6W.8.33.C11.1.454.CMB.2.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagaatgttggcgccttgtaagctggtaccaacacaaacctggccaggcctcccacggccccctcatctatggtgcatcccaacgacggggcccacgtggccactccccagcccaggttccaggtggcaggtgggtatggggacagtcttcactctccaccatcatcagccctggacgcctagaagattagttgactagtttattactgtacaactatcgtaccgtagtcggtccggtccgggggcctacgttccggcccgtcgggaccgtacgggtggtgacgtacgaaacgtacgtcgtcggcgtcgacactactctcgtcttctac

SEQ ID NO: 419691 - DNA, 521 bp, Homo sapiens
  misc_feature: GZ8MTXP02HWXNW.8.33.C11.1.454.CMB.2.raw
  modified_base (209)..(209): a, c, t, g, unknown or other
  modified_base (288)..(288): a, c, t, g, unknown or other
  modified_base (298)..(298): a, c, t, g, unknown or other
  modified_base (353)..(353): a, c, t, g, unknown or other
  modified_base (383)..(383): a, c, t, g, unknown or other
  modified_base (391)..(391): a, c, t, g, unknown or other
  modified_base (395)..(395): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagatgttgcgcttgagctgtacaacacaaactggccaggctcccaggcccctnatctatggtncatccgaacggggccatggcatcccagccaggttcagtgccagtggtatgggacngacttcactctcaccatcatcagcctgganctgaaatntgtnatagttatactatacaatctcgacgagtccgccggcggacttacgtcgccgaggacgaggtcgagtactaacgaaacgtacgtcgacgtcacgaacctactacttcgtactccttactctttcccg

SEQ ID NO: 419692 - DNA, 537 bp, Homo sapiens
  misc_feature: GZ8MTXP02GIGJP.8.33.C11.1.454.CMB.2.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccacgtggcactcccagccaggttcagtcgcaggtggatgggacagcttcactctacaccatcatcagcctggacgcctagaagtatgtgactagtttattactgtacaactatacgtaccgagtccggccgtccgggggcctacgttccggcccgtgggaccgaggtcggagtactacgaaacgacgtcgtagcgtgccactactctcgtctactac

SEQ ID NO: 419693 - DNA, 545 bp, Homo sapiens
  misc_feature: GZ8MTXP02IZRW3.8.33.C11.1.454.CMB.2.raw
  modified_base (213)..(213): a, c, t, g, unknown or other
  modified_base (249)..(249): a, c, t, g, unknown or other
  modified_base (255)..(255): a, c, t, g, unknown or other
  modified_base (262)..(262): a, c, t, g, unknown or other
  modified_base (267)..(267): a, c, t, g, unknown or other
  modified_base (273)..(273): a, c, t, g, unknown or other
  modified_base (276)..(276): a, c, t, g, unknown or other
  modified_base (281)..(281): a, c, t, g, unknown or other
  modified_base (286)..(286): a, c, t, g, unknown or other
  modified_base (288)..(289): a, c, t, g, unknown or other
  modified_base (291)..(291): a, c, t, g, unknown or other
  modified_base (294)..(294): a, c, t, g, unknown or other
  modified_base (298)..(299): a, c, t, g, unknown or other
  modified_base (302)..(303): a, c, t, g, unknown or other
  modified_base (325)..(325): a, c, t, g, unknown or other
  modified_base (330)..(330): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccaccctgttctttgtctccgaaggggaaanacgccaccctctcctgcagggccagtcagatgtgcncttganctgacancaacngcagcnccngcccnatcangnnancanggcnngcnnccagcagtcagtgcagtggtanggacngtcttcacttccacacctatcatcagtccctggacgcctagaaagtgttgttgtacgttagtttgttactgtacaaacgtcgtacggtacggagtccggccggtccgggggcctaccggtttccggaccgtacgggacccgtaaagggtcggaaacgactaaccgaaaacgtacgttcggcgtacgtcgaccactacgtcttcgtccttactacc

SEQ ID NO: 419694 - DNA, 517 bp, Homo sapiens
  misc_feature: GZ8MTXP02IVI8L.8.33.C11.1.454.CMB.2.raw
  modified_base (247)..(247): a, c, t, g, unknown or other
  modified_base (261)..(261): a, c, t, g, unknown or other
  modified_base (267)..(267): a, c, t, g, unknown or other
  modified_base (273)..(273): a, c, t, g, unknown or other
  modified_base (282)..(282): a, c, t, g, unknown or other
  modified_base (291)..(291): a, c, t, g, unknown or other
  modified_base (299)..(299): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcncttgaagctgacanacaacngcagcnccagccctnatcatggtncatccaanaggccactggcatcccagccaggtcagtcgcagtggatgggacagcttcactctcaccatcatcagctgagcctgaagatgttgctagtttattactagtacaaactattaccgtacgagtcggaccgtccgggggtccacgtttccggcccgtgggaccaagggtggagactacgaaaacgtacgtagtcggctaagcacgactctcgttcttctac

SEQ ID NO: 419695 - DNA, 646 bp, Homo sapiens
  misc_feature: GZ8MTXP02IX45C.8.33.C11.1.454.CMB.2.raw
  modified_base (208)..(208): a, c, t, g, unknown or other
  modified_base (242)..(242): a, c, t, g, unknown or other
  modified_base (247)..(247): a, c, t, g, unknown or other
  modified_base (254)..(254): a, c, t, g, unknown or other
  modified_base (260)..(260): a, c, t, g, unknown or other
  modified_base (266)..(266): a, c, t, g, unknown or other
  modified_base (274)..(274): a, c, t, g, unknown or other
  modified_base (281)..(281): a, c, t, g, unknown or other
  modified_base (288)..(288): a, c, t, g, unknown or other
  modified_base (375)..(375): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgtttacacagtctccagccaccctgtctttgtctccaggggaaanagccacctctcctgcagggccagtcagatgtgcnctganctgacanacaacngcagcnccagcccnatcatgncatcaanggcatgcatccagccagttcagtggcaggtggtatgggacagacttcactctcaccatcgaatcgagcctggacgtcctagaaagtnttggttagtacgttaaggtttacttacgttaggttaacctaaacctagtttaccggtaaccggtacgggttaccgggtaccccggtccccggggggtacccttaacccgggttttcccggggaccccgttacgggggaaacccctaaagggggttacggaacggtaacggtaacccgtaaaaacgggtaacgttacggggacggtcgtacgggaacccgtaaaccgtaacgtttccctcggtttaccctttaccgtaaccgttttcccccg

SEQ ID NO: 419696 - DNA, 541 bp, Homo sapiens
  misc_feature: GZ8MTXP02HEWAK.8.33.C11.1.454.CMB.2.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgtggcgccttgtaagctggtaccaacacaaacctggccaggctcccaggcccctcatctatggtgcatcccaaacaggggccactggccatccccaagccagggttcaggtcggcaggtggggtatggggacagcttcactctcaccatcatcagcctgagcctgaagatgttgactagtttattactgtacaactatcgtacgagtcggccgtccgggggcctacgtttcggcccgtgggaccgaacggtggagacgtacaaaacgtacgtcgtaggctggcaccatctcgttcttctac

SEQ ID NO: 419697 - DNA, 555 bp, Homo sapiens
  misc_feature: GZ8MTXP02IYOLF.8.33.C11.1.454.CMB.2.raw
  modified_base (382)..(382): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttgtaagctggtaccaacacaaacctggccaggcctcccaggccccctcatctatggtgcatccaacacggggcccagtggccatccccagccaggttcaggtcggcaggtgggtatgggacagcttcactcncaccatcatcagcctggacgcctagaagtatgttgactagtttattactgtacaactagtacgtacgtagtcggccgtccgggggcctacgttccggccgtcgggacgtaacggtggagacgtacgaaacgtacgtggtacgcgtcgaccacgtactcgtcgttcttactacg

SEQ ID NO: 419698 - DNA, 526 bp, Homo sapiens
  misc_feature: GZ8MTXP02GI80W.8.33.C11.1.454.CMB.2.raw
  modified_base (209)..(209): a, c, t, g, unknown or other
  modified_base (245)..(245): a, c, t, g, unknown or other
  modified_base (258)..(258): a, c, t, g, unknown or other
  modified_base (264)..(264): a, c, t, g, unknown or other
  modified_base (280)..(280): a, c, t, g, unknown or other
  modified_base (289)..(289): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagatgttgcncttgagctgacanacaacngcagctccagcccctnatctatggncatccaaacagggccactggcactcccagccaggttcagtcggcaggtgggtatggggacaggcttcactcacaccatcatcagcctggagcctgaagatgtgctagtttattactgtacaactatacgtacgagtcggccgtcgggggcctacgtttccggcccgtcgggaccgtagggtacggagacgtacgaaacggtaacgtggtacggctgaccacactctcgtcttactac

SEQ ID NO: 419699 - DNA, 628 bp, Homo sapiens
  misc_feature: GZ8MTXP02G06EU.8.33.C11.1.454.CMB.2.raw
  modified_base (209)..(209): a, c, t, g, unknown or other
  modified_base (244)..(244): a, c, t, g, unknown or other
  modified_base (259)..(259): a, c, t, g, unknown or other
  modified_base (283)..(283): a, c, t, g, unknown or other
  modified_base (385)..(385): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagccaccctctcctgcagggccagtcagatgtgcncttgaagctgacaanacaactggcagctcccagcccctnatctatggtcatccaataggccactaggcactacccacgccgaggttcacgtggccgaggtgggtagtgggacgaggacttccgtactctccaccatctacnctacgcctggacgccgtgaagatgttgtactagtttagttactagttactaaacacgttacgtaccggtacgtacggggtcccgtacccggggggtacccgttaccgtttcccgggtccccggttacgggggaacccgtaagggggtttacgggacggaacgttaccgaaaacggtaaaccgtgggttacggccgttacgaaccgaccgtaacgttcgtcggtacctttaccgactttccccg

SEQ ID NO: 419700 - DNA, 546 bp, Homo sapiens
  misc_feature: GZ8MTXP02GHOX6.8.33.C11.1.454.CMB.2.raw
  modified_base (293)..(293): a, c, t, g, unknown or other
  modified_base (303)..(303): a, c, t, g, unknown or other
  modified_base (395)..(395): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttgcgcttgtaagctggtaccaacacaaacctggccaggctcccaggcccctnatctatggtncatccaatcgggccacgtggcatcccagccaggttcaggtcggcaggtgggtatggggacagcttcactctcaccatcatcagtcctggacncctgaagtatgttgctagtttatactgtacaatagtcgtaccgagtcggccgtccggggcctacgttccgccgtagggaccctaagggtcgagacgtacgaaacgtaaccgtggtacggctgaccacgtactccgtcgttccttactaccg

SEQ ID NO: 419701 - DNA, 587 bp, Homo sapiens
  misc_feature: GZ8MTXP02GGGVK.8.33.C11.1.454.CMB.2.raw
  modified_base (246)..(246): a, c, t, g, unknown or other
  modified_base (252)..(252): a, c, t, g, unknown or other
  modified_base (284)..(284): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagatgttgcncttganctgacaacacaactgcagctcccaggcccctnatctatggtgcatcccaacaggggccacgtggcactcccagccaggttcagtcggcaggtggtatgggacagcttcactctcaccatcatcagccctggacgcctagaacgatgttgcgtagtttacttaactgtacaactacttaccggtaacggaggtcggtcccggtcccgggggtcctaccggtttccgggccccgtagggggaaccctaaggggtacgggaacgtacgttaaccgaaaacggtaaccgtggtacggcgtcggaccaaccgtactccgttacggttcctttctaacccg

SEQ ID NO: 419702 - DNA, 556 bp, Homo sapiens
  misc_feature: GZ8MTXP02JNZQY.8.33.C11.1.454.CMB.2.raw
  modified_base (321)..(321): a, c, t, g, unknown or other
  modified_base (433)..(433): a, c, t, g, unknown or other
  modified_base (511)..(511): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtagtccagcctgggagtcacagagactctcctgtgcagcctctgggttcaccttcagtagctacggcatgcacgtgggccaccaaactccgaggcaaggggnttgggagtgggtggctagttgttcatccgtgagggcaggtgttacaattgggtatggctgacgccgtagaacgggccgattcgaccatctccagacgacaactcgagaacanaatgtattgactgaacagcctaagtctagaggacgacggtgtactacgtactacggtacggaagggacgggggaaccnggacgggtaagtacgaacgtacgtcgtttacggacgtcgtacggg

SEQ ID NO: 419703 - DNA, 620 bp, Homo sapiens
  misc_feature: GZ8MTXP02IR10G.8.33.C11.1.454.CMB.2.raw
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctggggagtcacagagactctcctgtgcagcctcgtgggttcaccttcagtagctacggcatgccacgtgggtcccaccaaactccgaggcaaggggattgggaggtggggtggctagtttgtttcatccgtagaggactaggttgttacaagtgggtatggcgtgaccgccggacggaaacgggccgtattccgaccatcctccgagacgaacaactaccaaggaacaacaaatgtaatttcggaccctagaaaccacgacctaagtcctaggacggaacgacggggtcgtaactacgtacgtcggtaaacggaacggggacgggggaaaccgagggacggggaacgttaccgaacgttacctccgtttacggacggttcggtacggggg

SEQ ID NO: 419704 - DNA, 628 bp, Homo sapiens
  misc_feature: GZ8MTXP02JGWXK.8.33.C11.1.454.CMB.2.raw
  modified_base (400)..(400): a, c, t, g, unknown or other
  modified_base (421)..(421): a, c, t, g, unknown or other
  modified_base (430)..(430): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagacgccaccctctcctgcagggccagtcagaatgttggcgtccttcgtaagctggtaccaacacaaacctggccaggcctcccacggcccctcactctagtggtgcactacccaaacgacgggcccacgtggaccactccccgagccctagggttcaggtcggcaggtgggtagtgggacagcttcactcncaccatcatcacgcctggacnctagaagtntgttgacttaagtttattacgtagttacaactgttaccgtaccggagtcggtcccggtaccgggggccctacggtttcccggaccccggtagggaacccggtaggggtacggaacgtaacgtaaaccgaaaacggtacgttacggtcggtacgtaacggacctaaccgtacttccgttcgtttaccttacgttacccg

SEQ ID NO: 419705 - DNA, 816 bp, Homo sapiens
  misc_feature: GZ8MTXP02JJE43.8.33.C11.1.454.CMB.2.raw
  modified_base (260)..(260): a, c, t, g, unknown or other
tcagctcgcgtgtccacgaccggtgctcgatttagagtgagctcgttgggtttggggctgggagaggaacccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtagtccagcctgggaggtcacagagactctcctgtgacncgtcctggttcggtacctacctgagtacgacgtacggctagtcgacgtacggtccgggtaccccgaaacctaaccgtaccggaggtaacggaaggggttaggtaggggtagggttggggtacgacgtttaggttttcgttacgacgttcggtaggggacgggtacgtaggtttccgttaagtaaggtttggttaggtcggtacggttacgggacccgggtcgggttaaggggaccggggtacccttacgttacccgaccctacgttaccacccggaaaggaacccaaacccgtaaaccgtaacccgggaaaacgaaaccctaaaacgttaaggtttacggtttaaaccggttaccggtaaccgtaaacgtaacccgaacgttaaacccgtaccggttaccggtaaggggaacgtaacccgggttaggttaataaccgtttaacgtacgggtacgggtaaaaccgggggaacgggggtaaacgggacgacgggggtacggttacgtaaccgtaacgttcgttacggtacggtaccggttcgggaccgggtaacccgg

SEQ ID NO: 419706 - DNA, 658 bp, Homo sapiens
  misc_feature: GZ8MTXP02JY9ZW.8.33.C11.1.454.CMB.2.raw
  modified_base (245)..(245): a, c, t, g, unknown or other
  modified_base (251)..(251): a, c, t, g, unknown or other
  modified_base (258)..(258): a, c, t, g, unknown or other
  modified_base (264)..(264): a, c, t, g, unknown or other
  modified_base (270)..(270): a, c, t, g, unknown or other
  modified_base (278)..(278): a, c, t, g, unknown or other
  modified_base (288)..(288): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaaggggaaagacgccaccctctcctgcagggccagtcagatgtgcncttganctgacanacaacngcagcnccagcccnatctatggtncatccaagtacgggccagtggcactcccagccaggttcagtggcagtgggtatgggacagaccttcactctacacctatcatcagcctagggacgcccgtagaagtacgttaggttgtacgttaagttttaactttaaccgttcgttaacctaaaccgtacgttacccgggttaacccgggtaacggttcccgggggtaccccggtttaccccgggggggtaccccttaacccggttttcccggggaccccggttacgggggaaccccggtaaaggggttacgggaaacggaacgttaaaccgaaaacggtaaccgtacgggtacggtaccgtcggaccctaccgtacttccgtcgttccttacgtaccg

SEQ ID NO: 419707 - DNA, 508 bp, Homo sapiens
  misc_feature: GZ8MTXP02GGNFS.8.33.C11.1.454.CMB.2.raw
  modified_base (208)..(208): a, c, t, g, unknown or other
  modified_base (243)..(243): a, c, t, g, unknown or other
  modified_base (248)..(248): a, c, t, g, unknown or other
  modified_base (255)..(255): a, c, t, g, unknown or other
  modified_base (261)..(261): a, c, t, g, unknown or other
  modified_base (277)..(277): a, c, t, g, unknown or other
  modified_base (287)..(287): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagatgtgcnctganctgacanacaacngcagctcccagccctnatctatggtncatccaataggccagtggcatcccagccaggttcagtcgcagtgggtatgggacagcttcactctcaccatcatcagcctggagcctagaacgatagtgctagtttattactgtacaactatacgtacgagtcggaccgtccgggggctacgttccggccgtgggaccgaaggtggagactacgaaacgacgtcgtgactgacacacgtctcgtactctac

SEQ ID NO: 419708 - DNA, 611 bp, Homo sapiens
  misc_feature: GZ8MTXP02IUVV7.8.33.C11.1.454.CMB.2.raw
  modified_base (565)..(565): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctcctgtgcagcctctgggttcaccttcagtagctacggcatgcacgtgggtcccaccaaactccgaaggccaaggggattgggagttggggtgctagtttcgttcattcccgtggagggctaggttgttacaagttgggtatggctgaccgccgtaggaacgggccgtattcgaccatcctaccgagacgacaactacccgaaggaacaacgaatgttaacgtttacggaccttaggaaaccacgtacctaacgtcctaggacggaacgtacgggtataactactacgtacgtaacggaaagggacgggggaaaccnggacgggtaacgtaccgaacgtactcgtttacgacgtcgtacgggg

SEQ ID NO: 419709 - DNA, 513 bp, Homo sapiens
  misc_feature: GZ8MTXP02I09LB.8.33.C11.1.454.CMB.2.raw
  modified_base (292)..(292): a, c, t, g, unknown or other
  modified_base (302)..(302): a, c, t, g, unknown or other
  modified_base (364)..(364): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgtgcgccttgaagctggtaccaacacaaacctggccaggctcccaggcccctnatctatggtncatccaataggccactggcatcccagccaggtcagtgcagtggtatgggacagcttcactcncacatcatcagcctgacgctgaagatgttgctagttattactgtacaactatcgtaccgagtcggccgtccgggggcctacgtttcggcccgtgggaccgtaggtcgagactacgaaacgactacgtggctgcacactctctcttctac

SEQ ID NO: 419710 - DNA, 673 bp, Homo sapiens
  misc_feature: GZ8MTXP02HX8M5.8.33.C11.1.454.CMB.2.raw
  modified_base (211)..(211): a, c, t, g, unknown or other
  modified_base (301)..(301): a, c, t, g, unknown or other
  modified_base (312)..(312): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgagggggaaanagccaccctctcctgcagggccagtcaagaatgttggcgtcttcgaagctggtaccaacacaaacctggccaggcctcccacggcccctnatctagtggtncaatcccaaacgagggcccaacgtcggaccactcccagcccgtaggttccaggtcggcaggtgggtaactggggacagtacttccaactcctaccactatcactcacgccgtggacgtccctagaaagtagttaggttagtacgttagtttacttaacttcgtactaaactacgttaccgtaaccggaggttcggtcccggttccgggggtaccctaccggtttcccgggcccggtacggggtaacccgtaaaggggtacgggaacggaaacgttaacgaaaacggtaaacgttcgggttacgggaccgttaacggaccgtaacccgtacttaccgttacggtttcctttaccgtaacccg

SEQ ID NO: 419711 - DNA, 712 bp, Homo sapiens
  misc_feature: GZ8MTXP02FYYE4.8.33.C11.1.454.CMB.2.raw
  modified_base (313)..(313): a, c, t, g, unknown or other
  modified_base (325)..(325): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgttctttgtcctccgaaggggaaagacgcccaccctctcctgcgacgggccagtcaagattggttggcgtcttcgtaagctaggtaaccaacacaaaccgtggccaggcctcccgacggcccctnactctagtggtnacactacccaacgacgggcccacgtcggaccactccccgaggtccgtagggttccgaggtcggacgtaggggttcggggtaagtcggggaactaggtccttcaccttctaccaacctatccaatcgacgccgtagggacgaccgtaggaagtgttcgttacgtacgttaagttttacttacgttacgtaacctaaacgtacgttaccgggtaaccggtacggttccgggtaccccgggtccgggggtaccccttaaccgggtttcccgggacccggttacggggaaccggtaagggtacggaaacgtaacgtaaaccgaaaacggtacgtacggtcggtacgtaaccggacctaaccgtattccgtttacgttaccttccgtaaccc

SEQ ID NO: 419712 - DNA, 521 bp, Homo sapiens
  misc_feature: GZ8MTXP02JDGMF.8.33.C11.1.454.CMB.2.raw
  modified_base (209)..(209): a, c, t, g, unknown or other
  modified_base (247)..(247): a, c, t, g, unknown or other
  modified_base (262)..(262): a, c, t, g, unknown or other
  modified_base (268)..(268): a, c, t, g, unknown or other
  modified_base (287)..(287): a, c, t, g, unknown or other
  modified_base (297)..(297): a, c, t, g, unknown or other
  modified_base (305)..(305): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcnccttgaagctgacanacaacnggcaggctccaggcccctnatctatggtncatccaangggccatggcatccccagccaggttcagtcggcaggtgggtatgggacagcttcactctcaccatcatcagcctggacgcctagaagatgttgctagtttattactgtacaactatccgtacgagtcggcccgtccgggggcctacgtttccggcccgtggggaccaagggtggagactacgaaacgactcgtaggctgcaccatctgtcttctac

SEQ ID NO: 419713 - DNA, 637 bp, Homo sapiens
  misc_feature: GZ8MTXP02GOO6R.8.33.C11.1.454.CMB.2.raw
  modified_base (210)..(210): a, c, t, g, unknown or other
  modified_base (249)..(249): a, c, t, g, unknown or other
  modified_base (256)..(256): a, c, t, g, unknown or other
  modified_base (262)..(262): a, c, t, g, unknown or other
  modified_base (268)..(268): a, c, t, g, unknown or other
  modified_base (277)..(277): a, c, t, g, unknown or other
  modified_base (289)..(289): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagccacctctcctgcaggccagtcagatgtgcgcttganctgacanacaacngcagcnccagccctnatctagtggtcncatcccaacgcgggccacgtggccactccccgagcctaggttccaggtcggacgtagggttcgggtatcggggacaggtaccttcgacttcctacaacctatcaactcgacgtccgtaggacgtaccgtagtaaacggtagttggttacgaccgttaaggtttttaacttaaccgttacggttaactaaacgttaacgttaccggtaaaccgggtacggtcccgggtaccccggttcccggggggtacccttaccggtttccggacccggttacggggaccgtaagggtcgggtagacgtacgaaacgtacgtcgcggctaacgacactactcgtacgttctactacc

SEQ ID NO: 419714 - DNA, 552 bp, Homo sapiens
  misc_feature: GZ8MTXP02GZ4EY.8.33.C11.1.454.CMB.2.raw
  modified_base (304)..(304): a, c, t, g, unknown or other
  modified_base (323)..(323): a, c, t, g, unknown or other
  modified_base (334)..(334): a, c, t, g, unknown or other
  modified_base (348)..(348): a, c, t, g, unknown or other
  modified_base (378)..(378): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctcctgtgcagcctcgtgggttcaccttcagtagctacggcatgcacgtgggtcccnccaaactccaggcaagggnttggagtgggngcagttgttcatcngaggcagtgtacaatggtatgctgacgcgngacgggccatcacatctcagacgacaactaccagaacaacaagtagtagtttaggacctagaacagtacctaagtcctaggacggacgacgggtagtactacgtactaggtacggaaagggacgggggaacaggacggaacgtacgaagtactcgtttacgacgtcgtacgggg

SEQ ID NO: 419715 - DNA, 569 bp, Homo sapiens
  misc_feature: GZ8MTXP02F6NO6.8.33.C11.1.454.CMB.2.raw
  modified_base (210)..(210): a, c, t, g, unknown or other
  modified_base (247)..(247): a, c, t, g, unknown or other
  modified_base (262)..(262): a, c, t, g, unknown or other
  modified_base (268)..(268): a, c, t, g, unknown or other
  modified_base (274)..(274): a, c, t, g, unknown or other
  modified_base (282)..(283): a, c, t, g, unknown or other
  modified_base (288)..(288): a, c, t, g, unknown or other
  modified_base (292)..(292): a, c, t, g, unknown or other
  modified_base (308)..(308): a, c, t, g, unknown or other
  modified_base (312)..(312): a, c, t, g, unknown or other
  modified_base (332)..(332): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgttctttgtctccgaggggaaanagcccaccctctcctgcagggccagtcagatgttgcnccttgaagctgacanacaacngcagcnccagcccnntctanggtncatcaatggcatgcanccanccaggtcagtgcagtggtangggacagacttcactctcacctatcatcacgccgtagacgcctaagaagtattgtgtacttaagtttacttacgtataccaaactacgtaccggtacgacgtccgggtcccgtccgggggacccttacgtttcccgggacccgttacggggaaccgttaacggggtagaaacgggtactaacggaaacgtacgaaacggtgtacggtctcggacctaccacgtctcgttcttacccg

SEQ ID NO: 419716 - DNA, 622 bp, Homo sapiens
  misc_feature: GZ8MTXP02FYX35.8.33.C11.1.454.CMB.2.raw
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactgggtggagtcgtgggggaggcgtagtccagcctggggaggtcacagagactctcctgtgcagccctcgtgggttccaccttcagtagctacggcatgcacgtgggtcccgaccaaactccgaggaccaaggggattgggagtggggtggctaggttgtttcatccgtggagggctagttgtacaagtgggtatgctgacgcgtggaacggcgatcacatctcagacgacaactacgaacgaacaacaatagttagtttacggacctagaaaccacgtacctaagtccgtaggacggacgtacgggtacgttaactacgttaacgtaggtaaaccgggaaaggggaaacgggggaaaccgagggacggggtaacgttaccggtaaacgttaccgttacgtttacggacggtccgtaccggggg

SEQ ID NO: 419717 - DNA, 603 bp, Homo sapiens
  misc_feature: GZ8MTXP02FSHOO.8.33.C11.1.454.CMB.2.raw
  modified_base (320)..(320): a, c, t, g, unknown or other
  modified_base (414)..(414): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagcccaccctctcctgcagggccagtcagaatgttggcgcttcgtaagctggtaccaacacaaacctggccaggctcccacggcccctcatctatggtgcatccaaacgnggggcccacgtggaccactccccagccagggttccaggtcggcgaggtgggtatggggacaggccttcactctccacctatcatcagcctgganccgtagaagattgttgctagtttattactgtacaacgtattaccgtaaccggtacgtccgggcccgttacccgggggtccctacggtttcccgggacccgttcggggaacccgtaaagggtcgggaacgtacgtaaccgaaaacggtaaccgtaggtggcgtaaggcaccacgttctcgtcttacgtcc

SEQ ID NO: 419718 - DNA, 586 bp, Homo sapiens
  misc_feature: GZ8MTXP02HXZN3.8.33.C11.1.454.CMB.2.raw
  modified_base (206)..(206): a, c, t, g, unknown or other
  modified_base (240)..(240): a, c, t, g, unknown or other
  modified_base (254)..(254): a, c, t, g, unknown or other
  modified_base (260)..(260): a, c, t, g, unknown or other
  modified_base (276)..(276): a, c, t, g, unknown or other
  modified_base (373)..(373): a, c, t, g, unknown or other
  modified_base (378)..(378): a, c, t, g, unknown or other
  modified_base (402)..(402): a, c, t, g, unknown or other
  modified_base (442)..(442): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacctgtctttgctccaggggaangccaccctctcctgcagggccagtcagatgtgcncttgagctgtacanacaacngccagctccagccctnatctagtggtcgcatcccaaacgacgggccacgtcggccactccccagccctagggttcaggtcggctaggtgggtaatgggacagtccttcactcnccacntcatcagccgtgacgcctagaagnttgtgacttagtttacttactgtacaactattacgtacgngtacggccggtccgggggacctacggtttccggaccgttacgggaaccgtaaaggggtcggaacgtacgttaaccgaaaacggtacgttacggtacggcgtaacggacctaaccgtacgttccgtacgtttacctttacgaccg

SEQ ID NO: 419719 - DNA, 545 bp, Homo sapiens
  misc_feature: GZ8MTXP02FLNMR.8.33.C11.1.454.CMB.2.raw
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagatgttggcgccttcgtaagctggtaccaacacaaacctggccaggcctcccaggccccctcatctatggtgcatccaatacgggccactggcactccccagcccaggttcagtcggcaggtgggtatggggacagtctcactctcaccatcatcagcctggacgcctagaagatagttgtctagtttattaactgtacaactatccgtacgagtcggccgtccgggggcctacgttccggccgtcgggaccgaacgggtggagactacgaaacgaacgtcggtgactgacacgactcgtcgtactctac

SEQ ID NO: 419720 - DNA, 593 bp, Homo sapiens
  misc_feature: GZ8MTXP02F2Y5E.8.33.C11.1.454.CMB.2.raw
  modified_base (300)..(300): a, c, t, g, unknown or other
  modified_base (311)..(311): a, c, t, g, unknown or other
  modified_base (418)..(418): a, c, t, g, unknown or other
  modified_base (428)..(428): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagaatgttggcgccttgtaagctggtaccaacacaaacctggccaggcctccccgaggccccctnatcctatggtncataccaaagtacgggacccacgtggccactccccgagcccaggttcaggtcggcaggtgggtatggggacagtcttcactctaccaccatcatcagcctgggaacnccgtagaagnttgtgactagtttattacgtgtactaactattaccgtaacgaggttccggcccggttccgggggcccttacgtttccggcccgtacgggaaccgaagggtgggaagtactacgaaaacgtaccgtggtcggactcgacgtaactcgtctacggttccttactacg

SEQ ID NO: 419721 - DNA, 664 bp, Homo sapiens
  misc_feature: GZ8MTXP02JH1AP.8.33.C11.1.454.CMB.2.raw
  modified_base (210)..(210): a, c, t, g, unknown or other
  modified_base (304)..(304): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagngccaccctctcctgcagggccagtcagatgttgcgccttgaagctggtaccaacacaaacctggccaggctcccaggcccctcatctatcggtncacaccaacgacggaccacgtcggcctactcccgacgtccgtaggttcaggtccggacgtaggtagggtagtcgggactagtccttccacttcctaccaacctatactatacacgtccgtggacgtacgtagaacgtacgttgttacgtacttagtttacttacttacgtactaacgtaacgtaccgttaccggtacggtccggtacccgggtacccgggggtacccgttaccggtttcccgggtacccgtacggggaaccggtaaacgggtacggaacggtaacgtaaaccgtaaaccggtacgttacggtacggaccgtaacgaccctaaccgtactcgttcgttaccgttactaccg

SEQ ID NO: 419722 - DNA, 550 bp, Homo sapiens
  misc_feature: GZ8MTXP02HWAYE.8.33.C11.1.454.CMB.2.raw
  modified_base (289)..(289): a, c, t, g, unknown or other
  modified_base (390)..(390): a, c, t, g, unknown or other
  modified_base (399)..(399): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgcttgagctgtaccaacacaactggccaggctcccaggcccctnactctatggtgcatccaatacgggccactggcatcccagccaggttcagtcggacagtgggtatgggacagcttcactctcacctatcatcagcctggacncctagaagntgttgctagtttattatgtacaactatacgtacgagtcggccgtccgggggacctacgtttccggcccgtacggggaccctaagggtcggagactacgaaaacgtacgtcggtacgctaacggcaacgtacgtcgtcgttactttctaccg

SEQ ID NO: 419723 - DNA, 680 bp, Homo sapiens
  misc_feature: GZ8MTXP02I4CS6.8.33.C11.1.454.CMB.2.raw
  modified_base (431)..(431): a, c, t, g, unknown or other
  modified_base (441)..(441): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccacctgtctttgtctccagggaaagagccaccctctcctgcagggccagtcagaatgttggcgccttcgtaagctggtaccaacacaaacctggccaggcctcccgacggcccctcatctagtggtgcactacccaagtacggggcccaacgtcgggaccactccccgagccgtaggttaccaggtcggcgtagggtggggtagtggggacagcctttcacttctaccacctatcatcagccgtaggacncctagaagtntgttgcttaagtttattactagtacaaactacgttaccgtaaccggtaggtccgggtccccggttaccccgggggtaccctaccggttttccccggggaccccgttacgggggaaacccgtaaagggggtacgggaaacgtaacgttaaacccgaaaaacgggtaaccgttcggggtacggaccgttaacggaaccaacccgtacgttccgtttacggttaccctttaccgttaacccg

SEQ ID NO: 419724 - DNA, 669 bp, Homo sapiens
  misc_feature: GZ8MTXP02H4WII.8.33.C11.1.454.CMB.2.raw
  modified_base (206)..(206): a, c, t, g, unknown or other
  modified_base (240)..(240): a, c, t, g, unknown or other
  modified_base (248)..(248): a, c, t, g, unknown or other
  modified_base (258)..(258): a, c, t, g, unknown or other
  modified_base (286)..(286): a, c, t, g, unknown or other
  modified_base (295)..(295): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctccagtttcagataccaccggagagattgtgttgacacagtctccagccaccctgtctttgctccaggggaaanagccaccctctcctgcagggccagtcagatgtgncttgtaanctgtaccaanacaactgccaggctcccaggccccctanatctagtgnacactaccgacgacggccacgtcgacactccagccgtaggtcaggtccggacgtagggtggtagtcgggaactacgtccttacaccttcctaccaaccgtactacactaccgacgccgtacggacgtaccgtagtaacgtagttagttacgtacgttacgtttaacttacgttacgttaaccgtaacgttacgttaccggtaccggtacggttccggtaccccgggtcccgggggtaccttaccggtttcccgggtacccggtacgggaaccggtaacgggtacggtacgtaaacgtaaaccgaaaccggtaacgtacggtacggaccgtaacgtaccgtaacctacgtacctttacgttaccgttacgtaccg

SEQ ID NO: 419725 - DNA, 503 bp, Homo sapiens
  misc_feature: GZ8MTXP02GSNX9.8.33.C11.1.454.CMB.2.raw
  modified_base (244)..(244): a, c, t, g, unknown or other
  modified_base (270)..(270): a, c, t, g, unknown or other
  modified_base (279)..(279): a, c, t, g, unknown or other
  modified_base (285)..(285): a, c, t, g, unknown or other
  modified_base (289)..(289): a, c, t, g, unknown or other
  modified_base (372)..(372): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcttgctactctggctcccagtttcagataccaccggagagattgtgttgacacagtctccagccaccctgtctttgtctccaggggaaagagccaccctctcctgcagggccagtcagatgtgcncttgagctgacaacacaactgcagcnccagccctnatctanggtncatccaacaggccactggcatcccagccaggttcagtgcagtgggtatgggacagcttcactctcaccatcatcagcctgacncctagaagatgttgctagtttattactgtacaacatcgtacgagtcgccgtccgggggccacgttcggccgtgggaccgtaacggtggagagtacgaaacgacgtagtcggctgcaccatctcgtcttctc

SEQ ID NO: 419726 - DNA, 612 bp, Homo sapiens
  misc_feature: GZ8MTXP02FQ3GB.8.33.C11.1.454.CMB.2.raw
  modified_base (250)..(250): a, c, t, g, unknown or other
  modified_base (301)..(301): a, c, t, g, unknown or other
  modified_base (312)..(312): a, c, t, g, unknown or other
  modified_base (320)..(320): a, c, t, g, unknown or other
  modified_base (541)..(541): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgttctttgtctccgaggggaaagacgccaccctctcctgcagggccagtcagaatgttggcnccttcgtaagctggtaccaacacaaacctggccaggctcccaggccccctnatctagtggtncatccaancgggccacgtggacactcccagcctaggttcaggtcggctaggtgggtatggggaccaggtcttcaactctaccaccatccgatcagcctggacgtcctagaagattgtagaccttagtttacttacgtgtactaacgtagtaccgtaaccggtagtccggggtcccgttccgggggccttaaccggtttccggaccccggtagggaacccggtaaagggnggaaacggtactaaccgaaaacggtaacgttgacgggtacctcgacctaactactcgtacgtcttacgtac

SEQ ID NO: 419727 - DNA, 560 bp, Homo sapiens
  misc_feature: GZ8MTXP02FWSLK.8.33.C11.1.454.CMB.2.raw
  modified_base (276)..(276): a, c, t, g, unknown or other
  modified_base (304)..(304): a, c, t, g, unknown or other
  modified_base (325)..(325): a, c, t, g, unknown or other
  modified_base (433)..(433): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctcctgtgcagcctcgtgggttcaccttnagtagctacggcatgcacgtgggtcccnccaaactccaggcaaggggtnttgggagtgggtggctaggtttgttacattccgtggagggctaggttgttacaagttggtatgctgacgcgtagacgggcattcacatctcagacacactcagaacanaatgtagtgactagaacacgactagtcgtgaggacgacggtatactatacgtaggtaacggaagggacgggggaacgaggacgggaacgttaccgaacgttacctcgtttacgacgtcggtacgggg

SEQ ID NO: 419728 - DNA, 606 bp, Homo sapiens
  misc_feature: GZ8MTXP02GVHZM.8.33.C11.1.454.CMB.2.raw
  modified_base (273)..(273): a, c, t, g, unknown or other
  modified_base (279)..(279): a, c, t, g, unknown or other
  modified_base (289)..(289): a, c, t, g, unknown or other
  modified_base (297)..(297): a, c, t, g, unknown or other
  modified_base (304)..(304): a, c, t, g, unknown or other
  modified_base (310)..(310): a, c, t, g, unknown or other
  modified_base (338)..(338): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaaggggaaagagccaccctctcctgcagggccagtcagaatgttggcgccttgaagctgaccaacacaaacngcagcncccagccctnatctatgncatcaanaggcangcactccagccagtcagtgcagtggtangggaacagcttcactctacacatcaatcacgccgtggacgcctagaagagttgttgtactaagtttacttaactgtacaaactacgtacgtaaccggaggtccgggtcccggtcccgggggtacccttaccggtttcccgggaccccgtacggggaaacccggtaagggtacgggaacgtaacgtaaacccgaaaaaccggtaacgtacggtacggtaccgtaacggacccgaaccctatcccgtttacgtttaccgttacgtaaccg

SEQ ID NO: 419729 - DNA, 562 bp, Homo sapiens
  misc_feature: GZ8MTXP02FS864.8.33.C11.1.454.CMB.2.raw
  modified_base (299)..(299): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagaatgttggcgccttcgtaagctggtaccaacacaaacctggccaggctcctacggccccctnatctatggtgcatccaatcgggccagtggcatccccagccaggttcagtcggcaggtgggtatggggacagcttcactctcaccatcatcagcctggacgcctagaagatgttgctagtttattacgtgtacaactataccgtacgagtcggccgtccgggggcctacgtttccggcccgtggggacccgtaagggtcggaagacgtacgaaaacgtacgtacggtggacgtaaggccacctactcgtcgttccttacgtacc

SEQ ID NO: 419730 - DNA, 520 bp, Homo sapiens
  misc_feature: GZ8MTXP02HT1J6.8.33.C11.1.454.CMB.2.raw
  modified_base (301)..(301): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacctgtctttgtctccaggggaaagagccaccctctcctgcagggccagtcagatgttgcgccttgaagctggtacaacacaaacctggccaggctcccaggcccctcatctatggtncatccaacagggccactggcatcccagccaggttcagtgcagtggtatgggacagcttcactctcaccatcatcagcctgacgcctgaaagattgttgctagtttattacttgtacaactatacgtacgagtcggccgtccgggggcctacgttcggccgtcggaccgaggtcggagacgtacgaaacgactcgtgctgcacctatctcgtcttactac

SEQ ID NO: 419731 - DNA, 733 bp, Homo sapiens
  misc_feature: GZ8MTXP02FW8AM.8.33.C11.1.454.CMB.2.raw
  modified_base (303)..(303): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagaatgttggcgccttcgtaagctggtacccaacacaaacctggccaggcctccccaggccccctanatctagtggtcacactaccaacgacgggcccacgtcggaccactcccgacgcccgtaggttcaggtccggacgtagggtagggtagtcggggaactacggtaccttccaccttcctaccaacctactaccactccgacgtccgtaggacgtcgtaagaagtgttaggttacgtacgttaagtttacttaacgtacgtaacctaaacgtacgttacccggtaaccgggtacggttccggggtaccccgggttcccgggggtaccctttaacccgggtttaccccggggacccgggttaaccgggggtaaaccggtaacggggttacgggaaacggtaaaccgtaaaccggaaaaccggtaccggttacgggtacgggtacctaacggtacccgtaacctacgttccgttacggttaccctttacgtaaccg

SEQ ID NO: 419732 - DNA, 536 bp, Homo sapiens
  misc_feature: GZ8MTXP02FJKW2.8.33.C11.1.454.CMB.2.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctccccaggccccctcatctatggtgcatccaaacaggggcccactggcactccccagccaggttcagtcggcagtgggtatggggacaggacttcacttctcaccatcatcagcctggacgcctgaagatgttgctagtttattactgtacaactatcgtaccgagtcgccgtccgggggccacgtttcggcccgtgggaccaaggtggagatacaaacgacgtcgtggctgcacgtactctcgtctactac

SEQ ID NO: 419733 - DNA, 741 bp, Homo sapiens
  misc_feature: GZ8MTXP02GU61Y.8.33.C11.1.454.CMB.2.raw
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctcctgtgcagcctcgtgggttcaccttcagtagctacggcatgcacgtgggtccaccaaactccgaggaccaaggggattgggaggtggggtggctaggtttgttcagtccgtggagggtcaggttcgttacgaagttggggtaatggccgttaggaccggtccggtagggaaacggggcccgtagttccgacctactcccgtacccgaagaacgaaccaaaccgtacccgaacggaaaccaaaccgtaaattcggttaacgtttacgggaacccttacggaaaccgtaacgtacccgttaaacggtccccgtaagggtaaccgggtaaccgtaaccgggggttacggttaacttaaccggttaaccggttacgggttaaacccgggaaagggggtaacggggggaaacccgaaggggtaccgggggtaacgttacccggaaacggtttacccgttacccgtttacgggtaaccggttccgggttaccggggg

SEQ ID NO: 419734 - DNA, 718 bp, Homo sapiens
  misc_feature: GZ8MTXP02ITKGX.8.33.C11.1.454.CMB.2.raw
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctcctgtgcagcctctgggttcaccttcagtacgctacggcatgcacgtgggtcccgaccaaactccgaggacaaggggattgggagtggggtggctagtttgttcatccgtggagggctaggttgttacaaagttgggtatcggacttgaccggtccggtaggaaacggggcccgtattccgaaccctactacccgtaccaggacgaaccaaccgtacccgaacgggaaaccaactaaagttacggttaagttttacgggaacccttacgggaaaacctacgtaacccgttaaacggtacccgttagggaaccgggtaaccgtaaccgggggttagttaaacgttaaccgttaccgttaacgggtaaacggggaaacgggggaacggggggaacccgaaggggacgggggtaacgttaacccggaacgttacccgttaccgtttacggaaccggttccgggtaccggggg

SEQ ID NO: 419735 - DNA, 690 bp, Homo sapiens
  misc_feature: GZ8MTXP02JUEQ7.8.33.C11.1.454.CMB.2.raw
  modified_base (208)..(208): a, c, t, g, unknown or other
  modified_base (297)..(297): a, c, t, g, unknown or other
  modified_base (309)..(309): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcgcttcgtaagctggtaccaacacaaacctggccaggcctcccaggccccctnatctagtggtcncataccaagtacggccacgtggcacgtcccagccgtaggttcaggtcggactaggtagggtactggggacagtaccttcacttctaccaacctatccatacacgtccgtggacgtccgtagaaacgtagtaggttacgtacgttaagttttaacgtttaacgttacgttaacctaaacgtacgttaccggtaaccggtacggttccgggtacccggttacccgggggtacccgttacccggtttcccgggtaccccggtacggggtaacccggtaaacggggtacgggaacggtaacgtaaaccggtaaaacggtaaccgtacggtacggaccgtaacggacccgtaaccgtacgttccgttacgttaccgtttacgtacg

SEQ ID NO: 419736 - DNA, 727 bp, Homo sapiens
  misc_feature: GZ8MTXP02F1FZY.8.33.C11.1.454.CMB.2.raw
  modified_base (334)..(334): a, c, t, g, unknown or other
tcagctcgcgtgtccacgaccggtgctcgatttagagtgagctcgtggggagaggagcccagcactagaagtcggcggtgtttccattcggtgatcagcactgaacacagaggactcaccatggagtttgggaaaaactgaactgggttttcctcgttgctacttttaagaggtgtccagtgtcaagtgcaacgtggtggagtcgtgggggaggcgtagtccagcctgggaggtcacagagactctcctgtgcagcctctgggtcaccttcagtagctacggcagtcgctacgtcggggtccccaccaaaacgtccgagggaccgaaaggggtntttaggggaggttggggtagtaccgtaggttttcggtttcagttccggtagggacggggtccctaagggttcttacgaaagttgggtaacttcggcgttacgggacccgtcggttacggaacggggccctaaacttcccaaccgtattcccgaccgaaggacaaccaacctacccgaaaggaaactacgaaagttcgttacgttcggaaccttaggaaacctacgtaccgttaaagtcccgtaggaaccggacgtacggggtatacgtaacgtaccgttagggaaccgggaaagggggacgggggaaaccaggggtaccgggtaaacttaccggtaaaaggtaaccttccgtttagaccgggttcgtacgggggccctaacggggttaccccg

SEQ ID NO: 419737 - DNA, 544 bp, Homo sapiens
  misc_feature: GZ8MTXP02G2F1U.8.33.C11.1.454.CMB.2.raw
  modified_base (209)..(209): a, c, t, g, unknown or other
  modified_base (290)..(290): a, c, t, g, unknown or other
  modified_base (300)..(300): a, c, t, g, unknown or other
  modified_base (310)..(310): a, c, t, g, unknown or other
  modified_base (370)..(370): a, c, t, g, unknown or other
  modified_base (390)..(390): a, c, t, g, unknown or other
  modified_base (405)..(405): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccacctctcctgcagggccagtcagaatgtggcgcttgtaagctggtaccaacacaactggccaggctcccagcccctnatctatggtncatccaaacngggccacgtggcactcccagccaggtcagtcggcagtgggatggggacagtcttcactcncaccatcatcagcctggacncctagaacgatggtnactagtttattactgtactacagtccgtacgagtcgccgtccgggggcctacgtttccgggaccctggggaaccctaagggtcggtaagacgtacgaaaacgtacgtaggtcgctaagccaacgtctcgtctcttctac

SEQ ID NO: 419738 - DNA, 546 bp, Homo sapiens
  misc_feature: GZ8MTXP02JGNXR.8.33.C11.1.454.CMB.2.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaaacaggggcccactggcatcccagcccaggttcagtcggcaggtgggtatggggacagcttcactctcaccatcatcagcctgacgcctagaagatgttgctagtttattactgttacaaactatacgtaccgagtcggccgtccgggggtcctacgttccggcccgtcgggaccgtaacggtcggagtacgtacgaaacgacgtcgtacgctcgcacactcgtcgtctctac

SEQ ID NO: 419739 - DNA, 610 bp, Homo sapiens
  misc_feature: GZ8MTXP02H2DFC.8.33.C11.1.454.CMB.2.raw
  modified_base (209)..(209): a, c, t, g, unknown or other
  modified_base (270)..(270): a, c, t, g, unknown or other
  modified_base (280)..(280): a, c, t, g, unknown or other
  modified_base (300)..(300): a, c, t, g, unknown or other
  modified_base (369)..(369): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccacctgtctttgctccgaggggaaangccaccctctcctgcagggccagtcagatgtgcgcttgagctgtacacacaactgccagcnccaggccctnatctatggtgcatccaacgngggccacgtggcactcccagccaggttcagtcggcagtgggatgggacagtcttcactcctacacctancatcaagcctggacgcccgtagaagtattgttcggacttagtttattacgttagttacaaactagtaccgtaaccggagtcgggtcccgtccgggggtccctaccgtttccgggacccgttacggggaccgtaacggggtacgggacggtaacgttaaccgaaaacggtacgtacgggttaacggccgttaacgggacctaaacccgtacttaccgttcggtttacctttaaccgttcccg

SEQ ID NO: 419740 - DNA, 663 bp, Homo sapiens
  misc_feature: GZ8MTXP02GVZEX.8.33.C11.1.454.CMB.2.raw
  modified_base (210)..(210): a, c, t, g, unknown or other
  modified_base (245)..(245): a, c, t, g, unknown or other
  modified_base (260)..(260): a, c, t, g, unknown or other
  modified_base (287)..(287): a, c, t, g, unknown or other
  modified_base (297)..(297): a, c, t, g, unknown or other
  modified_base (309)..(309): a, c, t, g, unknown or other
  modified_base (377)..(377): a, c, t, g, unknown or other
tcagctcgcgtgtccacgaccggtgctcgatttagagtgagctcgttgggtttgggggaggaactgctcagttaggacccaggagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagatgtgcncttgagctgaccaanacaactggccaggctcccaggcccctnatctatggtncatcccaaacgnggggcccacgtggaccactccccgagcctaggttcaggtcggcaggtggatggggacagcttcactcncaccatcatcagccctaggacgcccttaggaaacgtagttggttacgtaccgttaaggtttttaacttaccgttacggttaacctaaacgttacgttaccggttaacccgggtaacggttccggggtaccccggttcccggggggtacccttaacccggttttcccggggaccccgtttacgggggaaccccgtaaggggttcgggaacgtaacgttaccgaaaacggtaccgttcggtacggcctaacggacctaccgtacgttccgtacgttccttacgtaccg

SEQ ID NO: 419741 - DNA, 600 bp, Homo sapiens
  misc_feature: GZ8MTXP02GFHBB.8.33.C11.1.454.CMB.2.raw
  modified_base (322)..(322): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggaggtcacagagactctcctgtgcagcctcgtgggttcaccttcagtgctacggcatgcacgtggtcccgccaaactccaggcaagggnttggagtgggtggcagttgttcatcctgaggctagtgttcaagtggtatgctgcgcgtggacggcgattcacatctaccagacgacaactccaagaacataatgtatttggacctagaaccacgtacctaagtccgtagacggacgtacgggtacgtaactacgttacgtacggtaaacgggaaacggggacgggggaaacccgaggggtaccggggtaacgttacccgtaaacggttacccgttaccgtttacggtaccggttacggtacccggggg

SEQ ID NO: 419742 - DNA, 560 bp, Homo sapiens
  misc_feature: GZ8MTXP02H3GO3.8.33.C11.1.454.CMB.2.raw
  modified_base (394)..(394): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggagcgtagtcagcctgggaggtcacagagactctcctgtgcagcctctgggttcaccttcagtagctacggcatgcactgggtcccaccaaactccaggcaagggattggagtgggtgcagtttgttcatcctgagggtcagttgtcaatggtatgctgcgcgtgagggcgatcacanctcagacgacaactcagaacacaatagtatttgactagaacagcctaacgtccgtagacggacgacgggtagtaactacgtaacgtcggtaaacggaaggggacgggggaaccagggacgggtaagtaccgaaacgtaccgtcgtttacgtacggtcgtaccgggg

SEQ ID NO: 419743 - DNA, 611 bp, Homo sapiens
  misc_feature: GZ8MTXP02HJ57H.8.33.C11.1.454.CMB.2.raw
  modified_base (183)..(183): a, c, t, g, unknown or other
  modified_base (301)..(301): a, c, t, g, unknown or other
  modified_base (312)..(312): a, c, t, g, unknown or other
  modified_base (410)..(410): a, c, t, g, unknown or other
  modified_base (417)..(417): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccacggagagattgtgtttacacagtctccagccnccctgttctttgtctccgaaggggaaagacgccaccctctcctgcaggccagtcagaatgttggctcttcgtaagctggtaccaacacaaacctggaccaggcctcccacggcccctnactctatggtncactccaaacgacgggccacgtggcactcccagccaggttcaggtgccgtaggtggtagtgggacagacttcactcacaccatcatcacgctaggacncagagtntgtgattagtttactactgtacaatacgttacgtacggcgggtccgggcccggtcccggggaccttaccgggttcccgggaccccggtaggggtaaaccgtaaggggtcggaacgtacgtaaacgaaaacggtacgtacggacggtacgtacgaaccgtactacgttcctacgtttccttacctaccgttcccg

SEQ ID NO: 419744 - DNA, 686 bp, Homo sapiens
  misc_feature: GZ8MTXP02ICNTJ.8.33.C11.1.454.CMB.2.raw
  modified_base (209)..(209): a, c, t, g, unknown or other
  modified_base (262)..(262): a, c, t, g, unknown or other
  modified_base (287)..(287): a, c, t, g, unknown or other
  modified_base (296)..(296): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagccaccctctcctgcagggccagtcagaatgtgcgcttgaagctgtaccaanacaactggccagctcccagcccctnatctagtgncataccgaagtacggccacgtcgacactcccagaccgtaggtcaggtcggacgtaggggtagggtagtgggactacgtaccttcaacctcctaccaacctataccgaactaccgacgtccgtaggacgtaccgtaagtaaagtagttacgttagtacgttagtttaacttacgttacgtaactaaacgtacgttaccggtaccggtacggtccgggtacccgggttacccggggtacccgttaccgggtttcccgggacccgggtaacggggtaaacccggtaaacggggtacggtaacggtaaacgtaaaccggtaaaaccggtacgtacggtacggtacgtaacggtactaaccgtacgttccgttacgtttaccgtttacgtaaccg

SEQ ID NO: 419745 - DNA, 536 bp, Homo sapiens
  misc_feature: GZ8MTXP02IR24K.8.33.C11.1.454.CMB.2.raw
  modified_base (295)..(295): a, c, t, g, unknown or other
  modified_base (305)..(305): a, c, t, g, unknown or other
  modified_base (314)..(314): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgcttgaagctggtaccaacacaaacctggccaggcctcccaggcccctnatctatggtncatccaacncgggccactggcatcccagccaggttcagtcgcaggtggtatgggacagcttcactctcaccatcatcagcctggacgcctagaagatgttagactagtttattactgttacaactatcgtaccgagtcggccgtccgggggcctacggttccggccgtgggaacctagggtggagactacgaaacgtactggtacgctcgcaccactctcgtcttactacc

SEQ ID NO: 419746 - DNA, 574 bp, Homo sapiens
  misc_feature: GZ8MTXP02G0N9M.8.33.C11.1.454.CMB.2.raw
  modified_base (209)..(209): a, c, t, g, unknown or other
  modified_base (243)..(243): a, c, t, g, unknown or other
  modified_base (257)..(257): a, c, t, g, unknown or other
  modified_base (262)..(262): a, c, t, g, unknown or other
  modified_base (268)..(268): a, c, t, g, unknown or other
  modified_base (271)..(271): a, c, t, g, unknown or other
  modified_base (276)..(276): a, c, t, g, unknown or other
  modified_base (280)..(281): a, c, t, g, unknown or other
  modified_base (283)..(283): a, c, t, g, unknown or other
  modified_base (286)..(286): a, c, t, g, unknown or other
  modified_base (289)..(289): a, c, t, g, unknown or other
  modified_base (293)..(294): a, c, t, g, unknown or other
  modified_base (320)..(320): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaanagccaccctctcctgcaggccagtcagatgtgcncttgagctgacaancaacngcagcnccngcccnatcnngncancanggcnngctccagcagtcagtgcaggtggtangggacagtactcacttcactaccatcgatcacgtccgtaggacgaccgttaggaagtagttggttcgtacgttaagtttacttacgttaggtaacctaaacgtacgttaccggtaaccggtagggttccgggtacccggtcccggggggtaccctacgggttttcccgggcccggttacggggaccgtaagggtacggagaacgtacgaaaacggacgtggtacggctaggcacctatctgtctcactttcccg

SEQ ID NO: 419747 - DNA, 558 bp, Homo sapiens
  misc_feature: GZ8MTXP02G48AY.8.33.C11.1.454.CMB.2.raw
  modified_base (209)..(209): a, c, t, g, unknown or other
  modified_base (245)..(245): a, c, t, g, unknown or other
  modified_base (296)..(296): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagatgttgcnccttgtaagctggtaccaacacaaacctggccaggctccccaggccccctnatctatggtgcatccaacagggccactggcatccccagccaggttcagtcggcaggtgggtatgggacagacttcactctcaccatcatcagcccgtggacgcctagaacgtatgttgactagtttattactgtacaactatcgtacgagtcggccgtccgggggctacgttccggcccgtagggacccgtaaagggtcggagacgtacgaaaacgtacgtcggtaggctcggacaccgtactccgtcgttccttactaccg

SEQ ID NO: 419748 - DNA, 554 bp, Homo sapiens
  misc_feature: GZ8MTXP02HM1Q2.8.33.C11.1.454.CMB.2.raw
  modified_base (324)..(324): a, c, t, g, unknown or other
  modified_base (406)..(406): a, c, t, g, unknown or other
  modified_base (412)..(412): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtagtccagcctggggagtcacagagactctcctgtgcagcctcgtgggttccaccttcagtagctaggcatgcacgtgggtcccaccaaactccaggcaaggggnttggagtgggtggctagtttgttcatccgtgaggcagttgttcaatggtatgctgacgcgtgaacggcatcacatctcaganacaacncagaacacaatgtatttgacctagaacagacctaagtcctagaggacgacgggtagtactactatacggtaacggaagggacgggggaaccgaggacgggaacgttaccgaacgtacgtaccgttcgacgtacggtacgggg

SEQ ID NO: 419749 - DNA, 648 bp, Homo sapiens
  misc_feature: GZ8MTXP02HCWY4.8.33.C11.1.454.CMB.2.raw
  modified_base (211)..(211): a, c, t, g, unknown or other
  modified_base (245)..(245): a, c, t, g, unknown or other
  modified_base (251)..(251): a, c, t, g, unknown or other
  modified_base (259)..(259): a, c, t, g, unknown or other
  modified_base (265)..(265): a, c, t, g, unknown or other
  modified_base (281)..(281): a, c, t, g, unknown or other
  modified_base (291)..(291): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagngccaccctctcctgcagggccagtcagatgtgcncttganctgtacanacaacngcagctccagcccctnatctatggtncatcccaacgacgggccacgtggccactcccagcctaggttcaggtcggcaggtcgggtagtcggggaacacggtactttcaacttcctaccaaccatccaatccacgtcccgtagggacgccgtagaaagtcttggttcgtacgttaagttttattaacgttgttaaccaaacgttacgttaccggtaacccgggtaggttccgggaccccggtccgggggtaccccttacggtttcccgggacccgtttacgggggaacccgtaaaggggttcggaagtaacgtaccgtaaaaccggtacgtgggtcggcttaacggaccctaaccgtacttcgttaccttacgtttactacccg

SEQ ID NO: 419750 - DNA, 558 bp, Homo sapiens
  misc_feature: GZ8MTXP02FYUR4.8.33.C11.1.454.CMB.2.raw
  modified_base (248)..(248): a, c, t, g, unknown or other
  modified_base (297)..(297): a, c, t, g, unknown or other
  modified_base (408)..(408): a, c, t, g, unknown or other
  modified_base (495)..(495): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgttctttgtctccgaggggaaagacgccaccctctcctgcagggccagtcagatgttggcnccttgtaagctggtaccaacacaaacctggccaggctcccaggcccctnatctatggtgcataccaagtacgggccacgtggacctactcccaagccaggttcaggtgcaggtgggtatggggacagtcttcactctaccaccatcatcagcctaggacnctagagattgtgactagttacttacgtgtacaactatccgttacggagtcggccgtcggggcctacgttcggccgtggacgtacggngagactacgaaacgtacgtcggcggtactcggaccaaccgtactcgtacgttccttactaccg

SEQ ID NO: 419751 - DNA, 564 bp, Homo sapiens
  misc_feature: GZ8MTXP02HAW69.8.33.C11.1.454.CMB.2.raw
  modified_base (209)..(209): a, c, t, g, unknown or other
  modified_base (244)..(244): a, c, t, g, unknown or other
  modified_base (265)..(265): a, c, t, g, unknown or other
  modified_base (280)..(280): a, c, t, g, unknown or other
  modified_base (395)..(395): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagccaccctctcctgcagggccagtcagatgtgcncttgagctgtacaacacaacngcagctccagccccnatctatggtgcatccaagtagggccacgtggaccactccccagaccaggttcaggtcggcaggtgggtatggggacaggcttcactctcaccatcatcagcctggacgctagaantgtcgctagtttatactgacaactataccgtacgagtcggaccgtccggggcctacgtttccggcccgtagggacccgtaaagggtcgggaagacgtaacgaaaacggtacgtacggtcggaccttggaccgtaacccgtagttccctacggttactttccgttaaccg

SEQ ID NO: 419752 - DNA, 560 bp, Homo sapiens
  misc_feature: GZ8MTXP02JMZLL.8.33.C11.1.454.CMB.2.raw
  modified_base (209)..(209): a, c, t, g, unknown or other
  modified_base (243)..(243): a, c, t, g, unknown or other
  modified_base (248)..(248): a, c, t, g, unknown or other
  modified_base (255)..(255): a, c, t, g, unknown or other
  modified_base (276)..(276): a, c, t, g, unknown or other
  modified_base (286)..(286): a, c, t, g, unknown or other
  modified_base (295)..(295): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcagggccagtcagatgtgcnctganctgacanacaactgcagctccagccctnatctatggtncactccaanggccatggacactcccagcctaggttcagtcggctaggtggtatggggacagtcttcactctacacctagtccatcagtcccgtaggacgcctaggaaagtagttggttgacttagtttattactgtactaaacgtgttacgtaccggtaagttcggcccggtaccgggggcctacgttccggacccgtagggaacccgtaagggtcggagtaacgtacgaaaacgtacgtcgtacgacgtgactaccatcctcgttcctctacc

SEQ ID NO: 419753 - DNA, 551 bp, Homo sapiens
  misc_feature: GZ8MTXP02FTED1.8.33.C11.1.454.CMB.2.raw
  modified_base (210)..(210): a, c, t, g, unknown or other
  modified_base (286)..(286): a, c, t, g, unknown or other
  modified_base (292)..(292): a, c, t, g, unknown or other
  modified_base (296)..(296): a, c, t, g, unknown or other
  modified_base (304)..(304): a, c, t, g, unknown or other
  modified_base (379)..(379): a, c, t, g, unknown or other
  modified_base (387)..(387): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagccaccctctcctgcagggccagtcagatgttgcgccttgaagctgacaacacaactggcagctcccagcccctnatctanggtncatccaanggccactggcatcccagccaggttcagtcgcagtgggtatgggacagctcactcacaccatcatcagcctggacncctagaanatgttgacttagtttattacgtgtactaactactcgtaaccgtaggtccggcccggtaccgggggtcctacgtttccggacccgtggggaacccaaggggttcggaatacgtaaccgaaaacgtacgtaggtcggactggactaccgatctcgtccttctaccg

SEQ ID NO: 419754 - DNA, 519 bp, Homo sapiens
  misc_feature: GZ8MTXP02IVY78.8.33.C11.1.454.CMB.2.raw
  modified_base (208)..(208): a, c, t, g, unknown or other
  modified_base (243)..(243): a, c, t, g, unknown or other
  modified_base (249)..(249): a, c, t, g, unknown or other
  modified_base (256)..(256): a, c, t, g, unknown or other
  modified_base (258)..(258): a, c, t, g, unknown or other
  modified_base (277)..(278): a, c, t, g, unknown or other
  modified_base (282)..(282): a, c, t, g, unknown or other
  modified_base (284)..(286): a, c, t, g, unknown or other
  modified_base (289)..(289): a, c, t, g, unknown or other
  modified_base (292)..(293): a, c, t, g, unknown or other
  modified_base (296)..(297): a, c, t, g, unknown or other
  modified_base (301)..(301): a, c, t, g, unknown or other
  modified_base (303)..(303): a, c, t, g, unknown or other
  modified_base (306)..(306): a, c, t, g, unknown or other
  modified_base (310)..(310): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcagggccagtcagatgttgcncttganctgacananaactgcagctccagccctnntcangnnncangcnngcnnccancngtngcgnagtggatggacagcttcactcacacatcatcacgcctgacgctagaagtatgtgactagtttacttacgtgtactaactagtaccgtacgacgtcggccggtccggggtacctacggttccggtccgtacgggaccgtaacgggtcggagtacgtaacgaaacgtacgtacggtcgtacgtcgaccacgtactcgtacgttcttactcg

SEQ ID NO: 419755 - DNA, 514 bp, Homo sapiens
  misc_feature: GZ8MTXP02IS9OY.8.33.C11.1.454.CMB.2.raw
  modified_base (210)..(210): a, c, t, g, unknown or other
  modified_base (263)..(263): a, c, t, g, unknown or other
  modified_base (270)..(270): a, c, t, g, unknown or other
  modified_base (277)..(277): a, c, t, g, unknown or other
  modified_base (298)..(298): a, c, t, g, unknown or other
  modified_base (348)..(348): a, c, t, g, unknown or other
  modified_base (403)..(403): a, c, t, g, unknown or other
  modified_base (419)..(419): a, c, t, g, unknown or other
  modified_base (472)..(472): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccagggggaaangccaccctctcctgcagggccagtcagaatgttgcgcttgaagctggtacaanacaaccnggcagcncccagcccctcatctatggtncatccaacaggccatggcatcccagccaggtcagtgcagtggatgggacngcttcactctcaccatcaatcagccctggacgcctagaagatgttgactagtttnttactgttacaaactntccgtacgagtcgccgtccgggggctacgtttcggacctgggaccctaagggngagactacgaaacgacgtgtggctgccacactctgtctctac

SEQ ID NO: 419756 - DNA, 698 bp, Homo sapiens
  misc_feature: GZ8MTXP02G2KC7.8.33.C11.1.454.CMB.2.raw
  modified_base (209)..(209): a, c, t, g, unknown or other
  modified_base (389)..(389): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgtggcgccttgtaagctggtacaacacaaacctggccaggcctcccacggcccctcatctatggtgcatcccaacgacgggccacgtggaccactcccacgcctaggttcaggtcggcgaggtgggtatggggacagtccttcacttcncaccatcactcagtcccgtggacgcctaggaaagtacttggttacgtaccgttaagttttaacttacgttacggttaaccaaacgttacgttaccggttaacccggtaaggttcccggggtaccccgggttccccggggggtacccttaacccgggtttccccgggtacccggggtacgggggtaaacccgtaacgggggtacggggtaaacggtaacgttaaaccggaaaaaccggtaccgttacgggttcggaccgtaacggtacccaaccggtacttcgtttaccggttcctttaccgttaacccg

SEQ ID NO: 419757 - DNA, 661 bp, Homo sapiens
  misc_feature: GZ8MTXP02F07SU.8.33.C11.1.454.CMB.2.raw
  modified_base (209)..(209): a, c, t, g, unknown or other
  modified_base (296)..(296): a, c, t, g, unknown or other
  modified_base (305)..(305): a, c, t, g, unknown or other
  modified_base (314)..(314): a, c, t, g, unknown or other
  modified_base (423)..(423): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcgccttgtaagctggtaaccaacacaaacctggccaggctcccagcccctnatcatggtncatccaaancgggccaacgtggaccactccccagaccccgtaggttccaggtcggacctaggtaggggtatggggaaccagggtacttcactctacaccaatcatcagtcctaggacnccttagaaagattgttacgataagtttacttactagttacaaaactatccggtaaccgaggttccgggacccggttcccggggggtacccttaccggtttcccgggaccccgttacgggggaaccccgtaaaaggggttcgggaaacggtaacttaaacccgaaaaaacggtccgttaggtacggtaccttaacggacctaaaccccgtactccgtttacggtcctttacttaacccg

SEQ ID NO: 419758 - DNA, 542 bp, Homo sapiens
  misc_feature: GZ8MTXP02FQXGU.8.33.C11.1.454.CMB.2.raw
  modified_base (303)..(303): a, c, t, g, unknown or other
  modified_base (385)..(385): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagatgttggcgccttcgtaagctggtaccaacacaaacctggccaggctccccaggccccctcatctanggtgcatccaatagggccactggcatcccagccaggttcagtcggcagtggtatgggacagcttcactctcaccatcatcancctggagcctgaagatgttgctagtttattaactgttcaactatcgtaccgagtcggcccgtccgggggtcccacgtttccggcccctggggacccaaagggtcggagtactacgaaaacgaacgtggtaggactcgcacctatcctgtcttctacc

SEQ ID NO: 419759 - DNA, 604 bp, Homo sapiens
  misc_feature: GZ8MTXP02F7PMC.8.33.C11.1.454.CMB.2.raw
  modified_base (210)..(210): a, c, t, g, unknown or other
  modified_base (246)..(246): a, c, t, g, unknown or other
  modified_base (262)..(262): a, c, t, g, unknown or other
  modified_base (274)..(274): a, c, t, g, unknown or other
  modified_base (283)..(283): a, c, t, g, unknown or other
  modified_base (291)..(291): a, c, t, g, unknown or other
  modified_base (299)..(299): a, c, t, g, unknown or other
  modified_base (389)..(389): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaangccaccctctcctgcagggccagtcagatgttggcnccttgaagctgtacanacaactgcagcnccagccccnatcatgtncatccaanggccactggcatcccagccaggttcagtcggactaggtgggtatggggaacagtccttcacgttctaccaccatccatcagcctaggacncctagaaagattggttagacttagtttacttaacgtgtaacaaactagttccgtaacggaggtacggcccggtccgggggaccctacggtttcccgggacccgtagggggaccctaaaagggtcggaaacggtacgtaaccgaaaacggtacctacgggtacggaccgtcggaccctaaccgaacgtttccgtacggtaccctttacgtaacccg

SEQ ID NO: 419760 - DNA, 536 bp, Homo sapiens
  misc_feature: GZ8MTXP02IZE0V.8.33.C11.1.454.CMB.2.raw
  modified_base (299)..(299): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaagagccacctctcctgcagggccagtcagatgttgcgccttgaagctggtaccaacacaaactggccaggctcccaggcccctcatctatggtncatccaataggccactggccatcccagccaggttcagtcggcagtgggtatggggacagacttcactctacaccatcatcagcctgagctgaagattgttgctagtttattactgtacaactatccgtacgagttcggccgtccgggggtcctacgtttcggacccgtgggaccaagggtcggaagtactacgaaaacgtactacggtggacgtgccacactctcgttcttactacg

SEQ ID NO: 419761 - DNA, 575 bp, Homo sapiens
  misc_feature: GZ8MTXP02IV1UP.8.33.C11.1.454.CMB.2.raw
  modified_base (239)..(239): a, c, t, g, unknown or other
  modified_base (245)..(245): a, c, t, g, unknown or other
  modified_base (252)..(252): a, c, t, g, unknown or other
  modified_base (258)..(258): a, c, t, g, unknown or other
  modified_base (264)..(264): a, c, t, g, unknown or other
  modified_base (266)..(266): a, c, t, g, unknown or other
  modified_base (270)..(271): a, c, t, g, unknown or other
  modified_base (273)..(274): a, c, t, g, unknown or other
  modified_base (276)..(278): a, c, t, g, unknown or other
  modified_base (281)..(281): a, c, t, g, unknown or other
  modified_base (284)..(285): a, c, t, g, unknown or other
  modified_base (287)..(288): a, c, t, g, unknown or other
  modified_base (291)..(292): a, c, t, g, unknown or other
  modified_base (294)..(294): a, c, t, g, unknown or other
  modified_base (302)..(302): a, c, t, g, unknown or other
  modified_base (309)..(309): a, c, t, g, unknown or other
  modified_base (329)..(329): a, c, t, g, unknown or other
  modified_base (344)..(344): a, c, t, g, unknown or other
  modified_base (354)..(354): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacctgtctttgctccagggaagagccacctctcctgcagggccagtcagatgtgcncttganctgacanacaacngcagcncngccnntnngnnncangcnngnnccnncngtcagtgnagtgganggacagcttcactctcaccntcatcagcctggacncctagaagtntgttgacttagtttaattaccgttgtacctaaacgtagttacccgtaccggtaggttccgggaccccgttcccgggggtaccctaccggttttcccggggaccccgtttacgggggaaacccgtaggggtacggaaacggtacttaaaccggaaaacggtacgtcggttacggacttcggaccctaaccgtacttccgtacggtttcctttaaccgttccg

SEQ ID NO: 419762 - DNA, 532 bp, Homo sapiens
  misc_feature: GZ8MTXP02IST48.8.33.C11.1.454.CMB.2.raw
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtagtccagcctgggaggtcacagagactctcctgtgcagcctctgggttcaccttcagtagctacggcatgcacgtgggtccgccaaactccaggcaagggattggagtgggtgcagttgttcatccgtgaggcagtgttcaatggtatgctgacgcgtgacggcgatcacatctcagacgacactaccagaacacaatgtattgactagaacacgctaacgtctagaggacgacggtgtaactactacgtcgtaacggaagggacgggggaacaggacggaagtacgaagtactacgtcgacgtcgtcgggg

SEQ ID NO: 419763 - DNA, 572 bp, Homo sapiens
  misc_feature: GZ8MTXP02JW2U2.8.33.C11.1.454.CMB.2.raw
  modified_base (247)..(247): a, c, t, g, unknown or other
  modified_base (299)..(299): a, c, t, g, unknown or other
  modified_base (309)..(309): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcnccttcgtaagctggtaccaacacaaacctggccaggcctcccaggccccctnatctatggtncatcccaacgaggggcccacgtggccactccccagcccaggttccaggtcggcaggtgggtatggggacaggcttcactctcaccatcatcacgcctggacgcctagaagattggttagtactagtttaacttactgtaccaactacgttacgtaccggtagtcgggacccggtcccgggggtcctacgttccggccgtcgggaccgtacgggtcggagacgtacgaaacgacgtcgtacggctcgcacactctcgtctctac

SEQ ID NO: 419764 - DNA, 538 bp, Homo sapiens
  misc_feature: GZ8MTXP02JSD0F.8.33.C11.1.454.CMB.2.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacaggggcccacgtggcatcccagccaggttcagtcggcagtgggtatgggacagcttcactctcacatcatcagcctgacgcctgaagatgttgctagtttattactgtacaactatcgtaccgagtcggccgtccgggggcctacgtttccggcccgtgggaccgaagggtcggagacgtacgaaacgtaacgtgtggactgacaccactctcgtcttactac

SEQ ID NO: 419765 - DNA, 522 bp, Homo sapiens
  misc_feature: GZ8MTXP02HXKWK.8.33.C11.1.454.CMB.2.raw
  modified_base (209)..(209): a, c, t, g, unknown or other
  modified_base (244)..(244): a, c, t, g, unknown or other
  modified_base (251)..(251): a, c, t, g, unknown or other
  modified_base (264)..(264): a, c, t, g, unknown or other
  modified_base (270)..(270): a, c, t, g, unknown or other
  modified_base (279)..(279): a, c, t, g, unknown or other
  modified_base (289)..(289): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagatgtgcncttcganctgacacacaacngcagcnccagccctnatctatggtncatccaaacgagggccacgtggcatcccagccaggttcaggtcggcaggtgggtatggggacagcttcactctcaccatcatcagccgtggacgcctagaagtatgttgctagtttattacttgtacaactatacgtaccgagtcggccgtccgggggcctacgttccggccgtcgggaccgaggtggagactacgaaacgtacgtgacgctcgcactactctcgtcttctac

SEQ ID NO: 419766 - DNA, 552 bp, Homo sapiens
  misc_feature: GZ8MTXP02GDOYG.8.33.C11.1.454.CMB.2.raw
  modified_base (322)..(322): a, c, t, g, unknown or other
  modified_base (373)..(373): a, c, t, g, unknown or other
  modified_base (401)..(401): a, c, t, g, unknown or other
  modified_base (412)..(412): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtagtccagcctgggaggtcacagagactctcctgtgcagcctctgggttcaccttcagtagctacggcatgcacgtgggtcccaccaaactccaggcaagggnttggagtggggtgctagttgttcatccgtggaggcagtgttcaagtggtangctgacgcgtggaacgggcatcacatcncagacacaacncagaacacaatgtattgactagaacagacctaagtcctgagacgacgggtatactactacgtagtaacggaaggggacgggggaaccagggacgggaacgttaccgaacgttacctaccgttacgacgtcggtacggggg

SEQ ID NO: 419767 - DNA, 582 bp, Homo sapiens
  misc_feature: GZ8MTXP02HCNMF.8.33.C11.1.454.CMB.2.raw
  modified_base (303)..(303): a, c, t, g, unknown or other
  modified_base (322)..(322): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggaggtcacagagactctcctgtgcagcctctgggttcaccttcagtagctacggcatgcacgtgggtccnccaaactccaggcaagggntggagtgggtgctagttgttcatccgtgagggcagttgtcaagtggtatgctgacgcgtagacgggcgatcacatctccagacgacaactccagaacacaatgtatttgacctagaacacgacctaagtccgtaggacggacgtacgggtagtaactacgtacgtacggtaaacgggaaaggggtacgggggaaccgaggacggggtaacgttaccgaaacgttaccgttaccgtttacggtacggttcggtaccggggg

SEQ ID NO: 419768 - DNA, 533 bp, Homo sapiens
  misc_feature: GZ8MTXP02FZ8C3.8.33.C11.1.454.CMB.2.raw
  modified_base (210)..(210): a, c, t, g, unknown or other
  modified_base (397)..(397): a, c, t, g, unknown or other
  modified_base (435)..(435): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagccaccctctcctgcagggccagtcagaatgttggcgccttgtaagctggtaccaacacaaacctggccaggctcccaggcccctcatctatggtgcatccaacagggccacgtggcatcccagccaggttcagtcggcagtgggtatggggacagcttcactctcaccatcatcagccctggacncctagaacgattgttgctagtttattactgtacaactntacgtaccgagtcggccgtccggggcctacgttcggccgtgggaccgaaggtggagactacgaaacgaacgtgtgacgtgacaccgatctgtctctac

SEQ ID NO: 419769 - DNA, 575 bp, Homo sapiens
  misc_feature: GZ8MTXP02IRSNB.8.33.C11.1.454.CMB.2.raw
  modified_base (209)..(209): a, c, t, g, unknown or other
  modified_base (243)..(243): a, c, t, g, unknown or other
  modified_base (258)..(258): a, c, t, g, unknown or other
  modified_base (264)..(264): a, c, t, g, unknown or other
  modified_base (279)..(279): a, c, t, g, unknown or other
  modified_base (288)..(288): a, c, t, g, unknown or other
  modified_base (337)..(337): a, c, t, g, unknown or other
  modified_base (343)..(343): a, c, t, g, unknown or other
  modified_base (361)..(361): a, c, t, g, unknown or other
  modified_base (389)..(389): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaanagccaccctctcctgcaggccagtcagatgtgcncttgaagctgacaanacaacngcagctccagccctnatcatggtncatccaacaggcacgtggcatcccagccaggttcagtggcaggtggtangggacngtacttcatctcaacctntcatcacgccgtaggacgcgtagaagtntgttagtacttagtttacttacgtgtaactacgtacgtaccggtacggtacggtccggtcccggtaccggggtacctaccggttccggaccgtacggggaaccgtaacgggtacggaagtaacgtaacgaaaccggtacgtcggtcggacgtaacgacctacgtacgttccgtcgttcctactacg

SEQ ID NO: 419770 - DNA, 637 bp, Homo sapiens
  misc_feature: GZ8MTXP02I91QG.8.33.C11.1.454.CMB.2.raw
  modified_base (208)..(208): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagcccaccctgtctttgtctccgagggaangccaccctctcctgcaggccagtcagatgtgcgtccttgaagctggtaccaacacaaacctggccaggcctcccgacggcccctcatctagtggtgcatccaagtcgggccagtggccactcccagccctaggttcgaggtcggctaggtgggtatggggacaggtcttcactcctaccactatcatcacgccgtggacgccgtagaagtagtggttgacttagtttattacgtacgtaccaaacgtacgttaccggtaccggtacgtccgggtccccggtaccgggggtaccccttaaccggtttcccgggaccccggtacggggaaccccgtaaaggggtcgggtaaacgtacgtaaaccgaaaaccggtacgtacggtcgtacgtaacgaccgtaaccctacgtcgttaccgtacctttctacccg

SEQ ID NO: 419771 - DNA, 520 bp, Homo sapiens
  misc_feature: GZ8MTXP02HGII7.8.33.C11.1.454.CMB.2.raw
  modified_base (304)..(304): a, c, t, g, unknown or other
  modified_base (395)..(395): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttgaagctggtaccaacacaaacctggccaggctcccaggcccctcatctatggtncatccaatagggccactggcatcccagccaggtcagtcggcagtggtatgggacagcttcactctcaccatcatcagcctgacgcctgaantgtgctagttattactgtacaactatcgtacgagtcggccgtccgggggcctacgtttccggccgtgggacctaagggtcgagactacgaaacgacgtgtagctaagcacagtcctgtcttctac

SEQ ID NO: 419772 - DNA, 515 bp, Homo sapiens
  misc_feature: GZ8MTXP02I7SF3.8.33.C11.1.454.CMB.2.raw
  modified_base (208)..(208): a, c, t, g, unknown or other
  modified_base (242)..(242): a, c, t, g, unknown or other
  modified_base (248)..(248): a, c, t, g, unknown or other
  modified_base (256)..(256): a, c, t, g, unknown or other
  modified_base (277)..(277): a, c, t, g, unknown or other
  modified_base (287)..(287): a, c, t, g, unknown or other
  modified_base (383)..(383): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcagggccagtcagatgtgcncttganctgtacanacaactgcagctccagccctnatctatggtncatccaatacgggccacgtggcatcccagccaggttcagtcggcagtggtatggggacagcttcactctcaccatcatcagcctggagcctagaanatgttgctagtttatactgtacaaactatcgtaccgagtcggccgtccgggggcctacgttcggacccgtgggacctaagggtggaagactacgaaacgacgtacgtggactgcactactctcgtctactac

SEQ ID NO: 419773 - DNA, 535 bp, Homo sapiens
  misc_feature: GZ8MTXP02J2IAD.8.33.C11.1.454.CMB.2.raw
  modified_base (213)..(213): a, c, t, g, unknown or other
  modified_base (272)..(272): a, c, t, g, unknown or other
  modified_base (384)..(384): a, c, t, g, unknown or other
tcagctcgcgtgtccacgaccggtgctcgatttagagtgagctcgttggggtttgggggaggaactgctcagttaggacccagagggaaccatggaagccccagctcagcttctcttcctcctgctactctggctcccagtttcagataccaccggagagattgtgttgacacagtctccagcccaccctgtctttgtctccagggggaaagngccaccctctcctgcagggccagtcagaatgttggcgccttcgtaagctggtaccaacncaaacctggccaggctccccaggccccctcatctatggtgcatccaacagggccactggcatcccagccaggttcagtggcagtgggtatggggacagcttcactctcaccntcatcagcctgagcctgaagatgttgcagtttattactgttacaacatcgtacccgagtcggccgtccgggggccacgttcggtcccgtggaccgaacggtggagactacaaacgaaaccgtagtggctgcaccactctcgttcttactac

SEQ ID NO: 419774 - DNA, 555 bp, Homo sapiens
  misc_feature: GZ8MTXP02ISRLF.8.33.C11.1.454.CMB.2.raw
  modified_base (210)..(210): a, c, t, g, unknown or other
  modified_base (249)..(249): a, c, t, g, unknown or other
  modified_base (263)..(263): a, c, t, g, unknown or other
  modified_base (270)..(270): a, c, t, g, unknown or other
  modified_base (286)..(286): a, c, t, g, unknown or other
  modified_base (295)..(295): a, c, t, g, unknown or other
  modified_base (303)..(303): a, c, t, g, unknown or other
  modified_base (351)..(351): a, c, t, g, unknown or other
  modified_base (394)..(394): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagcccaccctctcctgcagggccagtcagaatgttggcncttgagctggacanacaaccngcagcctccagccctnatctatggncatccaanggccagtggacatcccagccaggttcagtcgcagtgggtatggggacngacttcactcctacactatcatcagcctggacgcctagaagtntagttcgatagtttattacgtgtacaaacgtattaccggtaccgagtcggcccgtcccgggggtcctacgtttccggcccgtacgggaccctaaagggtcggaagtactaacgaaacgtactggtaggctaacggcctaaccgtatcgtcttcttactacc

SEQ ID NO: 419775 - DNA, 573 bp, Homo sapiens
  misc_feature: GZ8MTXP02F0VQ4.8.33.C11.1.454.CMB.2.raw
  modified_base (302)..(302): a, c, t, g, unknown or other
  modified_base (489)..(489): a, c, t, g, unknown or other
  modified_base (529)..(529): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctcctgtgcagcctctgggtcaccttcagtagctacggcatgcacgtgggtcccnccaaactccgaggcaaggggattgggagtggggtggctagttgtttcattccgtggacgggctaggtgttacaagttgggtatggctgaccgcgtgaaacgggcgatcgaccatctccagacgacaactccaagaacaacaatgtattacgacctagaacacgcctaagtcctagaggacgagggtntaacgtactacgtaggtaacggaacgggacgggggaaacnggacgggaacgtacgaagtaccgtacttcggacgtcgtacgggg

SEQ ID NO: 419776 - DNA, 528 bp, Homo sapiens
  misc_feature: GZ8MTXP02F9MKJ.8.33.C11.1.454.CMB.2.raw
  modified_base (207)..(207): a, c, t, g, unknown or other
  modified_base (241)..(241): a, c, t, g, unknown or other
  modified_base (246)..(246): a, c, t, g, unknown or other
  modified_base (253)..(254): a, c, t, g, unknown or other
  modified_base (274)..(274): a, c, t, g, unknown or other
  modified_base (284)..(284): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgctccaggggaangccaccctctcctgcagggccagtcagatgtgcnctganctgacannaactgcagctccagcccctnatctatggtncatccaacaggggccaacgtggcatccccagccaggttcaggtcggcaggtgggtatggggacagtccttcactctaccaccatcactcagcctggacgcctggagattgttgctagtttattactgtacaacgtatcgtacgagtcggcccgttccgggggcctacgttccggccgtagggaaccaaacggtggaatacgtacaaacgtaacgtacgtggctcgcacactcgtcgtcctactc

SEQ ID NO: 419777 - DNA, 585 bp, Homo sapiens
  misc_feature: GZ8MTXP02IMYII.8.33.C11.1.454.CMB.2.raw
  modified_base (255)..(255): a, c, t, g, unknown or other
  modified_base (434)..(434): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggaggtcacagagactctcctgngcagcctctgggttcacccttcagtagctacggcatgcacgtgggtccgccaaactccaggcaagggattggagtgggtgctagttgttcatccgtggaggcagttgttacaagtgggtatggcgtgaccggcggtggaacgggccgattcacagtctaccagacgacaactcagacanaactgtattgactagaacacgacctaagtccgtaggacggacgtacggtgtactacgtacgtacggtaaacggaaaggggacgggggaaccacgggacgggtaacgttaccgtaaacgttacgttacgtttacgtaccggtcggtacgggg

SEQ ID NO: 419778 - DNA, 573 bp, Homo sapiens
  misc_feature: GZ8MTXP02IY9YL.8.33.C11.1.454.CMB.2.raw
  modified_base (275)..(275): a, c, t, g, unknown or other
  modified_base (323)..(323): a, c, t, g, unknown or other
  modified_base (361)..(361): a, c, t, g, unknown or other
  modified_base (483)..(483): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctctttaagaggtgtccagtgtcaagtgcaactggtggagtcgtgggggagcgtagtccagcctgggagtcacagagactctcctgtgcagccctctgggttcaccttnagtagctacggcatgccacgtgggtcccaccaaactccaggcaagggnttggagtgggtgctagttgttcatccgtgagggcagtnttacaatgggtatgctgacgcgtagaacggccgatcacatctaccagacgaacaactaccagaactaacaattagtatttggaccctaggaaacagacctaagtcctagaggacgtacggtntaactactacgtagtaacggaagggacgggggaaccgaggacgggtaacgttaccgaacgttaccgtcgtttacggaacgtcgtacgggg

SEQ ID NO: 419779 - DNA, 646 bp, Homo sapiens
  misc_feature: GZ8MTXP02FUUOO.8.33.C11.1.454.CMB.2.raw
  modified_base (269)..(269): a, c, t, g, unknown or other
  modified_base (287)..(287): a, c, t, g, unknown or other
  modified_base (383)..(383): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaaggggaaagacgcccaccctctcctgcagggccagtcagatgtgctctgtagctgacaacacaaccngcaggctcccagcccctnatctatggtgcatccaacgacgggcccacgtggccactccccgagccgaggttcaggtcggacagggtggggtatggggaacagtacttcacttcnccaaccatcaatcacgtccctgggacgtccgtagaagagttgttagtcttaaggtttattacgttgtaccaaacgtacgttaccggtaccggtaggtccgggtcccggtacccgggggtacccttaccggtttcccgggccccggttacgggggaacccgtaaaggggttcgggaaacgtacgtaaaccgaaaacggtaaccgttgggtggacccgttaacggaccctaaccgtacttccgttcggttaccttccgttacccg

SEQ ID NO: 419780 - DNA, 510 bp, Homo sapiens
  misc_feature: GZ8MTXP02FYLK7.8.33.C11.1.454.CMB.2.raw
  modified_base (245)..(245): a, c, t, g, unknown or other
  modified_base (259)..(259): a, c, t, g, unknown or other
  modified_base (264)..(264): a, c, t, g, unknown or other
  modified_base (279)..(279): a, c, t, g, unknown or other
  modified_base (285)..(285): a, c, t, g, unknown or other
  modified_base (289)..(289): a, c, t, g, unknown or other
  modified_base (372)..(372): a, c, t, g, unknown or other
  modified_base (378)..(378): a, c, t, g, unknown or other
  modified_base (385)..(385): a, c, t, g, unknown or other
  modified_base (396)..(396): a, c, t, g, unknown or other
  modified_base (483)..(483): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagatgttgcncttgagctgacaancaacngcagctccagccctnatctanggtncatccaacaggccactggcatcccagccaggttcagtcggcagtgggtactgggacagaccttcacttctacaccatcatcancctganctagaantgtgcagtttntacgtgtacactatcgtacgagtccgccgtcgggggcctacgttcggccgtgggaccaagggtcggagactacgaaacgtaactggngctgcacgtacgtctcgtcttactacg

SEQ ID NO: 419781 - DNA, 588 bp, Homo sapiens
  misc_feature: GZ8MTXP02I89W8.8.33.C11.1.454.CMB.2.raw
  modified_base (210)..(210): a, c, t, g, unknown or other
  modified_base (262)..(262): a, c, t, g, unknown or other
  modified_base (268)..(268): a, c, t, g, unknown or other
  modified_base (285)..(285): a, c, t, g, unknown or other
  modified_base (295)..(295): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagccacctctcctgcagggccagtcagatgttgcgcttgaagctgtaccaanacaacngcagctcccagcccctnatctatggtncactccaaacgcgggccacgtggaccactccccagcccaggttcaggtcggacaggtgggtaatggggaacagtacttcactctacacctatcatcagccgtagacgcctagaagtagtagttgtactagtttattactgtacaactagtacgtacgagtcggccgtaccgggggtcctaccggtttccggcccgtacgggaacccgtaagggtcggaacgacgtaacgaaaccgtaacgtacggtacggacgtcgaccgaccgtacgtaccgttcgttaccttacttacccg

SEQ ID NO: 419782 - DNA, 579 bp, Homo sapiens
  misc_feature: GZ8MTXP02GBBFU.8.33.C11.1.454.CMB.2.raw
  modified_base (322)..(322): a, c, t, g, unknown or other
  modified_base (361)..(361): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtagtccagcctgggaggtcacagagactctcctgtgcagcctctgggtcaccttcagtagctacggcatgcacgtgggtccaccaaactccgaggcaaagggnttggagtggggtgctagttgttcatccgtgagggcagtnttacaagtggtatgcgtgacgcgtggaacgggcattcacatctccagacaacaactccagaacacaaatgtatttggacctagaacacgacctaaacgtcctagacggaacgtacgggtataacgtactacgtaggtaacggaaacggggacgggggaaaccgaggacgggtaacgttaccgaacgtacctcgtttacggaccggttcgtaccggggg

SEQ ID NO: 419783 - DNA, 536 bp, Homo sapiens
  misc_feature: GZ8MTXP02GAD1T.8.33.C11.1.454.CMB.2.raw
  modified_base (246)..(246): a, c, t, g, unknown or other
  modified_base (280)..(281): a, c, t, g, unknown or other
  modified_base (290)..(290): a, c, t, g, unknown or other
  modified_base (383)..(383): a, c, t, g, unknown or other
  modified_base (391)..(391): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagacgccaccctctcctgcagggccagtcagatgtgcncttgagctgacacacaactgcagctccagccctnntctatggtncactccaacgacgggccactggcactcccagccaggttcagtcggcaggtggtagtgggacagcttcactctaccacatcatcagcctaggcnctagaagnttgtagtctagtttacttactgtacaatactcgtaccgagtcggtccgtccggggcctacgttcggacccgtcgggaaccgtaagggtcggaagacgtaacgaaacgtaacgtcgtggactgccactactctcgttacctctacc

SEQ ID NO: 419784 - DNA, 540 bp, Homo sapiens
  misc_feature: GZ8MTXP02JB19E.8.33.C11.1.454.CMB.2.raw
  modified_base (208)..(208): a, c, t, g, unknown or other
  modified_base (304)..(304): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcgccttgaagctggtaccaacacaaacctggccaggctcccaggcccctcatctatggtncatccaatggccatggcatcccagccaggttcagtcggcaggtggtatggggacagcttcactctcaccatcatcagcctggagcctgaagatgttgctagtttattactgtacaactatcgtaccgagtcggccgtccgggggcctacgttccggcccgtcggggaccgtaagggtcggagactacgaaaacgacgtacggtcggctgccaaccgactcgtcgttccttactacc

SEQ ID NO: 419785 - DNA, 780 bp, Homo sapiens
  misc_feature: GZ8MTXP02IXH3S.8.33.C11.1.454.CMB.2.raw
  modified_base (210)..(210): a, c, t, g, unknown or other
  modified_base (309)..(309): a, c, t, g, unknown or other
  modified_base (356)..(356): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgcctttgtctccaaggggaaanacgccaccctctcctgcaggccagtcagaatgtgcgcttcgtaagctggtaccaacacaaacctggccaggcctcccgacggcccctcatctagtggtncatcccaaacgacggggcccctacgcggtacccaaccgttcccccgnggaccccgtaaggggtttccaagggttcggggacctaagggggttcggggttaaacgtcggggaaaccagggttacctttccaacgttccctaccaaacctatccaaatccgaacgtcccgttagggaacgacccgttaaggaaaacggtgttacggtttacgtacctttaaggtttttaaacctttaacgtacgttaaaccgtaaaccgttaacgttacccgggttaacccgggtaacgggttcccggggtcccccggggttaccccgggggtaccccgttacccggttttacccgggccccgggtttacgggggaaacccgtaaacgggggttacggaaacggtaacgtaacccggaaaacgtaaaccgtcggtaccgggacgtaacggacctaccgacttactccggttcttacttacccg

SEQ ID NO: 419786 - DNA, 577 bp, Homo sapiens
  misc_feature: GZ8MTXP02HMLS9.8.33.C11.1.454.CMB.2.raw
  modified_base (300)..(300): a, c, t, g, unknown or other
  modified_base (331)..(331): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggtttcctcgttgctcttttaagaggtgtccagtgtcaagtgcaactggtggagtctgggggagcgtagtccagcctgggagtcacagagactctctgtgcagcctcgtgggttccacttcagtagctacggcatgcacgtgggtccnccaaactcgaggcaaggggattggagtgggnggcagtttgttcatccgtggagggcaggttgtcaatgggtatggctgacgccgtggaacgggcgtatcaccatctcagacgacactcagaacacaatgtatttgacctagaacacgaccgtaacgtccgtaggacggacgtacggggtgttaacgtacgtacgttaggtaacggaagggacgggggaaccgaagggacggggtaacgtaccgaacgttactaccgtttcggtacgttcggtcgggg

SEQ ID NO: 419787 - DNA, 574 bp, Homo sapiens
  misc_feature: GZ8MTXP02FUZHA.8.33.C11.1.454.CMB.2.raw
  modified_base (209)..(209): a, c, t, g, unknown or other
  modified_base (299)..(299): a, c, t, g, unknown or other
  modified_base (309)..(309): a, c, t, g, unknown or other
  modified_base (408)..(408): a, c, t, g, unknown or other
  modified_base (416)..(416): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcgtccttgtaagctggtaacccaacacaaacctggccaggctcccaggcccctnatctatggtncatccaaacgacgggccacgtggcactccccagccaggttcaggtcggcaggtgggtatgggacaggtcttcactctaccaccatcatcagcctggacnctagaagnttgtgctaagtttattactgtacaaactatcgtaaccgtagtcggccgttccgggggacctacggtttccgacccgttagggacccgaaacgggtggaacgactaaccgaaaacgtaccgtaggtaggtctaagccaactactctcgtaccttctacc

SEQ ID NO: 419788 - DNA, 581 bp, Homo sapiens
  misc_feature: GZ8MTXP02H5D4N.8.33.C11.1.454.CMB.2.raw
  modified_base (302)..(302): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctcctgtgcagcctctgggttcaccttcagtagctacggcatgcactgggtcccnccaaactccaggccaaggggattgggagtggggtgctaggttgttcatcctggagggcagttgttcaatggtatgctgacgtccgtaggaacgggccgatcacctatcctcagtacgacaactaccgagaacaactaatgttacttgacctagaacagacctaacgtccgagaggacgacgggtatactacgtacgtcgtaacggaagggacgggggaaccagggaccgggtaagtaccgaaggttaccgtaccgtttagtaccgttacggtaccgggg

SEQ ID NO: 419789 - DNA, 521 bp, Homo sapiens
  misc_feature: GZ8MTXP02JUP9L.8.33.C11.1.454.CMB.2.raw
  modified_base (209)..(209): a, c, t, g, unknown or other
  modified_base (244)..(244): a, c, t, g, unknown or other
  modified_base (250)..(250): a, c, t, g, unknown or other
  modified_base (257)..(257): a, c, t, g, unknown or other
  modified_base (263)..(263): a, c, t, g, unknown or other
  modified_base (269)..(269): a, c, t, g, unknown or other
  modified_base (281)..(281): a, c, t, g, unknown or other
  modified_base (291)..(291): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagatgtgcncttganctgacanacaacngcagcncccaggcccctnatctatggtncatccaacagggccactggcatcccagccaggttcagtcggcagtgggtatggggacagcttcactctacaccatcatcagcctggacgcctagaagtactggttagactagtttactactgtacaactatcgtaccgagtcggcccgttccgggggcctacgttccggccgtcgggaccgtagggtgagactacgaaacgactgtcgactgcaccgatcgtgtctctac

SEQ ID NO: 419790 - DNA, 683 bp, Homo sapiens
  misc_feature: GZ8MTXP02FOCNC.8.33.C11.1.454.CMB.2.raw
  modified_base (211)..(211): a, c, t, g, unknown or other
  modified_base (263)..(263): a, c, t, g, unknown or other
  modified_base (284)..(284): a, c, t, g, unknown or other
  modified_base (294)..(294): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagngccaccctctcctgcaggccagtcagaatgttgcgcttgaagctgtaccaanacaactgcagctccagccctnatctatggtncatccaacgaggccaacgtggaccactccccgagccctaggttcaggtcggctaggtgggtatggggacaggtcttcacttctaccaccaatcaatcacgtcccgtaggacgcccgtagaaagagttgttacgtacttaagttttattaacggttactactaaacgtacgttacccggttaaccgggacggttccgggtccccggttaccccggggggaccctttaaccgggtttcccggggaccccggttaccgggggaacccgtaaaagggggtacgggaacgtaaaccgttaaaccgaaaaccgggtaaacgttcgggtacggggttaccgtaaccggtacccgtaaaccgtacgtttaccgttacgtttaccgtttaccgtaccg

SEQ ID NO: 419791 - DNA, 682 bp, Homo sapiens
  misc_feature: GZ8MTXP02JE5UW.8.33.C11.1.454.CMB.2.raw
  modified_base (207)..(207): a, c, t, g, unknown or other
  modified_base (297)..(297): a, c, t, g, unknown or other
  modified_base (441)..(441): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacctgtctttgctccgaggggaanagccacctctcctgcagggccagtcagaatgttggcgcttcgtaagctggtaccaacacaaacctggccaggcctcccgacggccccctnatctagtggtgacactcccaaacgacggggccctaacgtggacccacgtccccaggccccagggttccaggtccggctaggtgggtatggggaaccagtcttcactctcaccgatccagtcagcccgtggacgtcctagaagtntggtttagaccttaagtttacttacgtcgttaaacaactacgtacccggtacggtaacggtccgggtaccggtccccgggggtacttaccggtttacccgggcccccgttaggggaacccgtaagggggtacggaacgtaaacgtaaacccgaaaacgggtaaccgtttaggggtaccggccgtaacgggacccctaaccccttagtttcccggttaactttacccgtttaccttaccccg

SEQ ID NO: 419792 - DNA, 649 bp, Homo sapiens
  misc_feature: GZ8MTXP02FT6DB.8.33.C11.1.454.CMB.2.raw
  modified_base (311)..(311): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagatgtgcgcttgtagctggtaccaacacaaacctggccaggctcccaggcccctcatctatggtgcatccaacngggccactggcatcccagccaggttcagtcggcaggtgggtatggggacagtcttcactctcaccatcatcagcctggacgcctagaagatgttgcgtagttttatttacgtcgttacaactacgttaccggttaacccggtaaggtccgggtcccggttccccgggggggtccccttaacccggttttccccggggaccccggttaccgggggaaccccgtaaagggggttcgggaaacggtaacgttaaaccggaaaaccggtaaaccgttagggtacgggtccgttaacgggaccctaaccgtaactttccgtacggttccgttaccttaacccg

SEQ ID NO: 419793 - DNA, 706 bp, Homo sapiens
  misc_feature: GZ8MTXP02GHD88.8.33.C11.1.454.CMB.2.raw
  modified_base (330)..(330): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctcctgtgcagccctcgtgggttcacccttcagtagctacggcagtcgcacgtgggtcccaccaaactccgaggcaaggggtnttggaggtggggtggctaggtttgtttacagttccgtggaggggtctaggttgttacaaagttggggtattggccgttaggaccgtccggtaggaaacggggcccgtaactttcccaaccctaatccgtacccgacgaacgaaccaaacccgtacccgaaacgggaaaccaaactaaagttaggttaacttttacgggaaccccgttaggaaaccaaccggtaccttaaacgtcccgtaggaacggaacgtacggggttagtaacttaacgtacgttacggtaaaccggaaagggggtaacgggggaaacctagggacggggtaacgttaccgtaacggttaccgttaccgtttacggaccggtacgtaccggggg

SEQ ID NO: 419794 - DNA, 553 bp, Homo sapiens
  misc_feature: GZ8MTXP02FNY1H.8.33.C11.1.454.CMB.2.raw
  modified_base (210)..(210): a, c, t, g, unknown or other
  modified_base (294)..(294): a, c, t, g, unknown or other
  modified_base (304)..(304): a, c, t, g, unknown or other
  modified_base (396)..(396): a, c, t, g, unknown or other
  modified_base (438)..(438): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagccaccctctcctgcagggccagtcagatgttgcgcttgtaagctggtaccaacacaaactggccaggcctcccaggcccctnatctatggtncatccaagacgggccacgtggaccactcccagccaggttcaggtcgcagtgggtatgggacagtctcactctacacatcatcagcctggacnccgtagaagtatggttagctaagttttatacgtgtactaacngttaccgtaccgagtcgccgtccggggctacgttccggaccgtggaaccgaggtcggagtactacgaaacgtacgtcggtacgacctaaggccacgtactcgtcgtacttctacg

SEQ ID NO: 419795 - DNA, 555 bp, Homo sapiens
  misc_feature: GZ8MTXP02JOCIX.8.33.C11.1.454.CMB.2.raw
  modified_base (305)..(305): a, c, t, g, unknown or other
  modified_base (442)..(442): a, c, t, g, unknown or other
  modified_base (465)..(465): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagccctctgggttcaccttcagtagctacggcatgcacgtgggtcccnccaaactccaggcaagggattggagtggggtgcagttgttcatccgtgacgggcaggttgtacaatggtatgctgacgcgtgaaggccgatcacatctccagagacaactcagaacacaatgtattggacctgaacngacctaagtcctgaggacaggtntactactacgtagtacggaagggtacgggggaaccaggaccgggtaagtaccgaacgtaccgttccgtttacggaccggtcgtacggggg

SEQ ID NO: 419796 - DNA, 574 bp, Homo sapiens
  misc_feature: GZ8MTXP02GKRIL.8.33.C11.1.454.CMB.2.raw
  modified_base (295)..(295): a, c, t, g, unknown or other
  modified_base (305)..(305): a, c, t, g, unknown or other
  modified_base (366)..(366): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagatgttggcgccttgtaagctggtaccaacacaaacctggccaggcctcccaggcccctnatctatggtncatcccaagtacgggccactggcactcccagccaggttcagtcggcagtgggtatgggacngacttcactctacaccatcatcagccctggacgcctagaacgattgttgacttagtttattacgtgtacaactagtaccgtacgtagtcgggcccggtccgggggtccctacggtttccggcccgtacggggacccgtaagggtcggaagtactacgaaacgtaacgtcggtcggtcgtcgcctaaccgtactcgtcgttcttctacc

SEQ ID NO: 419797 - DNA, 680 bp, Homo sapiens
  misc_feature: GZ8MTXP02IMBSZ.8.33.C11.1.454.CMB.2.raw
  modified_base (285)..(285): a, c, t, g, unknown or other
  modified_base (309)..(309): a, c, t, g, unknown or other
  modified_base (329)..(329): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactgggtggagtcgtggggggagcgtagtccaggcctggggagtcacagagactctcctgtgcagcctcgtgggttcaccttcagtnctacggcatgccacgtcgggtccnccaaactccgaggcaagggnttgggaggtgggtgctagtttgttcatcgtgagggtctaggttcttacgaagttggggttatcggtacgttacgggacccggtcgggtaggggtaaccggggcccgtattacccaacctactcctacccgaaggacgtaaaccaacctacccgaaagaacctaaactaaagttacgttaacgtttacggaaccttacggaaaacctacgaccgttaacgtccgtaggacggtaacgtacgggttataacttacgtacgtacggtaaacgggaaaggggtacgggggaaacgtaggacgggtaacgttaccgaaacgttaccgttaccgtttcgaccggttcggtaccgggg

SEQ ID NO: 419798 - DNA, 546 bp, Homo sapiens
  misc_feature: GZ8MTXP02FF2SK.8.33.C11.1.454.CMB.2.raw
  modified_base (208)..(208): a, c, t, g, unknown or other
  modified_base (296)..(296): a, c, t, g, unknown or other
  modified_base (319)..(319): a, c, t, g, unknown or other
  modified_base (358)..(358): a, c, t, g, unknown or other
  modified_base (364)..(364): a, c, t, g, unknown or other
  modified_base (395)..(395): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgtttacacagtctccagccacctgtctttgtctccaggggaaanagccaccctctcctgcagggccagtcagaatgttggcgccttcgaagctggtaccaacacaaacctggccaggctcccaggccccctnatcctatggtgcatcccaaacgngggcccactggcatcccagccaggtcagtgccagtggangggacngacttcactctcaccatcatcagcctggacncctagaagatgttgctagtttattacgtagtacaaacatcgtaccgaggtcggcccgtccgggggcctacgtttccggcccgtgggaccgaagggtcggagagtacgaaacgaactcgtcggctagcaccgtatcgtgtcttcacttcccg

SEQ ID NO: 419799 - DNA, 716 bp, Homo sapiens
  misc_feature: GZ8MTXP02F4CNT.8.33.C11.1.454.CMB.2.raw
  modified_base (210)..(210): a, c, t, g, unknown or other
  modified_base (302)..(302): a, c, t, g, unknown or other
  modified_base (367)..(367): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagccaccctctcctgcagggccagtcagatgttggctccttgaagctgtaccaacacaacctggccaggctcccagccctcatctagtggtncactcccaagcgggccagtcggcactcccagccaggttcaggtcggcaggtgggtatggggaacngaccttcacttctaccacctatcactacacgcccgtagggaacgtccgtaggaagtagtttcggttgtacgttaagttttaacttaaccgttacgtaaacctaaaacttacgttacccgggttaaacccgggtacgggttacccggggtaccccggggttaccccggggggtccctttaacccggggttttcccggggacccccggtttacggggggaaaccccgtaaaagggggttcggggaaacgggtaacttaaaccgggaaaaccggtaaaccgtttacggggacgggtccgttaacggacccgaaccttacgttccggtttacgtttacctttaccgtaacccg

SEQ ID NO: 419800 - DNA, 594 bp, Homo sapiens
  misc_feature: GZ8MTXP02FWBBY.8.33.C11.1.454.CMB.2.raw
  modified_base (419)..(419): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagaatgttggcgccttgtaagctggtaccaacacaaacctggccaggctcccaggcccctcatctatggtgcatccaacgagggccacgtggcactcccagccaggttcaggtcggcaggtgggtatgggacaggtcttcactctacaccatccatcagtcccgtggacgtcctagaaacgtnttgttgacttaagttttacttacgtgtacaaactagttaccgtaccggaggttccggccggtcccgggggtctacgtttccgggcccgttacggggaacccgtaagggtcggaacgacgtaaccgaaaacggtaccgtgtacgggctaacggcaaccgtatcctcgtacttctac

SEQ ID NO: 419801 - DNA, 597 bp, Homo sapiens
  misc_feature: GZ8MTXP02J0WSH.8.33.C11.1.454.CMB.2.raw
  modified_base (330)..(330): a, c, t, g, unknown or other
  modified_base (426)..(426): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggagcgtagtccagccgtgggagtcacagagactctctgtgcagcctcgtggttcaccttcagtagctacggcatcgcacgtcgggtcccaccaaactccgaaggcaaaggggtnttgggagtgggtgctagtttgttcatccgtaggagggctaggttgttacaagttggtatgctggacgccgtagaacgggcctagttccaccatccncgagacgacaactccgagaacacaatgtattacgactagaacagacctaagccgtaggacggacgtacgggtatacgtactacgtacggtaaacggaaggggtacgggggaaccgtaggaccgggtaacgtaccgaacgtaccgttccgttacggacggtacgtaccgggg

SEQ ID NO: 419802 - DNA, 561 bp, Homo sapiens
  misc_feature: GZ8MTXP02J2DFJ.8.33.C11.1.454.CMB.2.raw
  modified_base (209)..(209): a, c, t, g, unknown or other
  modified_base (246)..(246): a, c, t, g, unknown or other
  modified_base (274)..(274): a, c, t, g, unknown or other
  modified_base (284)..(284): a, c, t, g, unknown or other
  modified_base (294)..(294): a, c, t, g, unknown or other
  modified_base (303)..(303): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangcccaccctctcctgcagggccagtcagaatgtggcncttgtaagctgaccacacaactgcagcnccagcccctnatctatggtncatcccaanaggggccacgtggcactccccagcccaggttcagtcggcaggtgggtatggggacaggtcttcactctacaccatcatcacgccctgggacgtccctagaagtattggttgcttagttttacttacgttgtaccaaactacgtacgtaccgtaggtcggcccggtcccgggggcctacgttccggcccgtcggggaacctagggtggagacgtacaaacgtacgtcgtaggctgaccactactctcgttacttctacc

SEQ ID NO: 419803 - DNA, 548 bp, Homo sapiens
  misc_feature: GZ8MTXP02HCFLL.8.33.C11.1.454.CMB.2.raw
  modified_base (209)..(209): a, c, t, g, unknown or other
  modified_base (243)..(243): a, c, t, g, unknown or other
  modified_base (248)..(248): a, c, t, g, unknown or other
  modified_base (260)..(260): a, c, t, g, unknown or other
  modified_base (275)..(275): a, c, t, g, unknown or other
  modified_base (281)..(281): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagccacctctcctgcagggccagtcagatgtgcnctgantgacacacaacngcagctccagccctnatctangtgcataccataggccagtgcatcccagccaggtcagtcggcaggtgggtatggggacagtcttcactctacaccatccatcagccctggacgcctagaagtatggttgactagttttattaacttgtactaacagttacgtaccggaacgtcggccgttcccgggggccctacggtttccggacccgttggggaaccctaaggggtacgaggtactaacgaaacggaacgtggtacggcgtcgcacctacgtctcgtacttactac

SEQ ID NO: 419804 - DNA, 685 bp, Homo sapiens
  misc_feature: GZ8MTXP02GKOIB.8.33.C11.1.454.CMB.2.raw
  modified_base (302)..(302): a, c, t, g, unknown or other
  modified_base (312)..(312): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagaatgttggcgtccttcgtaagctaggtaccaacacaaacctggccaggcctcccgacggcccctnatctatggtncataccaagtacgggccacgtggcactcccgagccgtaggttcaggtcggacgaggtggggtaagtggggaacaggtacctttcaccgttcctaccacctaatccgaatccacgtcccgtggtaacttccgtagaaaacgtgttggtttaggtactttaagttttactttacttgttaaccaaacttacgttaccggtaaccggtagggtcccgggtacccggttcccggggggtacctttaccgggttttcccggacccggtacgggggaacccgtaaggggtacgggaacgtaacgtaaaccgaaaacggtaacgttcgggtacggtccgtaacggacctaccgtactacgttcgttccttacgttacccg

SEQ ID NO: 419805 - DNA, 551 bp, Homo sapiens
  misc_feature: GZ8MTXP02IQJPY.8.33.C11.1.454.CMB.2.raw
  modified_base (209)..(209): a, c, t, g, unknown or other
  modified_base (244)..(244): a, c, t, g, unknown or other
  modified_base (250)..(250): a, c, t, g, unknown or other
  modified_base (259)..(259): a, c, t, g, unknown or other
  modified_base (281)..(281): a, c, t, g, unknown or other
  modified_base (288)..(288): a, c, t, g, unknown or other
  modified_base (292)..(292): a, c, t, g, unknown or other
  modified_base (388)..(388): a, c, t, g, unknown or other
  modified_base (400)..(400): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccacggagagattgtgttgacacagtctccagcccacctgtctttgtctccgaggggaaanagccaccctctcctgcaggccagtcagatgttgcncttganctgtacaanacaactgcagctccacgccctnatctagnggtncatccaacgaggccatggcatcccagcccaggttccagtcggacgagtgggtatgggacagcctttcacttctaccaccatcaatcagcccgtagngacctagaagtnttgtgtactagtttattacgtcgttacaactacgttcgtacggacgtcgggaccggtccgggggcctacgttccggccgtagggaccgtaagggtcggaatacgtacaaacgtacgtaggtcgacgtgacacgtactcgtcgtctactccg

SEQ ID NO: 419806 - DNA, 605 bp, Homo sapiens
  misc_feature: GZ8MTXP02GRCG0.8.33.C11.1.454.CMB.2.raw
  modified_base (249)..(249): a, c, t, g, unknown or other
  modified_base (268)..(268): a, c, t, g, unknown or other
  modified_base (274)..(274): a, c, t, g, unknown or other
  modified_base (282)..(282): a, c, t, g, unknown or other
  modified_base (285)..(285): a, c, t, g, unknown or other
  modified_base (289)..(289): a, c, t, g, unknown or other
  modified_base (292)..(292): a, c, t, g, unknown or other
  modified_base (296)..(296): a, c, t, g, unknown or other
  modified_base (302)..(302): a, c, t, g, unknown or other
  modified_base (305)..(306): a, c, t, g, unknown or other
  modified_base (309)..(309): a, c, t, g, unknown or other
  modified_base (318)..(318): a, c, t, g, unknown or other
  modified_base (328)..(328): a, c, t, g, unknown or other
  modified_base (333)..(333): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccaccctgttctttgtctccgaaggggaaagacgcccaccctctcctgcaggccagtcagatgtgcnctgagctgacaacacaacngcagcnccagcccnatnatgncancaancggcangcnnccngcagtcagngcagtggagnggacngctcactcacaccatcatcagtccgtggacgccgtagaagtattgttagtacttagtttacttacgttacgtaacctaaacgttacgtaccggtaccgggtacggtcccggggtacccggtccccgggggtacccttaccgggtttcccggtacccggtacggggaacccgtaaggggtacgggaacgtaacgtaaaccggaaaaccggtacgtacggtacggtacgtcggacctaaccgtacgttaccttcggttacctttaccttacccg

SEQ ID NO: 419807 - DNA, 571 bp, Homo sapiens
  misc_feature: GZ8MTXP02FWSBS.8.33.C11.1.454.CMB.2.raw
  modified_base (210)..(210): a, c, t, g, unknown or other
  modified_base (247)..(247): a, c, t, g, unknown or other
  modified_base (260)..(260): a, c, t, g, unknown or other
  modified_base (265)..(265): a, c, t, g, unknown or other
  modified_base (271)..(271): a, c, t, g, unknown or other
  modified_base (280)..(280): a, c, t, g, unknown or other
  modified_base (290)..(290): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagcccaccctctcctgcagggccagtcagatgtggcncttgagctgacancaacngcagcnccagccctnatctatggtncatccaacaggccagtggcactcccagccaggttcagtcggcaggtgggtatgggacagtcttcactctccaccatcatcagcctggacgcctgaacgattgttgctagtttattacgtgtacaactagtaccgtacggagtacggtccgtacccgggggtccctacgtttccgggacccgtcggggaacccgtaaggggtcgggaacgtacgtaccgaaaccggtaaccgtaggtcggtaccgtcgaccgacctacgttccgttcgttaccttcttaccg

SEQ ID NO: 419808 - DNA, 495 bp, Homo sapiens
  misc_feature: GZ8MTXP02IC8J1.8.33.C11.1.454.CMB.2.raw
  modified_base (208)..(208): a, c, t, g, unknown or other
  modified_base (242)..(242): a, c, t, g, unknown or other
  modified_base (257)..(257): a, c, t, g, unknown or other
  modified_base (263)..(263): a, c, t, g, unknown or other
  modified_base (276)..(276): a, c, t, g, unknown or other
  modified_base (279)..(279): a, c, t, g, unknown or other
  modified_base (284)..(285): a, c, t, g, unknown or other
  modified_base (287)..(287): a, c, t, g, unknown or other
  modified_base (291)..(291): a, c, t, g, unknown or other
  modified_base (337)..(337): a, c, t, g, unknown or other
  modified_base (347)..(348): a, c, t, g, unknown or other
  modified_base (356)..(356): a, c, t, g, unknown or other
  modified_base (365)..(365): a, c, t, g, unknown or other
  modified_base (410)..(410): a, c, t, g, unknown or other
  modified_base (472)..(472): a, c, t, g, unknown or other
  modified_base (494)..(494): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgctccaggggaaangccaccctctcctgcagggccagtcagatgtgcncttcgagctgtacanacaacngcagctccagccnatntatgnnancaanggcatgcatccagccaggtcagtcggcagtggtatgggacagcttnactctcaccnncacgtcancctgggacncgtagagtatgtgtatagtttatactagtactatactacgtacgngtcggccgtcgggcctcgtccgccgtagacgaggtagagactacgaaacgtacgtcgtcgcncgacacgtctacgtctactacnc

SEQ ID NO: 419809 - DNA, 665 bp, Homo sapiens
  misc_feature: GZ8MTXP02HBIMZ.8.33.C11.1.454.CMB.2.raw
  modified_base (212)..(212): a, c, t, g, unknown or other
  modified_base (248)..(248): a, c, t, g, unknown or other
  modified_base (254)..(254): a, c, t, g, unknown or other
  modified_base (262)..(262): a, c, t, g, unknown or other
  modified_base (268)..(268): a, c, t, g, unknown or other
  modified_base (274)..(274): a, c, t, g, unknown or other
  modified_base (283)..(283): a, c, t, g, unknown or other
  modified_base (293)..(293): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagcccaccctgtctttgtctccgaagggggaaancgcccaccctctcctgcagggccagtcagatgtgcncttganctgacaanacaacngcagcnccagccctnatctatggtnactataccaagtacggccagtgcactcccagccaggttcaggtcggctagggtgggtaagtgggaacagtaccgttcacctacctacccaacctatcctaactcgacgcccgtagggacgtcccgtaaggaagtacgttaggttacgtacttagttttaacgtttaacgacgttaaccaaacgttacgttacccgtaaccgggtacggtcgggtaccccggtccgggggtaccccttaacgggtttccccggacccggtacgggggtaacccgtaaaagggggttcggaacggtaactaaaccggaaaaccggttaacgtcggtaacgggtcctcgtaccgacccgtatccggttacgttcctactttaccg

SEQ ID NO: 419810 - DNA, 592 bp, Homo sapiens
  misc_feature: GZ8MTXP02H4P2R.8.33.C11.1.454.CMB.2.raw
  modified_base (208)..(208): a, c, t, g, unknown or other
  modified_base (303)..(303): a, c, t, g, unknown or other
  modified_base (316)..(316): a, c, t, g, unknown or other
  modified_base (377)..(377): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctccagtttcagataccaccggagagattgtgttgacacagtctccagccacctgtctttgtctccgaggggaaanagccacctctcctgcagggccagtcagaatgttggcgacttcgtaagctaggtacccaacaccaaacctggccaggcctccccgacggcccctanatcctatgggtcncataccaacgaggggcccacgtggcactcccagccaggttcagtcgcaggtggtatggganagcttcactctacaccatcatcacgcctggacgccagaagtatgttgacttagtttatacttgttacaaactagttacggaccgtaggttcggcccggtaccgggggtcctacggtttcccggacccgtcggggaacccgtaagggcgggaagaactacgaaaacgaacgtggtcggactaacggaccaccgtattccgtcttctttactacccg

SEQ ID NO: 419811 - DNA, 619 bp, Homo sapiens
  misc_feature: GZ8MTXP02I8TF0.8.33.C11.1.454.CMB.2.raw
  modified_base (208)..(208): a, c, t, g, unknown or other
  modified_base (242)..(242): a, c, t, g, unknown or other
  modified_base (248)..(248): a, c, t, g, unknown or other
  modified_base (277)..(277): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaanagccaccctctcctgcaggccagtcagatgtgcncttganctgacacacaactgcagctcccggccctnatctatggtgcatccaacgacgggcccacgtggacactcccagccaggttcaggtggacctaggtggggtatggggacaggtaccttcgactctaccacctatcactcacgcctggacgtcctaggaaagtattgttagtcttaagtttactacgttacgtacaaactacgtaccggttacggacggttcgggacccggtcccgggggtacccttaccgtttaccgggcccgtacggggaaccgtaaggggtcggaacgtacgttaaccgaaaacgtaacggttggtaccggcgtacggaacctacccgtaagttctacggtttccttactacgtttccccg

SEQ ID NO: 419812 - DNA, 523 bp, Homo sapiens
  misc_feature: GZ8MTXP02GO3UJ.8.33.C11.1.454.CMB.2.raw
  modified_base (307)..(307): a, c, t, g, unknown or other
  modified_base (315)..(315): a, c, t, g, unknown or other
  modified_base (344)..(344): a, c, t, g, unknown or other
  modified_base (352)..(352): a, c, t, g, unknown or other
  modified_base (387)..(387): a, c, t, g, unknown or other
  modified_base (395)..(395): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttgtaagctggtaccaaacacaaacctggccaggctcccaggcccctcatctatggtncatccaanaggccatgcactccagccagtcaggtcgnagtggtangggacagctcactctacacatcatcagcctggacnctagaaantgtgctattattatagtacaactatacgtacgacgtacggccggtccgggccgtacgttcggtccgtcggacgaacggaggagactacaaacgaacgtacgtaggcgtgcacactactctcttactac

SEQ ID NO: 419813 - DNA, 541 bp, Homo sapiens
  misc_feature: GZ8MTXP02F9ED6.8.33.C11.1.454.CMB.2.raw
  modified_base (262)..(262): a, c, t, g, unknown or other
  modified_base (275)..(275): a, c, t, g, unknown or other
  modified_base (303)..(303): a, c, t, g, unknown or other
  modified_base (322)..(322): a, c, t, g, unknown or other
  modified_base (399)..(399): a, c, t, g, unknown or other
  modified_base (402)..(402): a, c, t, g, unknown or other
  modified_base (411)..(411): a, c, t, g, unknown or other
  modified_base (418)..(418): a, c, t, g, unknown or other
  modified_base (459)..(459): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtagtccagcctgggaggtcacagagactctcctgtgcagcctntgggttcaccttnagtagctacggcatgcacgtgggtcccnccaaactccaggcaagggnttggagtgggtgctagttgttcatcctggagggcagttgtacaatggtatgctgacgcgtagacgggcatcacatcncanacgacaacncagacanatgtattgactagaacacgactacgtctgaggacgacggtntactactacgtacggtaacggaagggtacggggaaccaggacggaacgtacgaacgtactacgttacgacgtacgtacgggg

SEQ ID NO: 419814 - DNA, 546 bp, Homo sapiens
  misc_feature: GZ8MTXP02GQSX5.8.33.C11.1.454.CMB.2.raw
  modified_base (211)..(211): a, c, t, g, unknown or other
  modified_base (247)..(247): a, c, t, g, unknown or other
  modified_base (252)..(252): a, c, t, g, unknown or other
  modified_base (266)..(266): a, c, t, g, unknown or other
  modified_base (280)..(280): a, c, t, g, unknown or other
  modified_base (289)..(289): a, c, t, g, unknown or other
  modified_base (297)..(297): a, c, t, g, unknown or other
  modified_base (357)..(357): a, c, t, g, unknown or other
  modified_base (373)..(373): a, c, t, g, unknown or other
  modified_base (381)..(381): a, c, t, g, unknown or other
  modified_base (408)..(408): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagcctccagcccaccctgtctttgtctccgaggggaaanagcccaccctctcctgcagggccagtcagatgtgcnctganctgacaacacaacngcagctccagcccnatcatggtncatccaanggcatgcatccagccaggtcagtcggcaggtggtatggggacagccttcactctcaaccntcaatcagcctggacncgtgaagntgtgcttagtttattactgtacaactntaccgtacgtagtccgggccgtccgggggcctacggttccggcccgtacggggaaccgtagggtcggtaagacgtaacgaaacgtacgtacggtcggtctaacggacctaaccgtcgttcgtcgttccttactacccg

SEQ ID NO: 419815 - DNA, 543 bp, Homo sapiens
  misc_feature: GZ8MTXP02H7R2V.8.33.C11.1.454.CMB.2.raw
  modified_base (304)..(304): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagcccaccctgtctttgtctccagggggaaagagccaccctctcctgcagggccagtcagaatgttggcgcttcgaagctggtaccaacacaaactggccaggctcccagcccctcatctatggtncatccaaatagggccatggcatcccagccaggtcagtggcagtggggatgggacagcttcactctcaccatcatcagcctgagctgaagatgttgcagtttattactgttacaaactactcgtaaccgtaagttcgggcccgttcccgggggcctaaccgtttcccgggccccgtcggggaccctaaaaggggtggagagtacaaaacgaacgtcgtggctgcacatctcgttctctac

SEQ ID NO: 419816 - DNA, 569 bp, Homo sapiens
  misc_feature: GZ8MTXP02JKYO2.8.33.C11.1.454.CMB.2.raw
  modified_base (209)..(209): a, c, t, g, unknown or other
  modified_base (243)..(243): a, c, t, g, unknown or other
  modified_base (256)..(256): a, c, t, g, unknown or other
  modified_base (261)..(261): a, c, t, g, unknown or other
  modified_base (277)..(277): a, c, t, g, unknown or other
  modified_base (286)..(286): a, c, t, g, unknown or other
  modified_base (294)..(294): a, c, t, g, unknown or other
  modified_base (384)..(384): a, c, t, g, unknown or other
  modified_base (394)..(394): a, c, t, g, unknown or other
  modified_base (399)..(399): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcagggccagtcagatgtgcncttgagctgacancaacngcagctccagcccctnatcatggtncatccaanagggccacgtggcatcccagccaggttcagtcggcaggtcgggtatggggaacaggtcttcgactccgtacaccatcatcagcctggacncctagaagtntgttnactagtttaattacgtgtactaacgtacttacggtaccgtaggtcggtcccggttacccggggggtccctaaccggtttcccgggcccgttacggggacccgtaaggggtcggacgtacgtaccgaaaacgaccgtgtacggctgaccaccgatctacgtccttctaccg

SEQ ID NO: 419817 - DNA, 598 bp, Homo sapiens
  misc_feature: GZ8MTXP02JXG3A.8.33.C11.1.454.CMB.2.raw
  modified_base (262)..(262): a, c, t, g, unknown or other
  modified_base (303)..(303): a, c, t, g, unknown or other
  modified_base (322)..(322): a, c, t, g, unknown or other
  modified_base (349)..(349): a, c, t, g, unknown or other
  modified_base (372)..(372): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtagtccagcctgggagtcacagagactctcctgtgcagccctntgggttcaccttcagtagctacggcatgcacgtgggtcccnccaaactccaggcaagggnttggagtgggtgctagttgttcatccnggagggctaggtgtcaatggtangctgacgcggtgaaacgggccgattccactatcctccagacgacaactacagaacacatagtattgacctagaacacgactaacgtcgtaggaaggacgtacgggtagttacgtaacgttaccgtaggttaaaccggaaagggggacgggggaaaccgagggaccggggtaacgttacccgtaacggttaccgttaccgtttacggaaccggttcggtaccggggg

SEQ ID NO: 419818 - DNA, 667 bp, Homo sapiens
  misc_feature: GZ8MTXP02JF81P.8.33.C11.1.454.CMB.2.raw
  modified_base (210)..(210): a, c, t, g, unknown or other
  modified_base (249)..(249): a, c, t, g, unknown or other
  modified_base (297)..(297): a, c, t, g, unknown or other
  modified_base (307)..(307): a, c, t, g, unknown or other
  modified_base (317)..(317): a, c, t, g, unknown or other
  modified_base (428)..(428): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgtttacacagtctccagccaccctgtctttgtctccgaggggaaanagcccaccctctcctgcagggccagtcagaatgttggcnccttgaagctggtaccaacacaactggccaggcctcccacggcccctnatctatggtncatccaacgngggcccacgtggccactcccgagccaggttcaggtggaccgaggtgggtatggggacagtacttcactctacaccatcaatcgacgtccgtaggacgtccgtaggaaagtnttggttacgacttaaggttttacttacgttagtaacctaaacgtacgtttaccggaaccggtacgggttccggtccccggggtacccgggggtacccttaccgggttttcccgggacccggttacggggaaccgtaacggggtacgggaaacgtacgttaaaccgaaaacggtacgttcgggtacggtcttaacggaaccgtaacctacgttcgtacgttcctttacgtactttccccg

SEQ ID NO: 419819 - DNA, 533 bp, Homo sapiens
  misc_feature: GZ8MTXP02FHG5Z.8.33.C11.1.454.CMB.2.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtacaacacaaacctggccaggctcccaggccccctcatctatggtgcatcccaacagggccactggcatcccagcccaggttcagtggcaggtgggtatggggacagcttcactctcaaccatcatcagccctggacgcctagaagatgttgctagtttatactgtacaactatcgtacgagtcgccgtccggggccacgtttcggcccgtgggaaccagggtcgagacgtacgaaaacgacgtagtggctgcgaccatcgtcgtcttctac

SEQ ID NO: 419820 - DNA, 603 bp, Homo sapiens
  misc_feature: GZ8MTXP02HVODA.8.33.C11.1.454.CMB.2.raw
  modified_base (209)..(209): a, c, t, g, unknown or other
  modified_base (243)..(243): a, c, t, g, unknown or other
  modified_base (249)..(249): a, c, t, g, unknown or other
  modified_base (256)..(256): a, c, t, g, unknown or other
  modified_base (262)..(262): a, c, t, g, unknown or other
  modified_base (268)..(268): a, c, t, g, unknown or other
  modified_base (276)..(276): a, c, t, g, unknown or other
  modified_base (284)..(284): a, c, t, g, unknown or other
  modified_base (303)..(303): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagccaccctctcctgcaggccagtcagatgtgcncttganctgacanacaacngcagcnccagcccnatctatgncatcaatggcatgcatccngccaggtcagtcggactaggtggtatggggacagcttcactccacacatcatcacgccgtaggacgccgtagaaagtagttgttagtaccgttagtttaacgttacgttacgtaacaactacgttacggtaccggtacggtcgggcccggttacccgggggtacccttaacccgggtttcccgggaccccggttacgggggaacccgtaaggggttacgggaaacgtacgtaaaccgaaaacggtacgtcggtacgggctaacggacctaacctacgtacgttcgttaccttactacccg

SEQ ID NO: 419821 - DNA, 567 bp, Homo sapiens
  misc_feature: GZ8MTXP02H6EIB.8.33.C11.1.454.CMB.2.raw
  modified_base (405)..(405): a, c, t, g, unknown or other
  modified_base (411)..(411): a, c, t, g, unknown or other
  modified_base (480)..(480): a, c, t, g, unknown or other
tcagctcgcgtgtccacgaccggtgctcgatttagagtgagctcgttgggttgggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtggggagcgtagtccagcctgggagtcacagagactctcctgtgcagccctctgggttcacctcagtagctacggcatgcacgtgggtccccgccaaactcccaggcaaaggggattggagtggggtgcagtttgttcatcctgagggcagtgttcaatggtatgctgacgccggtgaacggccgtatcaccatccnccaganacaactccagaacacaatgtatttggacctagaacagacctaagtccgtaggaggacgacgggtagtanaaccttacgacgtaacggaaggggacgggggaccgaggacggggaacgttaccgaaacgtacgtacgtttacgaacgtttcgcgggg

SEQ ID NO: 419822 - DNA, 586 bp, Homo sapiens
  misc_feature: GZ8MTXP02F8ZC0.8.33.C11.1.454.CMB.2.raw
  modified_base (208)..(208): a, c, t, g, unknown or other
  modified_base (244)..(244): a, c, t, g, unknown or other
  modified_base (289)..(289): a, c, t, g, unknown or other
  modified_base (299)..(299): a, c, t, g, unknown or other
  modified_base (309)..(309): a, c, t, g, unknown or other
  modified_base (435)..(435): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgtttacacagtctccagccaccctgtctttgctccaggggaaanagccaccctctcctgcagggccagtcagatgttgcncttcgagctggtaccaacacaacctggccaggctccaggcccctnatctatggtncatccaacgngggcccatggcatcccagccaggttcagtggccagtgggatgggacagcttcactctcaccatcatcacgctggacgcctagaagtatgttgactagtttactactgtacaactacgtcgtaccgnggtacggcccgtccgggggcctacggtttccggcccgtacggggacccgtaaggggtacgggacgtacgtaaccgtaaaacggtaaccgttggtacggccgttacggaaccaacccgtattccgtacgtttccttacctacgtttcccccg

SEQ ID NO: 419823 - DNA, 595 bp, Homo sapiens
  misc_feature: GZ8MTXP02FJIHG.8.33.C11.1.454.CMB.2.raw
  modified_base (276)..(276): a, c, t, g, unknown or other
  modified_base (324)..(324): a, c, t, g, unknown or other
  modified_base (411)..(411): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctcctgtgcagccctctgggttcaccttnagtagctacggcatgcacgtgggtcccaccaaactccaggcaaggggnttgggagtgggtgctagttgtttcatccgtggagggcaggtgttacaagttgggtatgctgacgcgtgaacgggcgtatcaccatcnccagacgacaactcaggacaacatgtattcgactacgaacacgacctaagtcctagacggtacgtacgggtagtactaccgtagtacgggtaaacggaaagggggaacgggggaaaccgacgggaccggggtaacggttaccgaaacgttaccgtaccgtttacggaccggttcgtaccggggg

SEQ ID NO: 419824 - DNA, 619 bp, Homo sapiens
  misc_feature: GZ8MTXP02F1O98.8.33.C11.1.454.CMB.2.raw
  modified_base (210)..(210): a, c, t, g, unknown or other
  modified_base (245)..(245): a, c, t, g, unknown or other
  modified_base (287)..(287): a, c, t, g, unknown or other
  modified_base (297)..(297): a, c, t, g, unknown or other
  modified_base (401)..(401): a, c, t, g, unknown or other
  modified_base (411)..(411): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagccaccctctcctgcagggccagtcagatgtgcncttgagctgtaccaacacaactgccaggctcccaggcccctnatctatggtncatccaacacggggcccacgtggccactccccagcccaggttcaggtcggactaggtgggtatggggacagacttcgactctacaccatcatcagccctaggancctagaacgnttggttacgactagttttacgttactgtactaactacgttaccggtaccggaggtccgggcccggttccgggggacccttaacggtttccggacccgttcggggaacccgtaaggggtcggaacgtacgttaaaccgaaaacggtaacgttggtacgggtacctaacggacccgaaaccttcgttaccgttcgtcctttacgtacccg

SEQ ID NO: 419825 - DNA, 518 bp, Homo sapiens
  misc_feature: GZ8MTXP02JSGEH.8.33.C11.1.454.CMB.2.raw
  modified_base (208)..(208): a, c, t, g, unknown or other
  modified_base (241)..(241): a, c, t, g, unknown or other
  modified_base (254)..(254): a, c, t, g, unknown or other
  modified_base (266)..(266): a, c, t, g, unknown or other
  modified_base (275)..(276): a, c, t, g, unknown or other
  modified_base (278)..(278): a, c, t, g, unknown or other
  modified_base (280)..(280): a, c, t, g, unknown or other
  modified_base (283)..(283): a, c, t, g, unknown or other
  modified_base (286)..(286): a, c, t, g, unknown or other
  modified_base (290)..(290): a, c, t, g, unknown or other
  modified_base (293)..(294): a, c, t, g, unknown or other
  modified_base (297)..(297): a, c, t, g, unknown or other
  modified_base (299)..(299): a, c, t, g, unknown or other
  modified_base (301)..(302): a, c, t, g, unknown or other
  modified_base (307)..(307): a, c, t, g, unknown or other
  modified_base (309)..(309): a, c, t, g, unknown or other
  modified_base (311)..(312): a, c, t, g, unknown or other
  modified_base (316)..(317): a, c, t, g, unknown or other
  modified_base (321)..(321): a, c, t, g, unknown or other
  modified_base (328)..(328): a, c, t, g, unknown or other
  modified_base (340)..(340): a, c, t, g, unknown or other
  modified_base (347)..(347): a, c, t, g, unknown or other
  modified_base (351)..(351): a, c, t, g, unknown or other
  modified_base (359)..(359): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgctccaggggaaangccacctctcctgcagggccagtcagatgtgcncttgagctgacanacaactgcagcnccagccctnntntntgncancagngcnngcncncnncagtngngnngtgnngganagtctcnctcacacatcancacgcgngacnctagagtntgtgattagttatactgtacaactacgtacgtacgtagtcggtccggtccggggtacctccggttccggcccgtacgggaccgtaacgggtacggacgaacgtaacgaaacggtacgtcggtacgacgtcgaccgaccgtactcgtacgttcttactcg

SEQ ID NO: 419826 - DNA, 565 bp, Homo sapiens
  misc_feature: GZ8MTXP02I5X69.8.33.C11.1.454.CMB.2.raw
  modified_base (204)..(204): a, c, t, g, unknown or other
  modified_base (236)..(236): a, c, t, g, unknown or other
  modified_base (250)..(250): a, c, t, g, unknown or other
  modified_base (256)..(256): a, c, t, g, unknown or other
  modified_base (272)..(272): a, c, t, g, unknown or other
  modified_base (282)..(282): a, c, t, g, unknown or other
  modified_base (384)..(384): a, c, t, g, unknown or other
  modified_base (406)..(406): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgctcagggaangccacctctcctgcaggccagtcagatgtgcncttgagctgtacanacaacngcagctccagcccctnatctatggtncatccaatacgggccacgtggcatcccagccaggttcagtcggacaggtggtatgggacagtacttcactctacaccatcatcagcctgacgcctagaacgntggtgactagtttacttacgtnttacaactatacgtaacggagttccggcccggtaccgggggtcctaccggtttcccggacccggttacggggaacccgtaaggggtcggaaacgtacgtaaacgaaaacgtacgtaggtcgacgtcggacctaaccgtataccgtcgttcctacgtacc

SEQ ID NO: 419827 - DNA, 590 bp, Homo sapiens
  misc_feature: GZ8MTXP02JXYKL.8.33.C11.1.454.CMB.2.raw
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtagtccagcctgggaggtcacagagactctcctgtgcagccctcgtggttcaccttcagtagctacggcatgcacgtgggtcccgaccaaactccgaggcaagggattggagtgggtgctagttgttcatccgtgagggctagtgttacaagtggtatgctgacgtccgtgaacgggccgtattcaccatcctaccgagacgacaactccagaacacaatgtagttaggacctagaacagacctaagtccgtagacggacgacggtagtacgtacgtacgtacggtaacggaaggggtacgggggaaccgagggacgggtaacgttaccgaaacggttacctaccgtttacggtaccggtcggtaccgggg

SEQ ID NO: 419828 - DNA, 531 bp, Homo sapiens
  misc_feature: GZ8MTXP02F58VO.8.33.C11.1.454.CMB.2.raw
  modified_base (209)..(209): a, c, t, g, unknown or other
  modified_base (306)..(306): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagaatgttggcgccttcgaagctggtaccaacacaaacctggccaggctcccaggcccctcatctatggtncatccaacagggccactggcatccccagccaggttcagtggcagtgggtatgggacagcttcactctcaccatcatcagcctgagcctgaagatgttgctagtttattactgtacaacatcgtacgagtcggccgtccgggggcacgtttccggcccgtacgggacccgaaggtcgggagactacaaaacgacgtagtggacctggcacactctacgtcttctac

SEQ ID NO: 419829 - DNA, 547 bp, Homo sapiens
  misc_feature: GZ8MTXP02JHUL4.8.33.C11.1.454.CMB.2.raw
  modified_base (209)..(209): a, c, t, g, unknown or other
  modified_base (244)..(244): a, c, t, g, unknown or other
  modified_base (250)..(250): a, c, t, g, unknown or other
  modified_base (258)..(258): a, c, t, g, unknown or other
  modified_base (281)..(281): a, c, t, g, unknown or other
  modified_base (291)..(291): a, c, t, g, unknown or other
  modified_base (300)..(300): a, c, t, g, unknown or other
  modified_base (379)..(379): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcggataccaccggagagattgtgttgacacagtctccagccaccctgtctttgtctccaggggaaangccaccctctcctgcagggccagtcagatgttgcncttganctgaccanacaactgcagctccaggcccctnatctatggtncatccaacngggccactggccatcccagcccaggtcagtgccagtggtatgggacagacttcactctcaccatccatcagcctggacncctgaagtatgttgactagtttattactgtacaactatcgtaccgagtcggccgtccgggggcctacgtttccggcccgtcgggaccgtaacgggtcggacgactaccgaaaacgtacgtcgtacggctacggaaccacgtacgtcgtacgttcttcctactttcccg

SEQ ID NO: 419830 - DNA, 768 bp, Homo sapiens
  misc_feature: GZ8MTXP02I0FRJ.8.33.C11.1.454.CMB.2.raw
  modified_base (283)..(283): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagccgtgggaggtcacagagactctcctgtgcagcctgtgggttccaccttcagtancgtacggcatgccacgtcgggtcccgaccaaaactccgaggacgaaggggtattggggagttggggtcggacgtaggttttgttccagttcccgtaggacgggtctaggttgttaccgaaagttgggtactgcgtgaccgccggtagggaacgggccgtaacttaccaccgtacgttacctaccgacgaacgaaccaaccgtaacccgaacgggaaacctaacgtaaactttaggttaacgttttaccggggaaccctttaacggaaaccgtaaccgtaaccccgttaaacggtcccgtaacgggtaacggtaaccggtaaccggggtacgttaaacgtaacgttaaccggtacgggttaaaaccgggaaacgggggtaaccggggggtaaaacccgtaacggggacccggggtaacgtttacccggaaacgggtttacccgttacccggtttaccggtaaccggttaccgggttaacccggggg

SEQ ID NO: 419831 - DNA, 528 bp, Homo sapiens
  misc_feature: GZ8MTXP02IVKGE.8.33.C11.1.454.CMB.2.raw
  modified_base (210)..(210): a, c, t, g, unknown or other
  modified_base (361)..(361): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagcccaccctgtctttgtctccagggggaaanagccaccctctcctgcagggccagtcagaatgttggcgccttgtaagctggtaccaacacaaacctggccaggcctcccagcccctcatctatggtgcatccaataggccatggcatcccagccaggttcagtcgcaggtggtatgggacngcttcactctcaccatcatcagcctggagcctagaagatagttgctagtttattactgtacaactatacgtacgagtcggccgtccgggggtcctcgttccggccgtgggaccgaggtcggagactacgaaacgacgtacggtgactgacacgactctgtactctac

SEQ ID NO: 419832 - DNA, 571 bp, Homo sapiens
  misc_feature: GZ8MTXP02HDH18.8.33.C11.1.454.CMB.2.raw
  modified_base (381)..(381): a, c, t, g, unknown or other
  modified_base (443)..(443): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctctgtgcagcctgtgggttccaccttcagtacgctacggcatgcacgtcgggtcccaccaaaactccgaaggacgaaagggtattggaggtgggtgctagtttgttcatccgtgaggcagttgtcaagtgtangctgacgcgtaggaacgggcctattaccacactcaccagaacgacaaactccgaagaaacanaatgtatttcgactagaacagacctaagctagacgacgaggtatactacgtagtacgaaacgggaagggacgggggaaccagggacgtaacgtacgaacgttctaccgtttggacgttcggaccgggg

SEQ ID NO: 419833 - DNA, 712 bp, Homo sapiens
  misc_feature: GZ8MTXP02JKZB0.8.33.C11.1.454.CMB.2.raw
  modified_base (177)..(177): a, c, t, g, unknown or other
  modified_base (272)..(272): a, c, t, g, unknown or other
  modified_base (282)..(282): a, c, t, g, unknown or other
  modified_base (342)..(342): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagnggtgtccagtgtcaagtgcaactggtggagtcgtgggggagcgtagtccagccgtgggagtcacagagactctcctgtgcagcctcgtggttccnccttcagtancgtacggcatgcacgtcgggtccaccaaacgtccgaggacgaagggtatgggaggtgggnggctagtttgttcagtccgtggagggtctaggttgttacgtaagttgggtatcggcgtgaaccggtcggtaggaacgggtaccgtacttaccgacctactccgtaccgagacgaaccaaccgtaccgaaacggtaaccaaacgtaaacgttagtttaacgttaccggaccttaacgaaacctacgtaacccgttaacggtaccgtaaggtaccggtaaccggtacggggtacgttaaaacgttacgtaccggttaacggggtaaacgggaaacgggggtaacgggggaaacccgtacgggtaccggggtaaccgttaacggaaacggtttacccgttaccggtttacggtaccggttcggtacccggggg

SEQ ID NO: 419834 - DNA, 700 bp, Homo sapiens
  misc_feature: GZ8MTXP02JYDAI.8.33.C11.1.454.CMB.2.raw
  modified_base (304)..(304): a, c, t, g, unknown or other
  modified_base (323)..(323): a, c, t, g, unknown or other
  modified_base (375)..(375): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagccgtgggagtcacagagactctcctgtgcagcctctgggttcaccttcagtagctacggcatgcacgtgggtcccnccaaactccaggcaagggnttggagtggggtggcagtttgttcatccgtgagggctagtgttcaagtgtangctgacgtccgtaggaacgggccgtattccgacctatccgtcccagacgaaccaaccgtaccgaacggtaacaacgaaagttagttaacgtttacggaacccgttacgaaaacgtaacggtaaccgttaaaacggttacccgtacggggaaacggtaaccgtaacgggggttacgttaacgttaaccgtaacgttacgggtaaaaccgggaaagggggtaaccggggggaaaacccgaacgggggtaccgggggtaacggttaacccggtaaaacggttaccgtttacccggtttacggtaaccggttcgggttaacccgggggg

SEQ ID NO: 419835 - DNA, 650 bp, Homo sapiens
  misc_feature: GZ8MTXP02FYCS3.8.33.C11.1.454.CMB.2.raw
  modified_base (296)..(296): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagatgttggcgccttgaagctggtaccaacacaaacctggccaggcctcccaggcccctnatctatggtgcactccaaacgaggggcccacgtggccactccccgagcccgaggttccagggtcgacgtagggtagggtaggtcggaacacgtctccacttctaccactactactactcgacgtccgtaggactccgtaagaagtgttgtacgtactttaagtttacttacgtacgtaacctaacgtacgttacccggtaacggtacggtcccggtcccggggttcccgggtaccctttaccggttcccgggaccggttacgggaaacccgtaagggggtcggaacgtaaccgtaaacgaaaaccggtcgtcggtcgtacgcgaccacgtacttcgtcgttacctacttacccg

SEQ ID NO: 419836 - DNA, 652 bp, Homo sapiens
  misc_feature: GZ8MTXP02F9MSZ.8.33.C11.1.454.CMB.2.raw
  modified_base (470)..(470): a, c, t, g, unknown or other
  modified_base (479)..(479): a, c, t, g, unknown or other
  modified_base (525)..(525): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagacgcccaccctctcctgccgacgggccagtcaagaattggttggccgtccttacgtaagctacggtaacccaaacaaccaaaccgtggaccaaggcctacccgacggccccctcacttcctagtgggtacacctactaccccaaacgacggggcccaacgtcggccaacctccccagccctagggtttccaggtcggacgtaggtggggtatggggaccaggtaccttcacttctaccacctatcatcagcccgtaggacnccgtagaanagttgttacgattagtttacttactgtacaacattaccggtaacgnggttcggacccggttccgggggacctacggtttcccgggcccgtacggggaaccgtaagggtcggaacgtactaaacgaaaacgtacgttggcggactcggaccactactcgtacgtcttactaccg

SEQ ID NO: 419837 - DNA, 620 bp, Homo sapiens
  misc_feature: GZ8MTXP02GR78D.8.33.C11.1.454.CMB.2.raw
  modified_base (383)..(383): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctcctgtgcagccctgtggtcaccttcagtacgctacggcagtgcacgtgggtcccgaccaaactccgaggcaaggggattgggaggtgggtgctagtttgttcatccgtaggagggtcagtgttacaagtggtangctggacgtcggtaggacgggccgtatcgacctactctacgagtacgaaccaacctaccgaacgaaacaactaagttagtacgtttacggaccttacggaaactaccgtaccgtaaacgtccgtaggacggacgtacggggtatactactacgtacggtaacggaaaggggacggggaccgaggacgggtaacgttaccaacggttccttacggttcggaccgttacggtaccgggg

SEQ ID NO: 419838 - DNA, 838 bp, Homo sapiens
  misc_feature: GZ8MTXP02GA7L7.8.33.C11.1.454.CMB.2.raw
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggaggtcacagagactctcctgtgcagcctcgtggttccaccttcagtagctacggcatgccacgtgggtccccaccaaactccaggacaaaggggtattgggaggtggggtggctaggtttgtttacatccgtggaggggctaaggttgtactaaagttggggtaatcggcgttacggaaccggtcccggttaaggggaaacgggggtcccgtaaactttacccgaacccgtaacttacccgtacccgaaacggaaccggtaaacccaaacccgttacccgaaaacgggaaaacctaaaccgtaaacgtttaacggtttaaacgtttttaccgggaaaccccgttaagggtaaaacccgaacggtaaccccgtttaaaacggttaccccgtttaagggaaaccggggtaaaccggtaacgggggttaacggttaaaaccttaaacccgttaaacggttaacggggttaaaaccgggggaaaacgggggtaaacgggggggtaaaacccgaacgggggtaaccggggtaaacggttttaaccccgaaaacggtttacccgtttacccgttttacgggaacccgggtttacgggttaacccgggggg

SEQ ID NO: 419839 - DNA, 603 bp, Homo sapiens
  misc_feature: GZ8MTXP02HT0E5.8.33.C11.1.454.CMB.2.raw
  modified_base (210)..(210): a, c, t, g, unknown or other
  modified_base (244)..(244): a, c, t, g, unknown or other
  modified_base (250)..(250): a, c, t, g, unknown or other
  modified_base (258)..(258): a, c, t, g, unknown or other
  modified_base (264)..(264): a, c, t, g, unknown or other
  modified_base (278)..(278): a, c, t, g, unknown or other
  modified_base (287)..(287): a, c, t, g, unknown or other
  modified_base (295)..(295): a, c, t, g, unknown or other
  modified_base (344)..(344): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccacctgtctttgtctccgaggggaaanagccaccctctcctgcaggccagtcagatgtgcncttganctgtacanacaacngcagctccagcccnatctatgtncatccaanggccagtgcatccagcctaggtcagtcgcagtggtatgggacagtcctnaactatccaaccatcatcacgcctagggactccgtagaaagtagttggttacgacgttaagttttaacttacgttaggttacctaaactagtacccgtaaccggtaggttcgggacccggttacccgggggtaccttaccggtttcccgggccccgttacgggggaaacccgtaaggggttacggaaacggtaactaaccggaaaaacggtaccgtaggtacggactaaggaccaccgtactcgttcgtacttactccg

SEQ ID NO: 419840 - DNA, 621 bp, Homo sapiens
  misc_feature: GZ8MTXP02GHUJJ.8.33.C11.1.454.CMB.2.raw
  modified_base (303)..(303): a, c, t, g, unknown or other
  modified_base (326)..(326): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctcctgtgcagcctctgggttcaccttcagtagctacggcatgcacgtgggtcccnccaaactccgaggacaaggggtnttgggagtggggtggctagtttgttcagttccgtggagggtcaggttgttcaagttgggtatggctgaccgccggtaggaacggggccgtattccgacctactcctacccgagacgaacaacctaccgaaggaaccaactaaagtagttacgtttacggacctagaaccacgaccgtaacgtcctaggacggacgtacgggtagtacgtactacgtacggtaaacggaaggggtacgggggaaccagggacgggaagttaccgaacgtacgttcgttacggtacgtcgtacgggg

SEQ ID NO: 419841 - DNA, 691 bp, Homo sapiens
  misc_feature: GZ8MTXP02FYT2L.8.33.C11.1.454.CMB.2.raw
  modified_base (324)..(324): a, c, t, g, unknown or other
  modified_base (337)..(337): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggaggtcacagagactctcctgtgcagcctctgggttcaccttcagtagctacggcatgcacgtgggtcccacaaactccgaggcaaggggnttgggagtggggngtctagttgttcatccgtgagggcagtgttacaagtggtatgcgtcgacgtcgtagggaacggggtccgtacgttccaaccctatccgtacccgaggtacgaaccaacctaccgaaagggtaaaccaaacgtaaagttaggttacgtttacgggaaccctaggaaaccgtaaccgtacccgtaaacggttcccgtaggtaacgggaaccgtacgggggttagttaaccgtaacgttaccgtacgggtaaacgggaaacgggggtaacggggggaaaacccgacggggtacgggggtaacgttaccgtaaacggtttacggttacccgtttacggaccggttacggtaccggggg

SEQ ID NO: 419842 - DNA, 669 bp, Homo sapiens
  misc_feature: GZ8MTXP02HOUF9.8.33.C11.1.454.CMB.2.raw
  modified_base (211)..(211): a, c, t, g, unknown or other
  modified_base (246)..(246): a, c, t, g, unknown or other
  modified_base (252)..(252): a, c, t, g, unknown or other
  modified_base (260)..(260): a, c, t, g, unknown or other
  modified_base (266)..(266): a, c, t, g, unknown or other
  modified_base (282)..(283): a, c, t, g, unknown or other
  modified_base (285)..(285): a, c, t, g, unknown or other
  modified_base (289)..(289): a, c, t, g, unknown or other
  modified_base (293)..(293): a, c, t, g, unknown or other
  modified_base (303)..(303): a, c, t, g, unknown or other
  modified_base (308)..(308): a, c, t, g, unknown or other
  modified_base (340)..(340): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagcccaccctgtctttgtctccgaggggaaagngccaccctctcctgcagggccagtcagatgtggcncttganctgtacanacaacngcagctccagcccctnntngtgncacncagcggcagngcacnccagccgtaggtcagtcggcgtaggtggtagnggactagtccttcactccaccactatcatccgacgtccgtaggacgtacgtaagtaacgtgtttacggttacgtaacgtttagttttaacttacgttacgttaacctaaaccgttacgtacccggttaaccgggtacgggttcccgggtaccccggggttaccccgggggtaccctttacccgggtttcccgggaccccgggttaacggggaaacccggttaaaggggtacgggaaacgttaaaccgtaaaccggtaaaacgtacggttacggtacggaccgtaacgacccgtaaccgtacttaccgtttcgttacctttacgtacccg

SEQ ID NO: 419843 - DNA, 621 bp, Homo sapiens
  misc_feature: GZ8MTXP02GLXB1.8.33.C11.1.454.CMB.2.raw
  modified_base (294)..(294): a, c, t, g, unknown or other
  modified_base (304)..(304): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgttctttgtctccgaaggggaaagagccaccctctcctgcagggccagtcagatgttggcgcttgagctggaccaacacaaacctggccaggctcccaggcccctnatctatggtncatacccaacacggggccacgtggccatccccagccaggttccaggtcggctaggtgggtatggggacagtcttcactctaccaccatcatcagcctggacgcctagaagtattgttagcttagtttacttactgtacaactatacgtaccggagttccgggccggttaccccgggggccttaccggtttccggggaccccgttagggggaacccgtaaaggggttcgggaacgtaaacgtaccgaaaacggtaaccgttgggtacggtacgttaacgacctaacctacgttcgttacgtttacctttcttaacccg

SEQ ID NO: 419844 - DNA, 678 bp, Homo sapiens
  misc_feature: GZ8MTXP02GMLKV.8.33.C11.1.454.CMB.2.raw
  modified_base (310)..(310): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccaccctgtctttgtctccgaggggaaagacgccaccctctcctgcagggccagtcagatgttgcgtcttgtaagctggacaacacaacctggccaggcctcccgacggcccctcactctagtggtcncactccaaagcggggcccacgtcggcctactcccgaggcctagggttccagggtcggacgtagggttggggtagtcggggaacaggtacctttcgaccttcctaccaccctatccaactccgacgtcctagggacgccctaggaaagtgttgttacgtacttagtttacttagtagttaccaacgtacgtccggtaaccggtacgtccggggtaccccggttccgggggtcccttaccggtttcccgggacccgtacgggggaaacccgtaaggggttcggaaacgtaaccgttaaccggaaaccgtaacgttcgggtacggtacctcggtaccaacccttgttccgtacgtttccttacgttacccg

SEQ ID NO: 419845 - DNA, 575 bp, Homo sapiens
  misc_feature: GZ8MTXP02FVTJW.8.33.C11.1.454.CMB.2.raw
  modified_base (302)..(302): a, c, t, g, unknown or other
  modified_base (322)..(322): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtagtccagcctgggaggtcacagagactctcctgtgcagcctctgggttcaccttcagtagctacggcatgcacgtgggtccnccaaactccaggcaaggggnttggagtgggtggctagttgttcatccgtggagggcaggttgttacaatggggtatggtcgtgaccgtcgtaggaacgggccgtattccgacactctccagacgacaactccagaacacaatgtattgactagaacacgacctaagtcctaggagacgacgggtagtactacgtactacgtaacggaacgggacgggggaacacggacgggaagttccgaaagtaccgtcgtttacggacggtcggtacgggg

SEQ ID NO: 419846 - DNA, 582 bp, Homo sapiens
  misc_feature: GZ8MTXP02H6L0R.8.33.C11.1.454.CMB.2.raw
  modified_base (289)..(289): a, c, t, g, unknown or other
  modified_base (407)..(407): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagcgccaccctctcctgcaggccagtcagatgtgcgcttgagctggtaccaacacaacgtgccaggcctcccaggcccctnatctatggtgctatccaaacgacgggccaacgtcggacacgtcccagcctagggttcaggtcggacagggtcgggtatcggggacagtcttcactcctcaccatcatcagcctggacncctagaagtatgtacgacttagtttatactgtacactacgtcgacgaggtcggccgtccgggggtctacggtttcccggaccgtacggggaaccgtaaaggggtcgaacgtacgtaacgaaaccggtagtcggtacggcctaagaccaacgtacttcgtcgttctttacgtaccc

SEQ ID NO: 419847 - DNA, 582 bp, Homo sapiens
  misc_feature: GZ8MTXP02G9E3P.8.33.C11.1.454.CMB.2.raw
  modified_base (420)..(420): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagccgtgggagtcacagagactctcctgtgcagcctctggttcaccttcagtagctacggcatcgcacgtgggtcccaccaaactccgaggacgaagggattggaggtggggtggctagtttgttcatccgtggaggtcagttgttacaatggtatgctgacgcgtagacggcatcacatctcagacgacaacncagacacaatgtagttcgactagaacacgacctaagtcctagacggacgtaggtatactacgtacgtacggtaacggaaacggggacgggggaaccgaggtacggggaacgttaccgtaaacggttaccgttaccgtttacggtacggtccggtaccggggg

SEQ ID NO: 419848 - DNA, 567 bp, Homo sapiens
  misc_feature: GZ8MTXP02IXJ9P.8.33.C11.1.454.CMB.2.raw
  modified_base (302)..(302): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtagtccagcctgggaggtcacagagactctcctgtgcagcctctgggttcaccttcagtagctacggcatgcactgggtcccnccaaactccaggcaagggattggagtgggtgctagtttgttcatcctgaggcagtgttcaatgggtatgctgacgcgtagagggcgattcacatctcagacgacaactccagaacacaattagtatttagacctagaacagaccgtaacgtcctaggaggacgacgggtagtactactacgtacggtaacggaacgggtaacgggggaaccgacggacgggtaacgtaccgaacgttacgtcgtttacgacggttcggtacgggg

SEQ ID NO: 419849 - DNA, 600 bp, Homo sapiens
  misc_feature: GZ8MTXP02F7S01.8.33.C11.1.454.CMB.2.raw
  modified_base (210)..(210): a, c, t, g, unknown or other
  modified_base (274)..(274): a, c, t, g, unknown or other
  modified_base (302)..(302): a, c, t, g, unknown or other
tcagctcgcgtgtccacgaccggtgctcgatttagagtgagctcgttggggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaanagccaccctctcctgcagggccagtcagaatgttggcgccttgaagctggtaccaacacaaacnggccagctccacgccctcatctatggtncatccaacacgggccactggacactcccagccaggttcagtcggcaggtgggtatgggacagacttcactctacaccatcatcacgtcctggacgctagaagatgttgacttaagtttattactgtacaaactagtaccgtaaccggtaggtccgggtcccggtccgggggtaccctaccggtttcccgggacccgttacggggaacccgtaaggggttacggaagaacgtaaccgaaaacggtaacgtaggtggaccgtcggacctaaccgtacttcgtacgttacctttactaccg

SEQ ID NO: 419850 - DNA, 542 bp, Homo sapiens
  misc_feature: GZ8MTXP02FYNY2.8.33.C11.1.454.CMB.2.raw
  modified_base (209)..(209): a, c, t, g, unknown or other
  modified_base (291)..(291): a, c, t, g, unknown or other
  modified_base (297)..(297): a, c, t, g, unknown or other
  modified_base (301)..(301): a, c, t, g, unknown or other
  modified_base (398)..(398): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaangccaccctctcctgcagggccagtcagaatgttggcgcttgaagctggtaccaacacaaactggccaggctccaggcccctnatctanggtncatccaacacgggccactggacactcccagccaggttcagtcggcaggtgggtatggggacagtacttcacgtctacaccatcatcagccctggacnccagaagattgtgctagtttattactgtacaaactagtccgtacgagtcggcccgtccgggggtcctacgttcggcccgtgggaccaagggtggacgacgtacgaaaacgtacgtacggtgctgcaccgagtcctgtctctacc

SEQ ID NO: 419851 - DNA, 710 bp, Homo sapiens
  misc_feature: GZ8MTXP02JQLYN.8.33.C11.1.454.CMB.2.raw
  modified_base (292)..(292): a, c, t, g, unknown or other
  modified_base (301)..(301): a, c, t, g, unknown or other
  modified_base (311)..(311): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgttctttgtctccaaggggaaagagcccaccctctcctgcaggccagtcagatgttggcgcttcgaagctggtaccaacacaactgccaggctcccagcccctnatctatggncatccaacgnggccagtggacactcccagcctaggtcagtcggacgaggttgggtacgtgggacctagtacctttcgaacttccgaccaccgtaatccattaccgacggcccgttagggacgacccgttggaaacgtagtacggtttcgtaccttagttttaacgttacgttagttaaccaaaccgttacggttacccggttaaaccgggacggttaccgggtcccccggggttaccccggggggtaccctttaaccccgggtttcccggggaccccggtttaacgggggaacccgtaacgggggttacggaacgttaaacgtaacccggaaaacggtaccgtagggttaccgggacttaaccgggaccgttaaccctagttaccgtttccgttaccgttacctacccg

SEQ ID NO: 419852 - DNA, 550 bp, Homo sapiens
  misc_feature: GZ8MTXP02G53ZZ.8.33.C11.1.454.CMB.2.raw
  modified_base (208)..(208): a, c, t, g, unknown or other
  modified_base (243)..(243): a, c, t, g, unknown or other
  modified_base (250)..(250): a, c, t, g, unknown or other
  modified_base (259)..(259): a, c, t, g, unknown or other
  modified_base (281)..(281): a, c, t, g, unknown or other
  modified_base (290)..(290): a, c, t, g, unknown or other
  modified_base (300)..(300): a, c, t, g, unknown or other
  modified_base (398)..(398): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgctccaggggaaanagccaccctctcctgcagggccagtcagatgtgcncttgaanctgtacaanacaactgcagctccaggccctnatctatggngcatccaacnggccagtggcatcccagccaggttcagtcgcaggtgggtatggggacaggtcttcactctaccaccatccatccagcccgtggacgtcctagaaagtntgttagctagtttacttacgtgtacaactatcgtacgagtcggtaccgtccggggcctacgtttccggcccgtagggaccgtaaggtcggagacgttacgaaaacgacgtggtacgacgtcggactaccgtactcgtacgttactactaccg

SEQ ID NO: 419853 - DNA, 680 bp, Homo sapiens
  misc_feature: GZ8MTXP02IPFC5.8.33.C11.1.454.CMB.2.raw
  modified_base (210)..(210): a, c, t, g, unknown or other
  modified_base (293)..(293): a, c, t, g, unknown or other
  modified_base (303)..(303): a, c, t, g, unknown or other
  modified_base (332)..(332): a, c, t, g, unknown or other
  modified_base (362)..(362): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagcccaccctgtctttgtctccgaggggaaanagcccaccctctcctgcagggccagtcagatgtggcgtccttgagctaggtaccaacacaactggccagctccaccgccctcntctagtggtncatccaagtcggccacgtggccactcccngaccaggttcaggtcggcagggtgggtagngggaccagccttcactcctcaaccatcatacacgtaccgtgggacaccgtagaacgtagttgttacggtacttaagttttacttaaacgtcgtaaccaaccgttacgtaccgggttacccggtagggttccccgggtacccgggttaccccgggggtaccccttacccgggttttcccggggacccccggtttaggggaaaccccggtaagggggttcggaacggtaaacgttaacccggaaaaacggttacgttcggggtaaccggtcgtcgacccgtaaccgtacgttcccgttacggtttcctttaacccttccg

SEQ ID NO: 419854 - DNA, 575 bp, Homo sapiens
  misc_feature: GZ8MTXP02I0BOK.8.33.C11.1.454.CMB.2.raw
  modified_base (209)..(209): a, c, t, g, unknown or other
  modified_base (264)..(264): a, c, t, g, unknown or other
  modified_base (292)..(292): a, c, t, g, unknown or other
  modified_base (302)..(302): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagatgttgcgcttgtaagctggtaccaanacaaacctggccagctcccaggcccctnatctatggtncatccaaacacgggccacgtggaccactcccagccaggttcagtcggcaggtggtatgggacagcttcaactctacaccatccatcagcctggacgccgtagaaagtatgttgctagtttattactgtacaaactatacgtaccgaagtcggcccgtccgggggacctacgtttccggcccgtaggggacccgtaaagggtcggaacgtacgtaccgaaacggtaacctggtacggcgtaacggcctaccgacttccgtacgtcttactaccg

SEQ ID NO: 419855 - DNA, 585 bp, Homo sapiens
  misc_feature: GZ8MTXP02G8654.8.33.C11.1.454.CMB.2.raw
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctcctgtgcagcctcgtcgggttccaccttcagtacgctacggcatcgcacgtcgggtccccaccaaaactccgaggacgaaggggattgggagtggggtgcgtagtttgttcagtccgtggaggctagttgtacaagtgtatgctgacgcgtagacggcatcacatctacgagacgacaactcagaacacaatgtattacgactagaacacgacctaacgtcgtaggacgtacgtacgggtataactacgtacgtacggtaacgggaaacgggacggggaaaccagggacggtaacgtaccgaaagttacccgtacgttacgacggtacgtccgggg

SEQ ID NO: 419856 - DNA, 579 bp, Homo sapiens
  misc_feature: GZ8MTXP02G7VLZ.8.33.C11.1.454.CMB.2.raw
  modified_base (300)..(300): a, c, t, g, unknown or other
  modified_base (310)..(310): a, c, t, g, unknown or other
  modified_base (390)..(390): a, c, t, g, unknown or other
  modified_base (394)..(394): a, c, t, g, unknown or other
  modified_base (408)..(408): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagaatgttggcgccttgtaagctggtaccaacacaaacctggccaggcctcccgacggcccctnatctatggtncatccaagacgggccacgtggcactcccagccaggtcaggtgcagtggtagtgggaacagtaccttcactctaccaacanctanccagcccgtggacncctagaagtatgtagactagtttattaaacctgtacaactacgtacggtacgagtcgccggtcccgggggacctacgtttccggaccgtcgggaaccgaagggtcgaggactaccgaaaacggtacgtgtacggactcgccaaaccgtctcgtacttacctttctaacccg

SEQ ID NO: 419857 - DNA, 554 bp, Homo sapiens
  misc_feature: GZ8MTXP02HIIGD.8.33.C11.1.454.CMB.2.raw
  modified_base (210)..(210): a, c, t, g, unknown or other
  modified_base (250)..(250): a, c, t, g, unknown or other
  modified_base (256)..(256): a, c, t, g, unknown or other
  modified_base (268)..(268): a, c, t, g, unknown or other
  modified_base (277)..(277): a, c, t, g, unknown or other
  modified_base (286)..(286): a, c, t, g, unknown or other
  modified_base (296)..(296): a, c, t, g, unknown or other
  modified_base (370)..(370): a, c, t, g, unknown or other
  modified_base (412)..(412): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagccacctctcctgcagggccagtcagatgtgcgcttgantgacanacaactgcagcnccagccctnatctatggncatccaacgnggccacgtggcactcccgagccaggttcaggtcggcaggtgggtatggggacaggtacttcgactctaccaccntcaatcagccgtgagctagagtattgtgctagtttatacttntactaaactagtcgtaacgacgtggcccgtccgggggcctacggtttccgggcccgtacggggaacccgtaacgggtaggaagtaacgtacgtaaaacgtaacgtcggtagacgtgaccaccgtatcgtcttccttactccg

SEQ ID NO: 419858 - DNA, 601 bp, Homo sapiens
  misc_feature: GZ8MTXP02HTS4I.8.33.C11.1.454.CMB.2.raw
  modified_base (329)..(329): a, c, t, g, unknown or other
  modified_base (444)..(444): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgcttcttttaagaggtgtccagtgtcaagtgacaactggtggagtcgtgggggagcgtagtcagccgtgggagtcacagagactctctgtgcagcctcgtggttcaccttcagtagctacggcatcgctacgtcgggtcccaccaaactccgaaggcgaagggnttgggagtggggtgctagtttgttcatccgtagcggggtctaggttgttacaagtgggtatgctcgacgtccggtaggaacgggccctatccgacactcctacgagacgacaacnccgagaacaatatgttattacgactagaacagtaccctaagtccgtaggaacggacgtacgggtatacgtaacgtacgtacgtaaacgggaacgggacgggggaacgaggacgggtaacgtacgaacgtaccgtacgtttacgaccgttcggacggg

SEQ ID NO: 419859 - DNA, 648 bp, Homo sapiens
  misc_feature: GZ8MTXP02JNQXL.8.33.C11.1.454.CMB.2.raw
  modified_base (209)..(209): a, c, t, g, unknown or other
  modified_base (310)..(310): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagcccaccctctcctgcagggccagtcagaatgttggcgtccttcgtaagctcggtaaccaacaacaaaccgtggccacggcctaccccacggccccctanactcctagtggtcgcactacccgaacgacggggcccacgtggccactccacgccaggttcaggtcggcaggtgggtagtggggacagtcttcacctctaccactatccatcacgtacccgtggacgccgtagaagtactggttacgtcttaaggttttacttaccgtagtaacctaaactcgttaccggtacggtacggtcccggggtcccggttacccgggggtaccctaccggttttcccggggacccgttacggggacccgtaaaggggttcggaaagtaacgtaccgaaaacgtaacgtcgtacggtctcgacacctgtactcgtcctactccg

SEQ ID NO: 419860 - DNA, 651 bp, Homo sapiens
  misc_feature: GZ8MTXP02ISQ9Q.8.33.C11.1.454.CMB.2.raw
  modified_base (209)..(209): a, c, t, g, unknown or other
  modified_base (244)..(244): a, c, t, g, unknown or other
  modified_base (250)..(250): a, c, t, g, unknown or other
  modified_base (256)..(256): a, c, t, g, unknown or other
  modified_base (261)..(261): a, c, t, g, unknown or other
  modified_base (276)..(276): a, c, t, g, unknown or other
  modified_base (286)..(286): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaanagccaccctctcctgcagggccagtcagatgtgcncttgantgacancaacngcagctccagccctnatctatggtncactccaacgcgggccacgtggccatccccgagccaggttcagtcggctaggtgggtatgggacagtacttcacttctccacctatcaactcgacgtcctagggacgcctagaagattggttacgtacgttaagtttacttacgttacggtacctaaaccgtagtacccgggttaacggtaccgggttccggggtaccccggttcccggggggtacccttaaccggtttccccgggtacccgttacggggaacccgtaaaggggttcggaaacggttacggtaaaccgaaaaccggtacgttacggtaccggggtactccggtaccctaaccgtacgttccgttacgttccctttacttaacccg

SEQ ID NO: 419861 - DNA, 650 bp, Homo sapiens
  misc_feature: GZ8MTXP02ILDQZ.8.33.C11.1.454.CMB.2.raw
  modified_base (208)..(208): a, c, t, g, unknown or other
  modified_base (295)..(295): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccacctgtctttgtctccgaggggaagngccacctctcctgcagggccagtcagatgtgcgcttcgagctggtacaacacaacctggcaggctcccacgcccctcatctatggtncataccaagtcggccactggacactcccacgccgaggttcaggtcggcgtaggtggggtaatggggaccaggtacctttccaccttccgtaccaacctatccaactcgacgcccgttagggacgtcctaggaagtacgttgttcgtacttagttttaacgttactggttaacctaaacgtacgttaccggtaaccgggtacggtccggggtccccggtcccggggggtacccttacccggtttcccgggacccggtacggggtacccggtaaggggttaggacggtaacgtaacgaaaacgtacgtacgggtacggtactcggaccaccgtacgtccgtacgttccttactaccg

SEQ ID NO: 419862 - DNA, 674 bp, Homo sapiens
  misc_feature: GZ8MTXP02GB3A4.8.33.C11.1.454.CMB.2.raw
  modified_base (251)..(251): a, c, t, g, unknown or other
  modified_base (280)..(280): a, c, t, g, unknown or other
  modified_base (395)..(395): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccacctctcctgcaggccagtcagatgttgcgcttgtanctgacacacaactgcagctccacgccctnatctatggtgcactccaacgacgggccacgtggcactccccgagcccgtaggttcaggtcggctaggtgggtagtggacagtcttcactctacacctatcatcagtccgtggacncctagaaacgattggttagacgttaagttttacttacgttacgtacctaaacgtacgttaccggtaacccgggtaggttcccgggaccccggggtttccccggggggaccctttaacccgggttttacccggggcccccggttacgggggaaacccgtaaaacgggggttgggaaacggtaaacgttaaacccggaaaaaccggtaacgtttacggggtacggtaccgtaacggtaaccctaacgttacgttccgtttacgttacctttaccgtaaccg

SEQ ID NO: 419863 - DNA, 619 bp, Homo sapiens
  misc_feature: GZ8MTXP02HCYBZ.8.33.C11.1.454.CMB.2.raw
  modified_base (304)..(304): a, c, t, g, unknown or other
  modified_base (322)..(322): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctcctgtgcagccctcgtgggttcaccttcagtagctacggcatgcacgtgggcccncaaactccaggcaagggnttggagtgggtgcagtttgttcatccgtgagggctagtgttacaagtgggtactgctgacgtccggtaggaacgggcccgtattccaccgatcctaccgagacgaacaacgtccaaggaacaactaagtagttagtttcggacctaggaaacacgaccgtaagtccgtaggaacggacgtacgggtgtaactacgtacgtacggtaaacggaaggggtacgggggaaccgacgggtacggggtaacgttacccgtaacggttaccttaccggtttacggaccggttcggtacggggg

SEQ ID NO: 419864 - DNA, 692 bp, Homo sapiens
  misc_feature: GZ8MTXP02GHH66.8.33.C11.1.454.CMB.2.raw
  modified_base (504)..(504): a, c, t, g, unknown or other
  modified_base (678)..(678): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccagggggaaagcgccacctctcctgcgacggccagtcaagtagttggttcggccgtccgttacggtaacgtcgtacggtaacccaaacaaccaaaccgtcggaccgacggtccctaccccggaccggtccccctactactaccgttagtgggtcactactacccgaaaggtaccgggcctacggtcggactacctcccgacgccgtaggtcgaggtccggacgtaggggtagggtaggtcggggaacacggtccttacacgtctaccacctatacactcgacgtcccgtggacctcgtaagaagtnttggttacgactttaaagtttacttacgtactaaccaagttacgttaccggtaacgggtggtccccggtacccgggttcccggggttacctaccgggtttcccgggaccggttacggggaaccgtaggggtacggaataccgtaacgtaaacggtcgtggcgtcaacgcaactntcgtactctacgtc

SEQ ID NO: 419865 - DNA, 518 bp, Homo sapiens
  misc_feature: GZ8MTXP02FJQ5Q.8.33.C11.1.454.CMB.2.raw
  modified_base (208)..(208): a, c, t, g, unknown or other
  modified_base (245)..(245): a, c, t, g, unknown or other
  modified_base (294)..(294): a, c, t, g, unknown or other
  modified_base (304)..(304): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccggccaccctgtctttgtctccaggggaaangccaccctctcctgcagggccagtcagaatgttggcnccttcgaagctggtaccaacacaacctggccaggctcccaggccccctnatctatggtncatccaatagggccatggcactcccagccaggtcagtggccagtgggtatgggacagacttcactctcaccatcatcagctggagctgaagatgttgctagtttatactgtacaacatcgtacgaggtcgccgtccgggggcctacgtttcggcccgtagggaccgaaggtcggagatacgaaacgactgtcgctgcacactctgtctcactcc

SEQ ID NO: 419866 - DNA, 699 bp, Homo sapiens
  misc_feature: GZ8MTXP02H4DUD.8.33.C11.1.454.CMB.2.raw
  modified_base (210)..(210): a, c, t, g, unknown or other
  modified_base (297)..(297): a, c, t, g, unknown or other
  modified_base (311)..(311): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanacgccaccctctcctgcagggcagtcagaatgtgcgcttcgtaagctggtaccaacacaacctggccaggcctcccgacggcccctnactctacgtggtcnccatacccaacgaggggcccaacgtcggacacgtccccagccccgtaggttccaggtcggacaggtgggtatgggacagtccttcgactcctacaccagtcactacacgtccgtaggacgccgtagtaaagtagttcgttcgtacgttacgttttaacttacgttacgttactaacgtacgttaccggtaccggtaacgggtcgggtaccccggttcccgggggtacccttaacccgggtttcccgggtacccggttacgggggtaacccggtaaacgggggtacgggtacggtaaaccgtaaccggaaaaccggtaaaaccggtcggttacgggacgttaacggaccctaacgtaacgttccgtacggttacctttaccggtacccg

SEQ ID NO: 419867 - DNA, 635 bp, Homo sapiens
  misc_feature: GZ8MTXP02FUNU9.8.33.C11.1.454.CMB.2.raw
  modified_base (177)..(177): a, c, t, g, unknown or other
  modified_base (325)..(325): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagnggtgtccagtgtcaagtgcaacgtggtggagtctgggggagcgtagtccagcctgggaggtcacagagactctcctgtgcagcctgtggtcaccttcagtagcgtacggcatgcacgtgggtcccaccaaactccgaggacgaaggtnttgggaggtggggtggactagtttgtttcagttccgtaggagggtctaggttgttaccgaaagttggggtactggtacgtcggaccgtcggtaggaaacgggccgtattccacattccaccagacgaacaacctcgaaacgaacaacaagttagttacgtttacgacctaggaaacacgtaccgtaaacgtccgtaaggacggaacgtacgggtacgtaactacgtagtacggtaacggaaaggggtacggggaacaggtacgggtaacgttaccgaagttaccgtcgtttacgaccggttcgtacgggg

SEQ ID NO: 419868 - DNA, 701 bp, Homo sapiens
  misc_feature: GZ8MTXP02IK4I7.8.33.C11.1.454.CMB.2.raw
tcagctcgcgtgtccacgaccggtgctcgatttagagtgagctcggttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacgagagactctcctgtcgcagcctcgtggttcaccttcgagtagctacggcatcgcacgtcggtccgaccaaactccgaggacgaagggtactgggaggtcgggtggcgtagttgttcagtccgtgagggtctagtgttacagtgggtatgtcctggacgtcggtaggacgggccgtagttaccaccgtactacctaccgaacgaaccgtaaccaaaccgtaccgaacgggtaaacctaaacgtacgtacgttaacggttaccgtaaccgttacggaaaaccgtccggtaacccgtaaacgttcccgtaagggacgggtaaaccggtaccggggttaagttaacgtaaccgtacggttacggtaaaaccggggaacgggggtaacgggggaaccgaacggggtacggggtaacgttaaaccggtacgttaccgttcgttacggtaccggtacggtccgggg

SEQ ID NO: 419869 - DNA, 595 bp, Homo sapiens
  misc_feature: GZ8MTXP02GYQLN.8.33.C11.1.454.CMB.2.raw
  modified_base (209)..(209): a, c, t, g, unknown or other
  modified_base (247)..(247): a, c, t, g, unknown or other
  modified_base (289)..(289): a, c, t, g, unknown or other
  modified_base (371)..(371): a, c, t, g, unknown or other
  modified_base (386)..(386): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagcccaccctgtctttgtctccaggggaaanagccaccctctcctgcagggccagtcagaatgttggcnccttgaagctggacaacacaactggccaggctccagcccctnatctatggtgcatccaatacgggccactggcatccccagccaggttcagtcggcagtgggatgggacagctcactctcaccntcatcagcctggacncctagaagtatggttgactagtttacttacgtgttacaactagtacgtaccggagtccggaccccggttccgggggcccttaaccggtttcccggggaccccgttacgggggaacccgtaaaggggtcggaaagtaacgtaaccgaaaacggtaaccgtggtacggacgtcggaccaaaccctagttcctcgttacctttaccttaacg

SEQ ID NO: 419870 - DNA, 545 bp, Homo sapiens
  misc_feature: GZ8MTXP02HX42G.8.33.C11.1.454.CMB.2.raw
  modified_base (210)..(210): a, c, t, g, unknown or other
  modified_base (248)..(248): a, c, t, g, unknown or other
  modified_base (284)..(284): a, c, t, g, unknown or other
  modified_base (294)..(294): a, c, t, g, unknown or other
  modified_base (423)..(423): a, c, t, g, unknown or other
  modified_base (441)..(441): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagccaccctctcctgtagggccagtcagaatgttggcncttgtaagctggtaccaacacaaacctggccaggcnccagcccctnatctatggtgcatccaacagggccacgtggcatcccagccaggttcaggtgccaggtgggtatggggacagacttcactctcaccatcatcagcctggacgcagaagtatgttagctaagtttattacngtacaactagtcgtacgngtcggccgtcggggcctacgttcggccctgggaccagggtcgagactacgaaaacgacgttcggacgtctggaacctaccgtatctgtacctttcacttccccg

SEQ ID NO: 419871 - DNA, 531 bp, Homo sapiens
  misc_feature: GZ8MTXP02G2ALR.8.33.C11.1.454.CMB.2.raw
  modified_base (209)..(209): a, c, t, g, unknown or other
  modified_base (245)..(245): a, c, t, g, unknown or other
  modified_base (257)..(257): a, c, t, g, unknown or other
  modified_base (263)..(263): a, c, t, g, unknown or other
  modified_base (269)..(269): a, c, t, g, unknown or other
  modified_base (277)..(277): a, c, t, g, unknown or other
  modified_base (283)..(283): a, c, t, g, unknown or other
  modified_base (285)..(285): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanagcccaccctctcctgcagggccagtcagatgtgcnctgagctgacanacaacngcagcnccagcccnatctangncactcaataggccagtggcactcccagccaggttcaggtcgcaggtgggtatgggacagcttcgaactctcaccatcatcagcctggacgcctagaaagtgtgttacgacgttagtttatacttcgtactaaactagtacgtacggacgtcggccgtccggggtctacgttccggccgtgggaccagggtcgagacgtacgaaacgacgtacgtacgctcgacactacgtctcgtccttactaccg

SEQ ID NO: 419872 - DNA, 570 bp, Homo sapiens
  misc_feature: GZ8MTXP02JEISJ.8.33.C11.1.454.CMB.2.raw
  modified_base (281)..(281): a, c, t, g, unknown or other
  modified_base (302)..(302): a, c, t, g, unknown or other
  modified_base (320)..(320): a, c, t, g, unknown or other
  modified_base (395)..(395): a, c, t, g, unknown or other
  modified_base (480)..(480): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctggaaggtcacagagactctcctgtgcagcctctgggttccacttcagtanctacggcatgcactgggtccncaaactccaggcaagggntgggagtggggtgctagttgttcatcctggagggcagttgtacaatggtatgctgacgcgtagacggccatcacntctccagacgacaactccgaagaacacaagtgttatttacggacctaggaaaccagaccctaagtccagtacggacgacggggtntaactacgtaacgtaggtaacggaaaggggacggggaaccagggacggtaacgtaccaacgttactccgtttacggacggtcgtacgggg

SEQ ID NO: 419873 - DNA, 747 bp, Homo sapiens
  misc_feature: GZ8MTXP02FT1VB.8.33.C11.1.454.CMB.2.raw
  modified_base (308)..(308): a, c, t, g, unknown or other
  modified_base (319)..(319): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaaggggaaagacgcccaccctctcctgcacgggccagtcagaatgttggcgtccttcgtaagctggtaaccaacacaaacctggaccaggcctacccacggcccctanatctagtggtncatccaagtacgggccacgtggaccactccccgagtcccaaggtttccaggtccggtacagggttaggggtagtggggaactacgggtacctttcaaccttcctaccaaccctataccaacttcgaacgtcccgttagggacgtcccgtagggtaaaacgtgttaggttagtaccttaaaggttttaacttaacttacggtaactaaactaacgttcccgggttaaacccgggagggttcccgggacccggttacccgggggtaccctttaccgggtttcccggggacccgggtacgggggaaccggttaacggggtacggtaaacggtaaccgttaaaccggaaaaccggttacggttacggtaccgggtaccgtaacggtaccaaccggttacgttccgtttccgtttaccttaccgtttaacccg

SEQ ID NO: 419874 - DNA, 593 bp, Homo sapiens
  misc_feature: GZ8MTXP02ICSD4.8.33.C11.1.454.CMB.2.raw
  modified_base (210)..(210): a, c, t, g, unknown or other
  modified_base (270)..(270): a, c, t, g, unknown or other
  modified_base (276)..(276): a, c, t, g, unknown or other
  modified_base (293)..(293): a, c, t, g, unknown or other
  modified_base (303)..(303): a, c, t, g, unknown or other
  modified_base (413)..(413): a, c, t, g, unknown or other
  modified_base (435)..(435): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctccagtttcagataccaccggagagattgtgttgacacagtctccagccaccctgtctttgtctccgaaggggaaanacgcccaccctctcctgcagggccagtcaagaatggttggcgccttgaagctggtacaanacaacngccagctccacgccccnatctatggtnacataccaacgacgggaccacgtggacactcccagccaggttcagtggcaggtggtagtgggacagtcttcactctacacatcaactcaagccctggacgacctaggaanatgttagacttagtttattacngtacaaactcgtacggtacggagttcggcccggtccgggggccctacggttccggacccggtacgggaaaccgtaagggtcggaaacgaactaaccgaaaacggtacgtagggtacggctaacggaccaacctacgtacctttcgtacctttactacc

SEQ ID NO: 419875 - DNA, 643 bp, Homo sapiens
  misc_feature: GZ8MTXP02GG7EB.8.33.C11.1.454.CMB.2.raw
  modified_base (196)..(196): a, c, t, g, unknown or other
  modified_base (325)..(325): a, c, t, g, unknown or other
  modified_base (355)..(355): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgcttcttttaagaggtgtccagtgtcaagtncaactggtggagtcgtgggggagcgtagtccagccgtgggagtcacagagactctcctgtgcagcctgtggtccacttcagtgctacggcatgcacgtcgggtcccaccaaactccgaaggcaagggtntggaggtgggtgctagtttgttcagtccgnggacggctaggttgttacgaagttggggtatcggacgttggaaccggtcccggtagggaaacgggtccgtaacgttacccaacctactccgtacccgaagacgaacaaccgtaccgaagaacaactaatgtattacgactagaacacgacctaagtcgtagacggacgtacgggtataacgtaacgtacgtacggtaaacggacggggtaacggggaaacgacgggacgggtaagttaacccggtaacgttaccgttaccgtttacggtaccggttcggtaaccgggg

SEQ ID NO: 419876 - DNA, 656 bp, Homo sapiens
  misc_feature: GZ8MTXP02J0NZM.8.33.C11.1.454.CMB.2.raw
  modified_base (209)..(209): a, c, t, g, unknown or other
  modified_base (247)..(247): a, c, t, g, unknown or other
  modified_base (267)..(267): a, c, t, g, unknown or other
  modified_base (273)..(273): a, c, t, g, unknown or other
  modified_base (283)..(283): a, c, t, g, unknown or other
  modified_base (293)..(293): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtcttgtctccgaaggggaanacgcccaccctctcctgcagggccagtcagatgtggcnccttgagctgacacacaacngcagcnccacgccctnatctatggtncactccaagcggccagtcggcactcccagccaggtcaggtcggcgaggtcgggtagtgggacaggtcctcacctctaccacactacactaccgacgccgtacgggacgacccgttaggaacgtagttaggtttacgtacgtttaaggttttaacttacgttacggtaacctaaacgtacttaccgggtaaccgggtaggtcccgggtaccccgggttcccgggggacccttacccgggtttaccccgggcccgggtaccgggggaacccgtaagggggtacgggaaccgtacgtaaaacccgtaaacggtaccgtggttaccgacggtcgaccgtacctacgttccgtcgttaccttcgtacc

SEQ ID NO: 419877 - DNA, 675 bp, Homo sapiens
  misc_feature: GZ8MTXP02GNL9Y.8.33.C11.1.454.CMB.2.raw
  modified_base (266)..(266): a, c, t, g, unknown or other
  modified_base (272)..(272): a, c, t, g, unknown or other
  modified_base (289)..(289): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagcccaccctctcctgcagggccagtcagaatgttggcgccttgagctgtaccaanacaacngcaggctcccagccccnatctatggtgcatccaacgacgggccacgtggccactcccgagccaggttcaaggtcggacaggttgggtacgtggggaacaggtaccttcaacttcctaccaacctatcaactcaagtcccgtagggacgtacccgttagaaacgtattggttacgtaccttaaggttttaatttaaccttaggttacctaaaacgttacgttacccggtaaaccggggtaggtccggggtaccccgggttccccggggggaccctaaccgggttttcccgggaccccggttagggggaaccccgtaagggggttacgggaacgtaacgttaaccgaaaacggtaaccgtggtacggtcgtaacgacctacgtactcctcgttcccttctacccg

SEQ ID NO: 419878 - DNA, 679 bp, Homo sapiens
  misc_feature: GZ8MTXP02JTO77.8.33.C11.1.454.CMB.2.raw
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtagtccagccgtgggaggtcacgagagactctcctgtgcacgcctcttgggttcaccttcagtagctacggcatgcacgtcgggtcccaccaaactccgaggacgaaggggtattgggaggtggggtggctagtttcgttcagtcccgtggagggtcaggttgttacaagttgggtatcggtcgtgacgccggtaggaacggggccgtacttacccgacctacgtctccgaacgtaacggaacaaacccgtaccgaaacggaactaacctaaagttagttaacgtttacggaaccgttacgaaacgtaccgtaaccgttaacgtacccgtaggaacggtaacccgtaggggtactaacgtacgtacgtacgggtaacgggaaacggggtaacgggggaaccgaagggcggtaacgtacgtaacgttaccgttacgtacggtacgttcggtaccggggg

SEQ ID NO: 419879 - DNA, 670 bp, Homo sapiens
  misc_feature: GZ8MTXP02GZ77K.8.33.C11.1.454.CMB.2.raw
  modified_base (264)..(264): a, c, t, g, unknown or other
  modified_base (295)..(295): a, c, t, g, unknown or other
  modified_base (426)..(426): a, c, t, g, unknown or other
  modified_base (634)..(634): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagcccaccctgttctttgtctaccgaaggggaaagacgcccaccctctcctgcaggccagtcagatgtggcgtctgagctgacaanacaacgtggccaggcctcccgacggcccctnactctagtggtcacactaccgaagtacggccagtcggaccctacgtaccccacggccgtagggttccaggtccggacgtaggggttgggtagtcggggaactacgggtcctttcacttccgtaccaacctntacaactcgacggtcccgttaggactacccgtaggtaaacgtgttgttacgtactttaagtttaacttaacgtagttacaacgtagtaccgtaacgggtaggtcccgggtacccggtaccggggtcctacggtttcccggacccgtacgggaaacccgtaggggtacggaaacgtaacgtaaccgaaaacgtacgtaggtccggtacncggtaccaacgtcttaccgtcgtttcttaccttccg

SEQ ID NO: 419880 - DNA, 705 bp, Homo sapiens
  misc_feature: GZ8MTXP02G4392.8.33.C11.1.454.CMB.2.raw
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctcctgtgcagcctcgtgggttcaccttcagtagctacggcagtgcacgtggggtcccaccaaaacgtccgaaggaccaaaggggtattggggaggttggggtggctaggttttgttacagttccgtgggacgggctaaggttgttacaagttggggtatcggcgtacgaccggtccggtagggaaacggggtccgtattccaacctatcctaccaaggaacgaaccaaactcccgaaaggtaaaccaaacgtaaagttaggttaaacgtttcgggaacccttaggaaaaccgacgttacccgttaaacggtcccgttaaggaacggaaccgtaagggggttacgttaaataccgttaagtacgggtaaacgggaagggggaaccgggggaaacgacgggacgggtaacgttaccgaaacggttacctacggtttacgaacggttcggtaaccggggg

SEQ ID NO: 419881 - DNA, 782 bp, Homo sapiens
  misc_feature: GZ8MTXP02F15OG.8.33.C11.1.454.CMB.2.raw
  modified_base (281)..(281): a, c, t, g, unknown or other
  modified_base (376)..(376): a, c, t, g, unknown or other
  modified_base (382)..(382): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaacgtggtggagtcgtgggggagcgtagtccagccgtgggaggtcacagagactctcctgtgcagcccttcttggtccaccttnagtacgctacggcagtcgctacgtcgggtaccccaccaaactccgaggacgaagggtattggaggtgggtggctagttgttcatccgtggacggntaggtnttacaagttgggtatggactgggaccgtccgggtagggaaaccggggtccctagttacccaacctacttacccgtacccgaacgaacgtaaaccctaaaccgtacccgaaacggaaacctaaaccgttaaagttacggttaaacggttttaccgggaaccccgttaagggaaaaccctaccggtaaccccgttaaacgggttaccccgttaaaggggaaccgggtaaaccggttacgggggttaacttaaacgttaaaccgttaaacggtacggggttaaaacgggaaacggggggtaaccggggggaaacccgtacgggggaacccggggttaacgttacccggtaaaacgggttaccgtttacccgtttacgggtaccgggttacgggtacccggggg

SEQ ID NO: 419882 - DNA, 660 bp, Homo sapiens
  misc_feature: GZ8MTXP02GBL0X.8.33.C11.1.454.CMB.2.raw
  modified_base (272)..(272): a, c, t, g, unknown or other
  modified_base (287)..(287): a, c, t, g, unknown or other
  modified_base (297)..(297): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagcccaccctgttctttgtctccgaaggggaaagacgcccaccctctcctgcagggccagtcagatgttgcgtcttgagctgaccaacacaacngcagctcccagcccnatctatggtncatccaagtacggcctacgtcggcactcccgagccgtaggttccaggtcggacgtagggttggggtagtggggactaggtccttccacttcgaccacctatccgatccgacgcccgtaggacgtcccgtaggaaagtcttggttagtacctttaagtttactttaaaccgttgtaaccttaaactacgttacccggtaaccggtacggttccgggtccccgggttacccgggggtaccccttaccggtttccccgggaccccgggttacggggaaacccggtaagggtacgggaagtaacgtaaccggaaacgtacgtacggtcgacgtaacgacctacgtacgtcgttcgttcttacgtccc

SEQ ID NO: 419883 - DNA, 549 bp, Homo sapiens
  misc_feature: GZ8MTXP02FYTU6.8.33.C11.1.454.CMB.2.raw
  modified_base (260)..(260): a, c, t, g, unknown or other
  modified_base (266)..(266): a, c, t, g, unknown or other
  modified_base (272)..(272): a, c, t, g, unknown or other
  modified_base (282)..(282): a, c, t, g, unknown or other
  modified_base (288)..(288): a, c, t, g, unknown or other
  modified_base (292)..(292): a, c, t, g, unknown or other
  modified_base (301)..(301): a, c, t, g, unknown or other
  modified_base (385)..(385): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttgcgcttgagctgacaanacaacngcagcnccagcccctnatctanggtncatccaacngggccactggccactcccagccaggttcagtcggcagtgggtatggggacagtcctcactctccaccatccatcagcctggacncctagaacattgttagacttagtttacttactgtacaaactagttccgtacggacgtcggcccgtccgggggccttacgttccggcccgtacgggaaccgaagggtcggaagactacgaaacgtacgtacggtgtctggaccactacgttctcgtacttcctac

SEQ ID NO: 419884 - DNA, 721 bp, Homo sapiens
  misc_feature: GZ8MTXP02FPIJS.8.33.C11.1.454.CMB.2.raw
  modified_base (301)..(301): a, c, t, g, unknown or other
  modified_base (322)..(322): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtggggagcgtagtccagcctgggagtcacagagactctcctgtgcagcctctgggttcaccttcagtagctacggcatgcacgtgggtccnccaaactccgaggcaaggggntggagtggggtgcagttgttcatccgtaggagggctaggttgttcaaagtggggtatcggcgtaggaccgtccggttagggaacgggtccgtattaccgacctacgtcctaccgagacgaacaaccgtaccgaaacggaaaccaacgtaaacgttagttaacgtttacgggaacccttaagggaaacctacggtaccccgttaaacggtcccgttagggaacgggtaaccgtaacggggttacgtaaacgttaaccgtaacggttaacgggtaaaaccgggggaaaacgggggtaaccggggggaaaaccgagggggtaaccgggggtaacggttaacccggtaaaacggtttaaccgttacccggtttacggtaaccggttcgggttaacccgggggg

SEQ ID NO: 419885 - DNA, 613 bp, Homo sapiens
  misc_feature: GZ8MTXP02FYJHZ.8.33.C11.1.454.CMB.2.raw
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgttctttgtctccgaggggaaagagcccaccctctcctgcagggccagtcagaatgttggcgccttgaagctggtaccaacacaaacctggccaggcctcccacggcccctcatctatggtcgcactaccaatacggggccacgtggacactccccgaagtcccaggttcaggtcggctaggtgggtagtggggacaggtacttcacttctaccacctatcactcacgtcccgtggacgaccgttagaaagtgttgttacgcttaagtttacttacgtagtactaaacagttaccggtaccggagttcgggcccgtcccgggggccttacggtttccggccgtacggggaacgtacggtggagactaacgaaacgtacgtcgtcgggactcgacctaccgtagtccgttacgtttcctacgttacc

SEQ ID NO: 419886 - DNA, 566 bp, Homo sapiens
  misc_feature: GZ8MTXP02G6AIO.8.33.C11.1.454.CMB.2.raw
  modified_base (208)..(208): a, c, t, g, unknown or other
  modified_base (242)..(242): a, c, t, g, unknown or other
  modified_base (247)..(247): a, c, t, g, unknown or other
  modified_base (254)..(254): a, c, t, g, unknown or other
  modified_base (260)..(260): a, c, t, g, unknown or other
  modified_base (266)..(266): a, c, t, g, unknown or other
  modified_base (275)..(275): a, c, t, g, unknown or other
  modified_base (285)..(285): a, c, t, g, unknown or other
  modified_base (356)..(356): a, c, t, g, unknown or other
  modified_base (362)..(362): a, c, t, g, unknown or other
  modified_base (377)..(377): a, c, t, g, unknown or other
  modified_base (385)..(385): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgctccgaggggaaanagccaccctctcctgcaggccagtcagatgtgcnctganctgacanacaacngcagcnccagccctnatctatggtncatccaagtcggccagtggcactccagcctaggtcaggtcgctaggtgggtatggggacagtcttcactcncaaccntcatcagcctggacnctagaagntgttgacttagtttactatagtacaacgtagtaccgtaaccggtcggtccgggcccggtcccgggggtaccttaccggtttccgggacccgtagggggaaccctaagggggtacggaaagacgtaacggaaaaccgtacgtcgtacggactcgactaccgtatcgtcgttacttactaccg

SEQ ID NO: 419887 - DNA, 574 bp, Homo sapiens
  misc_feature: GZ8MTXP02FJ5Q4.8.33.C11.1.454.CMB.2.raw
  modified_base (169)..(169): a, c, t, g, unknown or other
  modified_base (302)..(302): a, c, t, g, unknown or other
  modified_base (321)..(321): a, c, t, g, unknown or other
  modified_base (412)..(412): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctnttttaagaggtgtccagtgtcaagtgcaactggtggagtctgggggagcgtagtccagcctgggaggtcacagagactctcctgtgcagcctctgggttcaccttcagtagctacggcatgcacgtgggtccnccaaactccaggcaagggnttgggagtggggtggctagttgttcatcctgagggcagtgttcaaatgggtatgctgacgcggtgaaacgggccgattcacatctccaganacaactccaagaacacaatagtattggactagaacacgacctaaagtccgtagaggacgtaacgggtagtaactactacgtaggtaacggaaaggggaacgggggaaccaggacggggtaagttaccaaacggttactccgtttacgacggttcgtacgggg

SEQ ID NO: 419888 - DNA, 564 bp, Homo sapiens
  misc_feature: GZ8MTXP02HGP12.8.33.C11.1.454.CMB.2.raw
  modified_base (177)..(177): a, c, t, g, unknown or other
  modified_base (321)..(321): a, c, t, g, unknown or other
  modified_base (378)..(378): a, c, t, g, unknown or other
  modified_base (476)..(476): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagnggtgtccagtgtcaagtgcaactggtggagtcgtgggggagcgtagtccagcctggggagtcacagagactctcctgtgcagcctcgtggtcacttcagtagctacggcatgcacgtgggtcccacaaactccgaggcaagggnttggagtgggtgctagttgttcatccgtgacgggcagttgtacaagtgggtatcggntgacgcgtagacggcgatcactatctacagacactacaccagaacacaatgtatttgacctagaacacgccgtaagtccgtggaacggacgacgggtntaatacgtacgtacggtaacggaagggacgggggaaccagggacggtaagttacaacgttactccgtttagaccggttcgtaccgggg

SEQ ID NO: 419889 - DNA, 647 bp, Homo sapiens
  misc_feature: GZ8MTXP02IQR3G.8.33.C11.1.454.CMB.2.raw
  modified_base (265)..(265): a, c, t, g, unknown or other
  modified_base (280)..(280): a, c, t, g, unknown or other
  modified_base (288)..(288): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacctgttctttgtctccgaggggaaagacgccacctctcctgcgaggccagtcagatgtgcgcttgagctgacaacacaacngcagctccagccctnatcatgtncatccaagcggccagtggacactccagcctaggtcaggtcgacaggtggtagtgggacagtccttcactctaccaacctatctatcacgccgtaggacgctagaaacgtgttgttacgacttagtttaacttacgttagttaaccaaacgttacgttaccggtaaccgggtacggttaccgggtccccgggttaccgggggtacccttaaccgggttttccccggggaccccgggttacgggggaaacccggtaagggggtacgggaaacgtaacgttaaaccgaaaacggtaccgttacgggtacggaccgtaacggacctaaccgtacgttccgttacgtttacctttaccgtaccg

SEQ ID NO: 419890 - DNA, 529 bp, Homo sapiens
  misc_feature: GZ8MTXP02GAAWN.8.33.C11.1.454.CMB.2.raw
  modified_base (211)..(211): a, c, t, g, unknown or other
  modified_base (247)..(247): a, c, t, g, unknown or other
  modified_base (253)..(253): a, c, t, g, unknown or other
  modified_base (266)..(266): a, c, t, g, unknown or other
  modified_base (272)..(272): a, c, t, g, unknown or other
  modified_base (280)..(280): a, c, t, g, unknown or other
  modified_base (285)..(285): a, c, t, g, unknown or other
  modified_base (289)..(289): a, c, t, g, unknown or other
  modified_base (365)..(365): a, c, t, g, unknown or other
  modified_base (371)..(371): a, c, t, g, unknown or other
  modified_base (377)..(377): a, c, t, g, unknown or other
  modified_base (384)..(384): a, c, t, g, unknown or other
  modified_base (404)..(404): a, c, t, g, unknown or other
  modified_base (426)..(426): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagcccaccctgtctttgtctccgaaggggaaanacgccaccctctcctgcagggccagtcagatgtgcncttganctgacacacaacngcagcnccagcccnatcanggtncatccaagtcggccacgtggcactcccgagcctaggttcaggtcggcaggtggtagtgggaacaggtcctcactcncacctntcatcngctgganctagatgtgtagcttatttntacgtatacactagtactacgngcggtcccgtcggggtctcgttccggacgtgggaacctagggtcgagtactaacggaaactacgtggtcgcgtgaccaacggtcttacgtctcgttacttccg

SEQ ID NO: 419891 - DNA, 560 bp, Homo sapiens
  misc_feature: GZ8MTXP02FPP0R.8.33.C11.1.454.CMB.2.raw
  modified_base (262)..(262): a, c, t, g, unknown or other
  modified_base (321)..(321): a, c, t, g, unknown or other
  modified_base (414)..(414): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctcctgtgcagcctntggttcaccttcagtagctacggcatgcactgggtcccaccaaactccaggcaagggtnttggagtgggtgctagttgttcatcccgtgaggcagtgttacaatggtatgactgacgcgtagaacggcgtattcacatctacagacacaacncagacacatgtattcgactagaacacgactaagtctaggacgacgacggtagtaactacgtacgtaggtaaacggaaacggggtacgggggaaccagggacggtaacgtaccgaaacgttaccgtcgttacgaccgtcgtacgggg

SEQ ID NO: 419892 - DNA, 655 bp, Homo sapiens
  misc_feature: GZ8MTXP02HFW8M.8.33.C11.1.454.CMB.2.raw
  modified_base (300)..(300): a, c, t, g, unknown or other
  modified_base (311)..(311): a, c, t, g, unknown or other
  modified_base (443)..(443): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagcccaccctgtctttgtctccgaggggaaagacgcccaccctctcctgcagggccagtcagatgttggcgtccttgtagctgtaccaacacaaacctggccaggcctcccgaggccccctnatctagtggtnctataccaagtacgggcccacgtcggaccactcccgagccgtaggttcaggtcggctagggttgggactggggacaggtccttcgactcctcaacctatcatcacgtcccgtaggacgtccctaggaaagtnttggttcgtacgtttaaagtttacttacgtagttaaccaaacgtttacgtacccggtaaccgggtaggttcccgggtaccccggttcccgggggtacccttccgggtttacccggggacccgttagggggaaacccgtaggggtcggaacgtacgtaaaccgaaacgtaccgtggcggtactcggacctactacgttctacgttctacgtcc

SEQ ID NO: 419893 - DNA, 738 bp, Homo sapiens
  misc_feature: GZ8MTXP02GZRZ9.8.33.C11.1.454.CMB.2.raw
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagccgtgggagtcacagagactctcctgtgcacgcctcgtcgggtcacccttcagtagcctacggcatcgctacgtcgggtcccaccaaacctccgaaggcaagggtattgggaggtggggtggtctaggtttgttcagtccgtggagggtctaggttgttacaagttgggtatggtcgtacggaccgtccgggtagggtaaaccggggtacccgtacgtttacccgacccgtacgttacccgtacccgaacgaaccgtaaaccaaacccgtacccggaaacggaaaacctaaaccgtaaagttaacggtttaacgtttaccggtaaccgttaacgaaaccgtaaccgtaacccgttaacgtacccgttaggaaccgggaccggtaacgggtacgttaaacgtaacgttacgttacggtaaaccggggaaaggggtaacgggggaaccgtacgggtacgggtaacgtacgtaacgttaccgttacgtttacggtaccggtacggtaccgggg

SEQ ID NO: 419894 - DNA, 672 bp, Homo sapiens
  misc_feature: GZ8MTXP02JWDBG.8.33.C11.1.454.CMB.2.raw
  modified_base (274)..(274): a, c, t, g, unknown or other
  modified_base (281)..(281): a, c, t, g, unknown or other
  modified_base (290)..(290): a, c, t, g, unknown or other
  modified_base (300)..(300): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagcccaccctgttctttgtctaccgaaggggaaagacgcccaccctctcctgcgagggccagtcagatgtggcgtcttgagctgaccaacacaacngcaggcnccagccccnatctatggtncataccaagtacgggccacgtggacacgtccccagccgtaggtcaggtcgggctagggtgggtagcggggacagtccttcactcctccacctatcactccgacgtccgtagggacgtaccgtagaagtagttcggttagtaccgttagttttaacttaccgttacgttaacctaaacgtacgtttacccggtaaccgggtacggtcccggggtccccgggttcccgggggtacccttaccgggtttccccgggcccggtacgggggaaccgtaacggggtcgggaaacgtaaccgtaaacggaaaaccggtacgtcggtacgggacctcggacccgtaacgtcgttcgttacggtttcccttacgtaccccg

SEQ ID NO: 419895 - DNA, 681 bp, Homo sapiens
  misc_feature: GZ8MTXP02JEW3T.8.33.C11.1.454.CMB.2.raw
  modified_base (210)..(210): a, c, t, g, unknown or other
  modified_base (244)..(244): a, c, t, g, unknown or other
  modified_base (258)..(258): a, c, t, g, unknown or other
  modified_base (264)..(264): a, c, t, g, unknown or other
  modified_base (280)..(280): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagngccaccctctcctgcagggccagtcagatgtgcncttgagctgacaanacaacngcagctccagcccctnatctagtggtcgacactccgaagtacgggccaacgtcggacatccccagccaggttccaggtcgcgaggtgggtaatggggacacgtcttcacgtcctacaaccatccattaccgagtcccgtagggacgtacccgtaggaaactgttacggttacggtacttaaggttttaactttaaccgttacggtaaccttaaacgtacgtttacccgggtaaaccggtacggttccggggtacccggttcccgggggaccctttacccgggttacccgggtacccggttaccgggggaaccccgtaaagggggttacgggaaacggtaaccgtaaaccgtaaaacgggtaacgtacgggtcggtaacctggaccctaacgtacttctacggttccttacttacccg

SEQ ID NO: 419896 - DNA, 579 bp, Homo sapiens
  misc_feature: GZ8MTXP02FFSRR.8.33.C11.1.454.CMB.2.raw
  modified_base (397)..(397): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccagggaaagagccaccctctcctgcagggccagtcagaatgttggcgccttcgtaagctggtaccaacacaaacctggccaggctcccaggccccctcatctatggtgcatccaacgagggccacgtggcactccccagccaggttcagtcggcagtgggtatggggacagcttcactctcacatcatcagcctggancctagaagatgttgctagtttatactgtacaactataccgtacgagtcggacccggtcccgggggtacctaccggtttcccggccccgttacggggaacccgtaaggggtcggagtaacgtaccgaaaaccgtaacgtcggtcggactggacctaacctactccgttcggtccttctacccg

SEQ ID NO: 419897 - DNA, 568 bp, Homo sapiens
  misc_feature: GZ8MTXP02GKHX0.8.33.C11.1.454.CMB.2.raw
  modified_base (366)..(366): a, c, t, g, unknown or other
  modified_base (403)..(403): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctcctgtgcagcctctgggttcaccttcagtagctacggcatgcacgtgggtcccaccaaactccgaggacaagggattggagtgggtggcagtttgttcatccgtggagggcaggttnttacaatggtatgctgacgcgtgacggcatcacatcnccagacgacactaccaagacacatgtattagactagaacagacctagtcctagaggacgacggtgtactacgtaacgtaggtaaccggaaggggacgggggaaaccgagggtacgggtaacgttaccgtaacgtaccgtaccgtttacggacggtcgtacggggg

SEQ ID NO: 419898 - DNA, 611 bp, Homo sapiens
  misc_feature: GZ8MTXP02H0F7I.8.33.C11.1.454.CMB.2.raw
  modified_base (291)..(291): a, c, t, g, unknown or other
  modified_base (361)..(361): a, c, t, g, unknown or other
  modified_base (380)..(380): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccacctgtctttgtctccgaggggaaagagccaccctctcctgcagggccagtcagatgttgcgcttgaagctgtaccaacacaacctggccaggctcccaggcccctnatcatggtgcatcccaaacgaggccatcggcactccagccctaggttcagtcggcaggtggtatgggacngacttcaactctccaactntcaatcagcccgtgacgcctagaacgtagttgttgacttagtttatttacttgtacctaaacgtacttaccggtaccggaggtccgggtacccgtcccgggggtccctaaccggttttccgggccccggtacggggaacccggtaaagggttcgggtacgaactaaccgaaacggtacgtaggtcggacgttaacggcaaccgtacttcgttacgttcctttacgtacccg

SEQ ID NO: 419899 - DNA, 604 bp, Homo sapiens
  misc_feature: GZ8MTXP02FJEUM.8.33.C11.1.454.CMB.2.raw
  modified_base (324)..(324): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggaggtcacagagactctcctgtgcagcctcgtgggttcaccttcagtagctacggcatgcacgtgggtccgaccaaactccaggcaagggnttggagtggggtggctagttgtttcatccgtggagggcaggttgttcaaagttggtatgcttggaccgtccggtagaaacgggccgtattacgaccatctccagacgaaccaactccgaacgaacaactaagtagttaagttacggaccttaggaaatacgacctaaacgtccctagaacggacgtacgggtacgtaacgtactacgtacggtaaacgaaggggaacgggggaaccaggacgggaagtaccgaagtactcgttacggacgtcgtacgggg

SEQ ID NO: 419900 - DNA, 616 bp, Homo sapiens
  misc_feature: GZ8MTXP02HJVDR.8.33.C11.1.454.CMB.2.raw
  modified_base (434)..(435): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggagcgtagtccagccgtgggagtcacagagactctctgtcgcagcctcgtgggtcaccttcgagtacgctacggcagtcgcacgtcgggtacccaccaaactccgaaggcaaggggtagttgggaggttggggtcgacgttaggtttgtttcattcccgtaggagggtctaggttgttacaagttggtatgctgaccgtcgagacgggcctatccacnnctcgagacacactaccaagaacactattgtagtttacgacctaggaaaccacgtacctaagtccgtaggacggtacgtaacgggtctaacgtacgtacgtacggtacggaaacggggacggggtaaccgaggtccggtaacgttacgtaacgtaccgtacgttcggtaccgtcggtacggg

SEQ ID NO: 419901 - DNA, 676 bp, Homo sapiens
  misc_feature: GZ8MTXP02IGT2R.8.33.C11.1.454.CMB.2.raw
  modified_base (211)..(211): a, c, t, g, unknown or other
  modified_base (299)..(299): a, c, t, g, unknown or other
  modified_base (309)..(309): a, c, t, g, unknown or other
  modified_base (397)..(397): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagngcccaccctctcctgcagggccagtcagaatggttgcgtcttcgtaagctggtaccaacacaaaccgtgccaggcctccacgcccctnatctatggtnacactccaacgacgggccacgtggacactcccagccgtaggttccaggtcggacaggtgggtagtgggacagtccttcactctcaccntacatcacgctaggacgtctagaagtattggttcgacgttagtttaacttacgttacgttacctaaacgtacgttaccggtaaccgggtaggtccgggtaccccgggtcccgggggtacccttccgggtttcccgggtaccccggttacgggggaaacccgtaaggggtacggtaacggaaacgttaaccgaaaaccgggtaaccgttggggttaccggtacggttaacgaacccgtaacccttacggttacctttcggttacccttttaccgtacccg

SEQ ID NO: 419902 - DNA, 612 bp, Homo sapiens
  misc_feature: GZ8MTXP02IW7UT.8.33.C11.1.454.CMB.2.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccaccctgtctttgtctccaggggaaagagccacctctcctgcagggccagtcagaatgttggcgccttgtaagctggtaaccaacacaaacctggccaggctcccacggccccctcatctatggtgcactccaaaccgacggggcccacgtggccatccccagcccagggttccaggttcggctaggtgggtagtggggacagcttcactctccaccatcatcagcctggacgcctagaagattggttgtacttagtttacttacgttagtacctaactacgttaccggtaccggtaggtcggtcccggtccgggggccctaccggtttccggcccgtcggggacccgtaagggtcggaggacgtaacgaaaacggtaaccgtggtacggtcgtaacggccaccgtacttcgtcgttccttacttaccg

SEQ ID NO: 419903 - DNA, 628 bp, Homo sapiens
  misc_feature: GZ8MTXP02GGPO8.8.33.C11.1.454.CMB.2.raw
  modified_base (209)..(209): a, c, t, g, unknown or other
  modified_base (254)..(254): a, c, t, g, unknown or other
  modified_base (269)..(269): a, c, t, g, unknown or other
  modified_base (276)..(276): a, c, t, g, unknown or other
  modified_base (287)..(287): a, c, t, g, unknown or other
  modified_base (297)..(297): a, c, t, g, unknown or other
  modified_base (306)..(306): a, c, t, g, unknown or other
  modified_base (359)..(359): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanacgccaccctctcctgcagggccagtcagatgttgcgccttgaanctgtacaacacaacnggcagcncccagcccctnatctatggtncatccaacngggccacgtggccactcccagccaggttccaggtcggcaggtgggatgggacnggtccttcgactctacacctatcactcacgtcccgtaggacgtcctagaagtgtagttgtactagtttacttacgttgtaactaactacgttacggtaaccggtacggtccggtcccggtacccgggggtacctaacccggttttccgggaccccggttacgggggaaacccgtaagggggttacggaacggtacgtaaaccggaaaccgtaacgtacggtacggcgttaacgacccgtacctacgttcctacggttcctttactaccg

SEQ ID NO: 419904 - DNA, 668 bp, Homo sapiens
  misc_feature: GZ8MTXP02HR3R4.8.33.C11.1.454.CMB.2.raw
  modified_base (285)..(285): a, c, t, g, unknown or other
  modified_base (331)..(331): a, c, t, g, unknown or other
  modified_base (357)..(357): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttggctgaacttgggttttcctcgttgcttcttttaagaggtgtccagtgtcaagtgacaacgtggtggagtcgtgggggagcgtagtccagccgtgggagtcacagagactctcctgtgcacgcctcgtggttccacctcagtanctacggcatgcacgtggtccccaccaaactccgaggacgaagggtnttggaggtggggtcggactaggtttnttcagtccgtgggacgggtcgtaggttactaagtaggtggtgtcgtcggtaccgggtcccggtagggacgggacccgggtaccttactcccgaatcccgttccaacgagaacccaactaacccgaacggaacaacctaaagttacgttagttaccggttaacgacaacgaacgtacgtaacgtacctcggaggtaccgtacgggtagtactaaacgtcgttaacggaggtaacggggaaacgggaccgggaagtaccgggtacgtaacgtaaacgtaccgttacgtacgttcggacgttcggggaacccgg

SEQ ID NO: 419905 - DNA, 643 bp, Homo sapiens
  misc_feature: GZ8MTXP02IAR4J.8.33.C11.1.454.CMB.2.raw
  modified_base (473)..(473): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtagtccagcctgggagtcacagagactctctgtgcagccctcgtgggttcctaccttcgagtacgctacggcatcgctacgtcgggtacccgacccaaactcccgaaggcgaaaggggtagttgggaggtggggtggctaggtttgtttcagttccgtaggagggtctaggttgtttacaagttggtattagcgtagacgccggtaggaacgggccgtataccacgtactcctaccgaagacgaccaaacnccgaagaaacactaagttacgttagtttacgaccttagaacagtacctaaagccgtaggaacgacgtacggtagtactacgtacgtacgtaacggaacggggtaacggggacgtacggacgggtaacgtaccgtaacgtacctacgtttacggacgtttacggaccgggg

SEQ ID NO: 419906 - DNA, 716 bp, Homo sapiens
  misc_feature: GZ8MTXP02JVGAS.8.33.C11.1.454.CMB.2.raw
tcagctcgcgtgtccacgaccggtgctcgatttagagtgagctcgtgggagaggagcccagcactagaagtcggcggtgtttccattcggtgatcagcactgaacacagaggactcaccatggagtttgggctgaactggggttttcctcgttgctcttttaagaggtgtccagtgtcaagtgcaactggtggagtcgtgggggagcggtagtccaggcctgggaggtcacagagactctccgtgtgcagcctcgtgggttcaccttcagtacgctacggcatgcacgtcgggtcccaccaaagtccgaggtacaaaggggtcttgggaaggttggggtcggaccttaggtttcggttaccagttccgtagggaggggtccctaggttcgttacaaggttggggtatcggtcgtcggaccggtcccggttaggggaacggggtccctaagtttcccgaaacctaacgttcccgtaccgaacggtaacgtaaacccgaaaccgttaccgaaacgggaaacaaccgttaaagttaccgtttaaaggtttccggaaaccgtacgaaacacgggtaccttaagtcccgtagacggaacggtacggtagtaacgttacgacgttacggtaaaccggaaggggtacgggggaaccgagggtacggtacgttacgaacgttaacgtcgttacggacgttcggacgggtaccgacggttacccg

SEQ ID NO: 419907 - DNA, 673 bp, Homo sapiens
  misc_feature: GZ8MTXP02G9U35.8.33.C11.1.454.CMB.2.raw
  modified_base (207)..(207): a, c, t, g, unknown or other
  modified_base (440)..(440): a, c, t, g, unknown or other
  modified_base (444)..(444): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccacggagagattgtgttgacacagtctccagccacctgtctttgtctccgaagggaanacgccacctctcctgcgacgggccagtcagtagttgttggcgtccttacgtaagcgtacggtaaccaacactaaaccgtcggaccacggcctccccgacggcccctctaactctactcgtcgactactacccgaacgacgggacctacgtcggacctacgtcccacggtacccgtaggttcacggtcgggacgtagggtagggtacgtgggaacagtcctcactccacacctntacnctacgacgcgtacgacgtcgtagaaacgtgtacgttgtacttagtttattacgtctaactaactcgtaccgtacgggtaggtccgggtccggtcccgggggtaccttacgggtttcccgggaccggttacggggaacccggttaagggtacggaacgtaacgttaaacggaaacggttaccgtaggtcggtacgaaccgacgactacgttctaccgtcgtaaccttccg

SEQ ID NO: 419908 - DNA, 714 bp, Homo sapiens
  misc_feature: GZ8MTXP02H3MED.8.33.C11.1.454.CMB.2.raw
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagtcgtgggggaggcgtagtccagccgtgggaggtcacagagactctcctgtgcagcctcgtggttccaccttcagtacgctacggcatgcacgtcgggtcccaccaaactccgaaggacgaaggggattggggaggttggggtggcgtaggtttcgttacagttccgtgggagggtctaggttgttacgaagttgggtatggtccgtaggaccggtccggtaggaaaccggggtcccgtatacccgaccacgtccctaccgaagaacgaaccaacctaccgaacgaaacaactaagttacgttaagtttacgaccgtacgaaccaacgtaccgtaaacgtccgtaggaacggtaaccgtaacggggttacgttaacgtaaccgttaacggttaacgggtaaaacgggaaacgggggtaaccgggggaaccgaacgggacggggtaaaccgttacccggtaaacggttacccgttaccggtttacggtaccggttacggtaccggggg

SEQ ID NO: 419909 - DNA, 592 bp, Homo sapiens
  misc_feature: GZ8MTXP02HQLF8.8.33.C11.1.454.CMB.2.raw
  modified_base (327)..(327): a, c, t, g, unknown or other
  modified_base (410)..(410): a, c, t, g, unknown or other
  modified_base (413)..(413): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtagtccagccgtgggagtcacagagactctctgtgcagcctcgtgggttccaccttcagtagctacggcatgcacgtgggtcccaccaaactccgaggcaagggnttgggagtggggtgctaggtttgttcatccgtaggagggtctagttgttacaagtggtatgctgacgcgtagacggcatcacntcncagacacaactcgagacacatgtatttgacctagaacagtacctaacgtccgtaggaacggacgtacgggtataacgtacgttacgtacggtaacgggaaaggggacgggggaacccagggacgggtaacgttacgtaacgttaccgttaccgtttacggaccgttacggtaccggggg

SEQ ID NO: 419910 - DNA, 603 bp, Homo sapiens
  misc_feature: GZ8MTXP02GK806.8.33.C11.1.454.CMB.2.raw
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagccgtgggaggtcacagagactctcctgtgcagcctctgggttcaccttcagtagctacggcatgcacgtgggtcccaccaaactccgaggacaaggggattgggagtggggtggctagtttgttcagtccgtggagggctaggttgttacaaagttggggtatggtctaggaccgccggtaggaacggggccgtagttccacctatcctaccagacgacaactccagaacaacaatgtattgacctagaacacgactaagtcctaggaggacgacgggtataactacgttacgtacggtaaacggaaacggggacgggggaaccagggacggaagtaccgtaacgtacgttaccgttacgtacgtacgttcgggg

SEQ ID NO: 419911 - DNA, 657 bp, Homo sapiens
  misc_feature: GZ8MTXP02HPCDB.8.33.C11.1.454.CMB.2.raw
  modified_base (250)..(250): a, c, t, g, unknown or other
  modified_base (269)..(269): a, c, t, g, unknown or other
  modified_base (285)..(285): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctgtctcccagtttcagataccaccggagagattgtgttgacacagtctccagcccacccttgtctttgtcctccgaagggggaaagagcccaccctctcctgcaggccagtcagatgtgcncttgagctgacacacaacngcagctccagcccctnatctagtggtgcactccaacgcgggcccaacgtggaccactcccgagtcccgtaggtttccgaggtcgggactagggttggggtagttacggggactaagggtcccttcaaacttccgtaaccaaccgtatacctactccgtaacgtcccgtagggtaccgtacccgtaagaacgttacgttggttacgtacgtagttttaacgttagtcgttaacaaacgttacgtaccgtaccgggtaagtccgggtacccggtcccgggggtaccttacggtttcccgggaccgtacggggaaccgtaagggtggtacgtaactaacgaaacgtacgtgggtacgcgtcgacctacgtacgtcttcgtccttgtacccg

SEQ ID NO: 419912 - DNA, 584 bp, Homo sapiens
  misc_feature: GZ8MTXP02FVCHD.8.33.C11.1.454.CMB.2.raw
  modified_base (177)..(177): a, c, t, g, unknown or other
  modified_base (311)..(311): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagnggtgtccagtgtcaagtgcaactgggtggagtcgtgggggaggcgtagtccaggcctggggaggtcacagagactctcctgtgcagccctctgggttcaccttcagtagctacggcatgccacgtcgggtaccnccaaactccgaggcaaaggggattgggagtggggtgctagttgttcatccgtggagggcaggttgttacaagttgggtatggctaggaccgcgtaggaacgggccgattccacatctcagacgacaactcaagaacacaatgtattaggacctagaacacgactaagtcctaggagacgacgggtatacgtactacgtaggtaacggaaagggacgggggaaacagggacgggaagttaccgaagttactccgtttacgacgttcgtacgggg

SEQ ID NO: 419913 - DNA, 671 bp, Homo sapiens
  misc_feature: GZ8MTXP02F8PJN.8.33.C11.1.454.CMB.2.raw
  modified_base (302)..(302): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccagggggaaagagcccaccctctcctgcagggccagtcagaatgttggcgtccttcgtaagctggtaccaacacaaacctggccaggcctcccgaggccccctnatctatggtgcatccaagtacgggccacgtggcatcccagccaggttcaggtcggcaggtgggtatggggacagtacttcacgtctaccgacctatcaatcgacgtcccgtaggacgtccctaggaaagtacttggttacgtcgttaagttttacttaacgtgttaaccctaaaacgtacgttaccggttaaacccgggagttccggggtccccggttacccggggggtcccttaaccgggtttcccgggacccggttacgggggaaccccgtaaagggggttcggaaacggtaacgttaaaccgaaaacgggtaaccgttacggtacgggactcggacctacctacgttctcggttacttacctaccg

SEQ ID NO: 419914 - DNA, 604 bp, Homo sapiens
  misc_feature: GZ8MTXP02H1XGM.8.33.C11.1.454.CMB.2.raw
  modified_base (210)..(210): a, c, t, g, unknown or other
  modified_base (291)..(291): a, c, t, g, unknown or other
  modified_base (303)..(303): a, c, t, g, unknown or other
  modified_base (318)..(318): a, c, t, g, unknown or other
  modified_base (427)..(427): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaanacgccaccctctcctgcagggcagtcagaatgtggcgtcttcgtagctggtaccaacacaactgccagcctccacgccctnactctatggtcnctactacccaaacgngggcccacgtcggcactcccagacctaggttcaggtcggacgtaggtgggtagtggggacagtaccgttcacgttcctaccaacctatctaactcacgccgttaggacnccgtaagacgtagtggttacgtacgttagttttaactcgttagtactaactgttaccgacggcgttcggcccgtaccggggtcctacggttccggaccgtggaaccgtagggacggtagaaactacgaaactacggtcggtacgactcggactaacgtcgtcgtacttcgtctaccg

SEQ ID NO: 419915 - DNA, 706 bp, Homo sapiens
  misc_feature: GZ8MTXP02HKBBI.8.33.C11.1.454.CMB.2.raw
  modified_base (313)..(313): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagcccaccctgttctttgtctccgaggggaaagcgcccaccctctctgcgacgggccagtcaagattggttcgcgtcttagaagctacggtaaccaacaactaaccgtggccaggcctacccgacggccccctanactctagtgggtcacacgtaccaaagtacggggccaacgtcggaccacgtcccacgtacccgtaggttccaggtccggacgtagggttcgggtaagtcggggaacacggtacctttccgaaccttctaccaaacctactcacgtcaacgtcccgtagggacgtcccgtaggtaaacgtgttaggttacgtaactttaggtttaactttacgacgttaccaaacgttagttacccgggtaacgggtacgggtccgggtccccgggtacgggggtacccttaccgggtttaccgggcccgggttacgggaacggtacgggaggtacgtaacgtaaacgtaaacgaacggtgggtacgacgtcgacctaccgtactccgttgtaccttactacccg

SEQ ID NO: 419916 - DNA, 586 bp, Homo sapiens
  misc_feature: GZ8MTXP02HH8YR.8.33.C11.1.454.CMB.2.raw
  modified_base (326)..(326): a, c, t, g, unknown or other
  modified_base (423)..(423): a, c, t, g, unknown or other
  modified_base (445)..(445): a, c, t, g, unknown or other
  modified_base (463)..(463): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggtttcctcgttgctcttttaagaggtgtccagtgtcaagtgcaactggtggagtcgtgggggagcgtagtccagcctgggagtcacagagactctcctgtgcagcctcgtgggttcaccttcagtagctacggcatgcacgtgggtcccaccaaactccgaaggcaaaggggnttgggagtggggtgctagttgttcatccgtggagggctagtgttacaagtggtatgctggaccgtcgtaggaacgggcgattccacactctaccganacgacaactccagaacacaatntatttggacctagaaacngacctaagtcctagacgacgtagggtactactactacgtagtaacggaacgggacgggggaaccagggacgggtaacgttacgaaacggttacctacgtttacggacggttcggtaccggggg

SEQ ID NO: 419917 - DNA, 595 bp, Homo sapiens
  misc_feature: GZ8MTXP02HKEQC.8.33.C11.1.454.CMB.2.raw
  modified_base (263)..(263): a, c, t, g, unknown or other
  modified_base (322)..(322): a, c, t, g, unknown or other
  modified_base (541)..(541): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggagcgtagtccagccgtgggagtcacagagactctctgtgcagcctntgggtcaccttcagtcgctacggcatgcacgtgggtcccaccaaactcgaggcgaaggnttggagtgggtgctagtttgttcatccgtagagggtcaggttgttcaagtgggtactgctgaccgcgtaggacgggcgtatcacactctacacgacacaactacgacgaacaacattgtaacgtttggacctacggaactacgtacgtaacgtccgtaggacggtacgacggtacgtaactacgtacgtacggtaacggaaacggggacgggggaaacncgggaccggtaagttaccaacggttactacgtttcggaccggttcggtacgggg

SEQ ID NO: 419918 - DNA, 690 bp, Homo sapiens
  misc_feature: GZ8MTXP02IC1R5.8.33.C11.1.454.CMB.2.raw
  modified_base (404)..(404): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagccgtgggagtcacagagactctcctgtgcagcctcgtgggttccaccttcagtacgctacggcagtcgctaccgtcgggtccccaccaaaaccgtccgaaggacgaaaggggtgttgggaggttggggtggactagtttgtttcagtccgtggagggctagtgttcaagtgggtanggtactacgaccgtcggtaggaacgggccgtattccgacctactccgtacccgagacgaaccaacgtaccgaaacggaactaaacgtaatacggttacgttacggaaccgttacggaaaccacggtaccctaaaggtacccgtagggaacggtacgtacggggtagtaacgttaacgtacggttaacgggtaaaccgggaagggggaaaccgggggaaccgaggggtaccgggtaacgttaaccgaaacggttaccgtcgtttacggaccgttacgggtaccgggg

SEQ ID NO: 419919 - DNA, 735 bp, Homo sapiens
  misc_feature: GZ8MTXP02JS6B3.8.33.C11.1.454.CMB.2.raw
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagccgtgggagtcacagagactctcctgtgcagccctcgtggttccaccttcagtagctacggcatgcacgtcgggtccccaccaaacgtcccgaaggcgaaaggggacttggggaggtggggtggctaggttttgttcagttccgtaggagggctaggttgttacaagttgggtatggtctagaccgccggtagaaaccggggccgtacttccgaccgtactcctacccgaggtaccgaacaaccgtaccgaaacggaaacctaaacgtaaagttggttaaacgtttcggaacccgttacgaaacaaccggtaacctaaacggttcccgtaacgggtaacgggaaccgtaacggggtaacgttaaacgttaccgttaaacgtaacggggttaaaccgggaaaaggggggaaccgggggaaaccgaacggggtaccgggggtaaacgttaccccggtaaaacggtttacccttaccggtttaccggtaaccggttcgggtacccggggg

SEQ ID NO: 419920 - DNA, 621 bp, Homo sapiens
  misc_feature: GZ8MTXP02FFXML.8.33.C11.1.454.CMB.2.raw
  modified_base (302)..(302): a, c, t, g, unknown or other
  modified_base (323)..(323): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtgagtcgtgggggagcgtagtccagcctggggagtcacagagactctcctgtgcagcctctggttcaccttcagtagctacggcatgcacgtgggtcccnccaaactccaggcaaagggtnttggagtggggtggctagtgtttcatccgtggagggcaggttgttcaagttgggtatgctggaccgcggtagaacgggccgattccgaccatctccgagacgaaccaactccgaaggaacactaaatgttaatttcggaccttaggaaacacgtacctaaacgtcccgtagaacggacgacggggtataactaacgtacgtacggtaaacgggaaacggggaacgggggaaaccagggaccggggtaacgttaccgtaaacggtaccttacccgtttaggaccgttcggtaccggggg

SEQ ID NO: 419921 - DNA, 658 bp, Homo sapiens
  misc_feature: GZ8MTXP02JZ1UG.8.33.C11.1.454.CMB.2.raw
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctctttaagaggtgtccagtgtcaagtgcaactggtggagtcgtgggggagcgtagtccagcctgggagtcacagagactctcctgtgcagccctcgtgggttcaccttcagtagctacggcatgcacgtcgggtcccaccaaactccgaaggccgaaggggattgggaggtggggtggacgtagtttgtttcattccgtggagggcaggttgtacgtaagtgggtatggcgtcgaccgtccggtaggacggggccgtattccaccgtatcctaccgagtacgaacctaaccgtaccgaacgaacacctaaagttcggttaactttacgggaacctacggaaaccacgtacccgttaaacgtcccgtaggaacggacgtacggggtattacgaccgtacgtagggtaaaccggaagggggaccgggggaaaccgagggaccgggtaagttaccgaaacggttaccttaccgtacggaccgtcggtaccgggg

SEQ ID NO: 419922 - DNA, 541 bp, Homo sapiens
  misc_feature: GZ8MTXP02FEXKQ.8.33.C11.1.454.CMB.2.raw
  modified_base (397)..(397): a, c, t, g, unknown or other
  modified_base (403)..(403): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgagggaaagagccaccctctcctgcagggccagtcagaatgttggcgccttcgtaagctggtaccaacacaaacctggccaggctcccaggccccctcactctatggtgcatccaacagggcccactggcactcccagccaggttcagtcggcagtgggtatgggacagtctcactctcaccatcatcagcctgganctgaanatgttgctaagtttattactgtacactatcgtaccgagtccggccgtcccgggggcctacgtttccggacccgtgggacccgaacgggtggagaataccgaaacgacgtgtacggctgcaccactctcgtacttctac

SEQ ID NO: 419923 - DNA, 552 bp, Homo sapiens
  misc_feature: GZ8MTXP02HMIC6.8.33.C11.1.454.CMB.2.raw
  modified_base (208)..(208): a, c, t, g, unknown or other
  modified_base (243)..(243): a, c, t, g, unknown or other
  modified_base (284)..(284): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagcctccagcccaccctgtctttgctccaggggaaanagccaccctctcctgcagggccagtcagatgtgcncttgagctgtacacacaactgtcaggctcccacggcccctnatctatggtgcatccaatacggccactggcatcccagccaggttcagtcgcaggtgggtatggggacagcttcactctcactatcatcagccctaggacgccttagaagtgttgttcgacgttagtttacgttactagtacaactactcggtaccgtagtcggccgtccgggggacctccggttccggtcccggtcgggacccgaagggtcggagaactacgaaacgacgtcgtacggcgtaacgcacgtactcgtcgtacttactcg

SEQ ID NO: 419924 - DNA, 656 bp, Homo sapiens
  misc_feature: GZ8MTXP02JPJJW.8.33.C11.1.454.CMB.2.raw
  modified_base (210)..(210): a, c, t, g, unknown or other
  modified_base (275)..(275): a, c, t, g, unknown or other
  modified_base (286)..(286): a, c, t, g, unknown or other
  modified_base (295)..(295): a, c, t, g, unknown or other
  modified_base (303)..(303): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgctccgagggggaaagngccaccctctcctgcagggccagtcagatgttgcgcttgagctggtaccacacaactggccagcnccaggcccctnatcatggtncatccaangggccacgtggctagtccccagccgaggttcaggtcggcaggttcggggtaatggggaacagggtacctttcgaacttccgtacaaccctattccaactcaacgtccctaggacgcccttagaaagtgtagttacgacttaagtttacgttacgttacgttactaaacgtacttacggtaacccgtaaggttccggcccggttacccgggggtaccctacggttttcccgggaccccgttacggggaacccgtaagggtaccggggaaagtacggtaccgaaaacggtaacgtaccgggttacggacgtaacggaccctaaccgtacttccgtacggtttccttacgtacccg

SEQ ID NO: 419925 - DNA, 583 bp, Homo sapiens
  misc_feature: GZ8MTXP02JYN6M.8.33.C11.1.454.CMB.2.raw
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtagtccagccgtgggagtcacagagactctctgtgcagcctcgtggttcaccttcagtagctacggcatgcacgtcgggtcccaccaaactccgaggcaaggggtattgggagtggggtgctagtttcgtcagtccgtggagggtctaggtgttacaagtggtatgctgacgcgtagacggccatcacgtatctcagacgacaactcagacacgatgtacttagacctagaaccagacctaagtccgtaggacggacgtacggtcgtaactacgtacgtacggtaaacggaagggggacggggaaccgagggacgggtaacgttaccgaacgttacgtaccgtttcggacggtcgtacgggg

SEQ ID NO: 419926 - DNA, 918 bp, Homo sapiens
  misc_feature: GZ8MTXP02HL09I.8.33.C11.1.454.CMB.2.raw
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagccgtgggaggtcacagagactctcctgtgcagccctcgtgggttccaccttcagtagctacggcatcgcctacgtggggtccccgacctaaaacgtcccgaagggaccgaaaaggggtacgtttggggagggttgggggtgggaccgtaagggtttttcgtttaccgtaagtttccccgtaggggtacggggtctaaggggtttggtttacgaaagtttgggggttaatcggacgtttacgggaaccggggtccccgggttagggaaacccgggggacccgttaacgttaccgaacccctaacgtacccgttaacccgaaacggaaccggtaaacccaaacccgttaaccccgaaaacgggtaaacccaaaccgtaaagtttacggtttaacgtttttaacgggaacccgtttaacggaaaaccgtaaccggtaacccgttaaaacgggttacccgttacggggaaaccgggtaaccggtaacggggttaacggtttaaacgttaaacccggtttaaacggttaaccgggttaaaaccgggggaaaacgggggtaaaccgggggggtaaaacccgaacgggggtaaccgggggtaaaaccggtttaacccggtaaaaccgggtttaccccggtttaacccggttttaccgggtaacccggggttttaccggggttaaacccccggggggg

SEQ ID NO: 419927 - DNA, 682 bp, Homo sapiens
  misc_feature: GZ8MTXP02IXMN5.8.33.C11.1.454.CMB.2.raw
  modified_base (242)..(242): a, c, t, g, unknown or other
  modified_base (283)..(283): a, c, t, g, unknown or other
  modified_base (329)..(329): a, c, t, g, unknown or other
  modified_base (343)..(343): a, c, t, g, unknown or other
  modified_base (377)..(377): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtagtccagcctgggagtcanagagactctctgtgcagcctcgtggttccaccttcagtacncgtacggcatgccacgtcgggcccaccaaactccgaggcgaagggngtgggaggttgggnggtctagtttgttctattccgtggaggctaggtnttacgaagttgggtatggcgtacgaccggtcgtagggaacgggccgtattccgaaccgtacttcctaccgaagacgaaccaaccgtaccgaaacggaaaccaacgtaaagtttacggttaacgttttacgggaaccttaaggaaaccgtaacgtaccgtaaacgtccgtaggtaacgacggtacgggtaattaacgtacgttacgtaggtaaacgggaaacggggtacgggggaaaccgacgggtacgggtaacgttaccgaaacggttacccgttacgtttacgggtaccggtcggtacggggg

SEQ ID NO: 419928 - DNA, 663 bp, Homo sapiens
  misc_feature: GZ8MTXP02JHRDD.8.33.C11.1.454.CMB.2.raw
  modified_base (277)..(277): a, c, t, g, unknown or other
  modified_base (331)..(331): a, c, t, g, unknown or other
  modified_base (598)..(598): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtagtccagccgtgggagtcacagagactctcctgtgcagcctcgtggttcaccttnagtagctacggcatgccacgtcgggtcccaccaaacctccgaggcgaaggggtnttgggagttggggtgctagtttgttcatccgtggagggctaggttcgttacaagttgggtatcgggctagggaccgtccggtagggaacggggtccgtattcccgaccacgtcctaccgagacgaaccaacctaccgaacggaaacaacaaagttgttaacgtttcggaaccttacgaaaccacgtaccttaaacgtccgtaggacggaacgtacgggtagtaactacgtacgtacggtaaacggaaacggggacgggggtaaaccngggtaccgggtaacgttaccgtaaacggttaccgttaccgtttacggaccgttcggtaccggggg

SEQ ID NO: 419929 - DNA, 714 bp, Homo sapiens
  misc_feature: GZ8MTXP02HLGUD.8.33.C11.1.454.CMB.2.raw
  modified_base (333)..(333): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtagtccagcctgggaggtcacagagactctctgtgcagcctcgtggttcaccttcagtagctacggcagtgcacgtcgggtcccaccaaacgtcccgagggacaaaggggtnttgggaggtggggtggctaggtttgtttcagtccgtggaggctagttgtacaagtgggtatgctgacgtccggtaggaacgggtccgtagttccacactcctaccgagtaccgaacaaccgtaccgaacggaaacctaactaacgttagttaacgttttacggaacccttacgaaacgtaaccgtacccgttaacggtacccgtagggaacggtaccgtaacggggttacgttaaacgttaaccgttaacgttaacgggtaaacgggtaaacgggggtaacggggggtaaacccgaacgggggtaccggggtaaacggttaacccgtaaacggtttacccgttaccggtttaccgggaaccggtttcccgggtaccggggg

SEQ ID NO: 419930 - DNA, 490 bp, Homo sapiens
  misc_feature: GZ8MTXP02GLCBU.8.33.C11.1.454.CMB.2.raw
  modified_base (209)..(209): a, c, t, g, unknown or other
  modified_base (245)..(245): a, c, t, g, unknown or other
  modified_base (251)..(251): a, c, t, g, unknown or other
  modified_base (258)..(258): a, c, t, g, unknown or other
  modified_base (264)..(264): a, c, t, g, unknown or other
  modified_base (279)..(280): a, c, t, g, unknown or other
  modified_base (283)..(284): a, c, t, g, unknown or other
  modified_base (286)..(287): a, c, t, g, unknown or other
  modified_base (289)..(289): a, c, t, g, unknown or other
  modified_base (293)..(293): a, c, t, g, unknown or other
  modified_base (297)..(297): a, c, t, g, unknown or other
  modified_base (301)..(301): a, c, t, g, unknown or other
  modified_base (304)..(305): a, c, t, g, unknown or other
  modified_base (324)..(324): a, c, t, g, unknown or other
  modified_base (329)..(329): a, c, t, g, unknown or other
  modified_base (340)..(340): a, c, t, g, unknown or other
  modified_base (345)..(345): a, c, t, g, unknown or other
  modified_base (355)..(355): a, c, t, g, unknown or other
  modified_base (359)..(359): a, c, t, g, unknown or other
  modified_base (461)..(461): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaanacgccaccctctcctgcagggccagtcagatgtgcncttganctgacanacaacnggcagctccagcccnntcnngnnanccangcangcanccnnccagtcagtcgcagtgganggganaggtctcatcncaccntcatcagccngacncagagatgtgcttagttatactgtacaactatacgtacgagtacggccgtcggggtcctacgttccgccgtggacctaggtgagtactacaaacgacgtagngcctgacactactcgtacgtcctctaccg

SEQ ID NO: 419931 - DNA, 589 bp, Homo sapiens
  misc_feature: GZ8MTXP02IIIR9.8.33.C11.1.454.CMB.2.raw
  modified_base (430)..(430): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggagcgtagtccagcctgggagtcacagagactctcctgtgcagcctcgtgggttcaccttcagtagctacggcatgcacgtgggtcccaccaaactccgaggacaagggattgggagtggggtgctagtttgttcattccgtggaggctagtgttacaagtgggtatgctgaccgtcggtagaacgggcctatccaccatctcagacgacaacncaagaacacaatgtatttagactagaacagacctaagtccgtagacgacgacgggtattactacgtacgtacggtaacgggaaacgggtacgggggaaccgaggacggggtaacgttaccgaacgttaccgttacgtttacggacggttcggtacgggg

SEQ ID NO: 419932 - DNA, 780 bp, Homo sapiens
  misc_feature: GZ8MTXP02H1URL.8.33.C11.1.454.CMB.2.raw
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggaggcgtagtccaggccgtgggagtcacgagagactctcgtgtcgcacgtcctcgtggtccaccttcagtacgctacggcatcgcacgtcgggtcccaccaaactccgaaggacgaagggtagttgggaggtgggtgcgtagtttgttcagtcgtaggaggtctaggttgttacgaagttggggtattgccgtaggaccggtccggtagggaaaccgggtccgtactaccctaaccgacttacccgacccgaagaaaccgtaaccgaaacccgtaacccgaacggaaaccaaaccgttaaagttacggtttaacgtttacggtaaaccgtaacggaaaccgtaaccggtaacccgttaaaccggttaccggaacggtaaccgggaaccggtaacgggtttaacgttaaaccgttaacggttaacgtaaacggggtaaacggggaaaacggggggtaaccggggggaaaacccgtaacgggggtaacggggttaaaccggttaccggtaaaacggtttacccgttaccggttttaccggaccgggtttacgggtacccggggg

SEQ ID NO: 419933 - DNA, 594 bp, Homo sapiens
  misc_feature: GZ8MTXP02GW18P.8.33.C11.1.454.CMB.2.raw
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctcctgtgcagcctctgggttcaccttcagtagctacggcatgcacgtgggtcccaccaaactccaggcaaggggattggaggtggggtgctagtttgttcatctggaggcagtgttcaatgggtatggctgacgtcggtgaacgggccattccacatcctccagacgacaactacgaacgaacaacaattagtagtttcggacccttagaaacacgaccctaaggtcctaggacggtacgacgggtatacgtactacgtacgtaacggaaggggacgggggaaaccagggacgggaacgttaccgaaacgttacgttaccgtttacggtaccggtacggtccgggg

SEQ ID NO: 419934 - DNA, 543 bp, Homo sapiens
  misc_feature: GZ8MTXP02IMULE.8.33.C11.1.454.CMB.2.raw
  modified_base (306)..(306): a, c, t, g, unknown or other
  modified_base (398)..(398): a, c, t, g, unknown or other
  modified_base (403)..(404): a, c, t, g, unknown or other
  modified_base (409)..(409): a, c, t, g, unknown or other
  modified_base (415)..(415): a, c, t, g, unknown or other
  modified_base (422)..(422): a, c, t, g, unknown or other
  modified_base (425)..(425): a, c, t, g, unknown or other
  modified_base (498)..(498): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggagcgtagtccagcctgggaggtcacagagactctcctgtgcacgcctctgggttcaccttcagtagctacggcatgcacgtgggtcccnccaaactccaggcaagggatggagtgggtgctagttgtttcattccgtggaggtcagtgttacaagtgggtatgctgacgcgtagacgggcntcacnnctcanacacancagacanatntattgactagaacagctaagtcctagagacgaggtagtactactatacgtaacggaacgggacgggggaaccnggacgggtaagtaccgaagtacctacgttcgtacgtcgtacgggg

SEQ ID NO: 419935 - DNA, 602 bp, Homo sapiens
  misc_feature: GZ8MTXP02IPG7Y.8.33.C11.1.454.CMB.2.raw
  modified_base (207)..(207): a, c, t, g, unknown or other
  modified_base (241)..(241): a, c, t, g, unknown or other
  modified_base (278)..(278): a, c, t, g, unknown or other
  modified_base (288)..(288): a, c, t, g, unknown or other
  modified_base (354)..(354): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagcccacctgtctttgtctccaggggaanagccacctctcctgcagggccagtcagatgtgcncttgagctgtacacacaactgcagctccaggcccctnatctatggtncatccaatacgggccactggaccatccccagccaggttcagtggcagtgggtatggggacagcttnactctacaccatcatcagcctggacgtctgaacgtatgttagctagtttatttaactgttactaaactagttaccgtacggtacgtcgggtcccgttccgggggtccctaacggtttcccggtaccccggtacggggtaacccgtaacggggtacgggtaacggtaacgtaaccgaaaacggtaccgttaggtaacgggtcttaacggcctaaccgtaacgttccgttcggttacctttaccgttacc

SEQ ID NO: 419936 - DNA, 535 bp, Homo sapiens
  misc_feature: GZ8MTXP02FJJJE.8.33.C11.1.454.CMB.2.raw
  modified_base (378)..(378): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctccccaggccccctcatctatggtgcatccaacagggccagtggcatcccagcccaggttccagtcggcagtgggtatggggacaggctcactntcacatcatcagcctgagcctgaagatgtgctagtttattactgtctaacatcgtaccgagtcggccgtccgggggcctaccgtttccggcccgtcgggaccgtaacggtggagacgtacgaaacgaacgtagtggcgtgcaccatctcgtctctac

SEQ ID NO: 419937 - DNA, 710 bp, Homo sapiens
  misc_feature: GZ8MTXP02H10FO.8.33.C11.1.454.CMB.2.raw
  modified_base (208)..(208): a, c, t, g, unknown or other
  modified_base (283)..(283): a, c, t, g, unknown or other
  modified_base (294)..(294): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagcccacctgtctttgtctcgaggggaaancgccaccctctcctgcagggccagtcagatgtgcgcttcgagctcgtacaacacaactgccaggctccagccctnactctatggtnctataccaagtacgggcctaacgtggcactccagtaccgaggttccaggtcggcgtagggtcgggtagtcggggaacagtaccttcgaaccttctaccaaacctagtacctaacgtaccgacgtaccggttacgggaacgtccctaaggtaaacgtagtttcggttaacgtaaccgtttaggtttaaacttaccgttaacggttacctaaaacgttacgtaaccgggtaaaccggtcgggtacggtaccccgggtacccgggggtaccctttaacggtttcccggggaccggttaacgggggaaaccgtaacggggtacggggtaaaccgtaacgtaaaccggtaaaacgtacgtacgggttacgaccgttaacggaccctaacgtacgttcgttaccggttactttaacctcccg

SEQ ID NO: 419938 - DNA, 684 bp, Homo sapiens
  misc_feature: GZ8MTXP02INO2N.8.33.C11.1.454.CMB.2.raw
  modified_base (269)..(269): a, c, t, g, unknown or other
  modified_base (312)..(312): a, c, t, g, unknown or other
  modified_base (456)..(456): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacctgtctttgtctccgaggggaaagacgcccaccctctcctgcgaggccagtcagaatgttggcgccttgtaagctggtaccaanacaaacctggccaggcctcccgaggcccctcatctagtgggtnactactacccgaaacgacgggcccaacgtcggacactccccgaagccccgtaagggttccaggtcggaccgtagggtggggtataggggacaggtaccttcaaccttcctaccaacctatacaactcgaacgcccgtagggacncgttagaaagtatggttagacgttagtttaaatcgttagttaccaaacttacgtacgtaaccgagggttccggacccggttcccgggggtacctaccggttttccggaccccggtagggtaaccgtaaggggtacgggtacgtaacgtaaccgaaaacggtaccgttacgggtacggtacgtaacggtaccaaacccgttagtccgtttacggtccctttagtccccg

SEQ ID NO: 419939 - DNA, 750 bp, Homo sapiens
  misc_feature: GZ8MTXP02HIS9X.8.33.C11.1.454.CMB.2.raw
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagccgtgggagtcacagagactctcctgtgcagcctcgtgggttcaccttcagtagctacggcatcgcacgtgggtcccaccaaactccgaggacgaagggtattgggaggtggggtggctaggtttgttcagttccgtggaggggctaggttgttacgaagttgggtatgcgttaggaccgtccggtaggaacggggtccgtacgttaccaaccgtacgtcctaccgaagaacgaaccgaaaccgtaccgaaacggaaacctaacgtaaacgtttacggttaaacgtttaccggaaacccttacggaaaccgtaacgtaacccgttaaacggttaccccgtaagggtaaccgggtaaccggtaacggggttaacgttaaacgttaaaccgttaacggttaacgggtaaacggggaaaacgggggtaaacggggggaaccgtaacggggaccggggtaacgttacccggtaaacggttacccgttacggtttaccggtaccggtttaccgggttaacccggggg

SEQ ID NO: 419940 - DNA, 590 bp, Homo sapiens
  misc_feature: GZ8MTXP02F6F6M.8.33.C11.1.454.CMB.2.raw
  modified_base (424)..(424): a, c, t, g, unknown or other
  modified_base (437)..(437): a, c, t, g, unknown or other
  modified_base (492)..(492): a, c, t, g, unknown or other
  modified_base (536)..(536): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtagtccagcctgggaggtcacagagactctcctgtgcagcctctgggttcaccttcagtagctacggcatgcacgtcggggtccccaccaaaacctccgaggaccgaaaggggtacttggggaggtggggtggctaggtttgttcatccgtaggagggctagttgttacaagtggtatgcgtgacgcgtagacggcgatcacntctcagacacacncagacacatgtattacgactagacacgacctagtcctaggacggacgtacgggtntaactacgtacgtacggtaaacggaacggggacggggaaaccgngggacggtaacgttaccgaacgttaccgtacgttacgaccggtcgtaccggggg

SEQ ID NO: 419941 - DNA, 567 bp, Homo sapiens
  misc_feature: GZ8MTXP02JRJYC.8.33.C11.1.454.CMB.2.raw
  modified_base (263)..(263): a, c, t, g, unknown or other
  modified_base (327)..(327): a, c, t, g, unknown or other
  modified_base (358)..(358): a, c, t, g, unknown or other
  modified_base (439)..(439): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctctgtcgcagccctntgggttcaccttcagtagctacggcagtgcacgtgggtcccaccaaactccgaggacaagggtnttgggagtggggtgctagtttgttcatccgngacgggctagtgtcaagtggtatgctgacgccgtaggacggcgaattccactactctccgagacgacaacctacagaacanatgtagttacgacctagaacagactagtctaggacgacgaggtactactacgtacgacggtaacggaacggggtacggggaacaggacggaacgttacgaacgtactcgtttacgacgtcgtacgggg

SEQ ID NO: 419942 - DNA, 552 bp, Homo sapiens
  misc_feature: GZ8MTXP02I3CB4.8.33.C11.1.454.CMB.2.raw
  modified_base (246)..(246): a, c, t, g, unknown or other
  modified_base (259)..(259): a, c, t, g, unknown or other
  modified_base (265)..(265): a, c, t, g, unknown or other
  modified_base (271)..(271): a, c, t, g, unknown or other
  modified_base (280)..(280): a, c, t, g, unknown or other
  modified_base (290)..(290): a, c, t, g, unknown or other
  modified_base (351)..(351): a, c, t, g, unknown or other
  modified_base (389)..(389): a, c, t, g, unknown or other
  modified_base (398)..(398): a, c, t, g, unknown or other
  modified_base (402)..(402): a, c, t, g, unknown or other
  modified_base (492)..(492): a, c, t, g, unknown or other
tcagctcgcgtgtccacgaccggtgctcgatttagagtgagctcgttggggtttgggggaggaactgctcagttaggacccagagggaaccatggaagccccagctcagcttctcttcctcctgctactctggctcccagtttcagataccaccggagagattgtgttgacacagtctccagcccaccctgtctttgtctccgaggggaagagccaccctctcctgcagggccagtcagatgtgcncttgagctgacanacaacngcagcnccagccctnatctatggtncatacccaacgcggggacccacgtggccactcccagcctaggttcaggtcgcagtgggtangggacagtcttcactctacacatcatcagtcctggacnctagaagtntgtncttagttattacgtgtacaactagtaccgtacgagtccggccgtccgggggctacgtttccgggacccgtaggggacctagggtcggaanacgtaaacgaaacgtacgtcggtggacctggaccacgtactcgtacgttcttacgtaccg

SEQ ID NO: 419943 - DNA, 709 bp, Homo sapiens
  misc_feature: GZ8MTXP02G70DT.8.33.C11.1.454.CMB.2.raw
  modified_base (275)..(275): a, c, t, g, unknown or other
  modified_base (325)..(325): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagccgtgggagtcacagagactctcctgtgcagcctcgtggtcaccttnagtagctacggcatgcacgtcggtcccaccaaactccgaggacaagggtnttgggagtggggtgctagtttgttacatccgtaggaggtctagttgttacaagttggtatggctaggaccgtccgtagggaacgggtcctattccgacctactcctacccgaagaccgaacctaaccgtacccgaaacggaaacctaaacgtaaacgttaggtttaacgtttacggaacccgttacggaaacccgtacggtacccgttaaacggtcccgtagggaacgggtaaccgtacggggttacgttaaacgttacgttacgtaacggtaaacgggaaacgggggtaacggggggaaacccgtaaggggtaccggggtaacggttacccggtaaacggtttacccgttaccgtttacgggaccggttacggtacccggggg

SEQ ID NO: 419944 - DNA, 514 bp, Homo sapiens
  misc_feature: GZ8MTXP02JL4PI.8.33.C11.1.454.CMB.2.raw
  modified_base (207)..(207): a, c, t, g, unknown or other
  modified_base (242)..(242): a, c, t, g, unknown or other
  modified_base (247)..(247): a, c, t, g, unknown or other
  modified_base (253)..(254): a, c, t, g, unknown or other
  modified_base (258)..(258): a, c, t, g, unknown or other
  modified_base (272)..(276): a, c, t, g, unknown or other
  modified_base (278)..(279): a, c, t, g, unknown or other
  modified_base (281)..(281): a, c, t, g, unknown or other
  modified_base (285)..(285): a, c, t, g, unknown or other
  modified_base (288)..(289): a, c, t, g, unknown or other
  modified_base (292)..(292): a, c, t, g, unknown or other
  modified_base (294)..(294): a, c, t, g, unknown or other
  modified_base (296)..(297): a, c, t, g, unknown or other
  modified_base (299)..(299): a, c, t, g, unknown or other
  modified_base (302)..(302): a, c, t, g, unknown or other
  modified_base (306)..(307): a, c, t, g, unknown or other
  modified_base (314)..(314): a, c, t, g, unknown or other
  modified_base (317)..(317): a, c, t, g, unknown or other
  modified_base (319)..(319): a, c, t, g, unknown or other
  modified_base (331)..(331): a, c, t, g, unknown or other
  modified_base (337)..(337): a, c, t, g, unknown or other
  modified_base (345)..(345): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacctgtctttgctccgaggggaanagccaccctctcctgcagggccagtcagatgtgcnctgantgacannaacngcagctccagcccnnnnngnnancagngcnngcncncnncngtngcgnngtgtagngananctcactcacacntcatcngcgtgacncgtagagtgtgtagtattagtttatacgtatacaacgtacgtacgtacggtagtccggcccggtccggggtacctaccggttccggccgtagggaccgtagggtgacgtaacgtaacgaaacgtacgtcggtacggcgtaacgactacgtacgtcgtcgttcctactcc

SEQ ID NO: 419945 - DNA, 598 bp, Homo sapiens
  misc_feature: GZ8MTXP02F317D.8.33.C11.1.454.CMB.2.raw
  modified_base (161)..(161): a, c, t, g, unknown or other
  modified_base (330)..(330): a, c, t, g, unknown or other
  modified_base (494)..(494): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttccncgttgctcttttaagaggtgtccagtgtcaagtgcaactggtggagtcgtgggggagcgtagtccagcctgggaggtcacagagactctcctgtgccagcctcgtggttcaccttcagtagctacggcatgcacgtgggtcccaccaaaacgtccaaggccgaaagggnttgggaggtgggtgggctagtttgttacagtccgtggagggctaggtgttacaaagtgggtatgcgtgacgcggtaggacggcgatcacatctcgagacgacactacagaacacatagtattcggactagaacacgacgtactcgtaggacggtacgacgggtntaacgtacgtaacgtcggtaaacggaaaggggacgggggaaaccctggggacggtaacggttaccgaaacgttacgtccgtttacggacgttcgggtaccgggg

SEQ ID NO: 419946 - DNA, 646 bp, Homo sapiens
  misc_feature: GZ8MTXP02G9XSD.8.33.C11.1.454.CMB.2.raw
  modified_base (314)..(314): a, c, t, g, unknown or other
  modified_base (322)..(322): a, c, t, g, unknown or other
tcagctcgcgtgtccacgaccggtgctcgatttagagtgagctcgttggggtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcacgtcgggtccgaccaaactccgaggcaagggattgggagtggggtgctagttgtttcatcgtgaggactagtgttcaagtgtatgctgacgcgtgaacggcattcacntctcaganacactcagaacacatgtatcgactgaacacgctaagtctggacgaacgacgggtatactactacgtaggtaacggaagggaacgggggaaccaggacgggtagtaccgaagttaccgtcgttacggacgtcggtacggggaccgtacggggtacccgtggtaccctaccggtcctaccctcgaccgtccctaccgacccgtaaccggggtacccaccggttcccgttccccgttcccccgacgggtccccgtaccccgtcgtcccgtaccgacgggaacccgtcccgaccccgttaccggaccgaccgtcccgacggacccggg

SEQ ID NO: 419947 - DNA, 668 bp, Homo sapiens
  misc_feature: GZ8MTXP02FUXY3.8.33.C11.1.454.CMB.2.raw
  modified_base (210)..(210): a, c, t, g, unknown or other
  modified_base (302)..(302): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgtttacacagtctccagccaccctgtctttgtctccgaggggaaanagccaccctctcctgcagggccagtcagatgttggcgtccttcgaagctaggtaccaacacaaaccgtggccaggcctcccgaggccccctnatctatggtgcataccaacgcgggcccacgtggaccactccccgagccgtaggttccaggtggccgaggtggggtagtcggggacagtacttcactctacacctatacatcagtcctaggacgccgtagaagtagttggttagtacgttaagtttactacgttagtacctaaacgtacgttaccggttaaccggtacgggttaccggggtcccccggttcccgggggtacccttacccgggttttcccgggccccggttacggggaacccgtaagggtcggaaacggtacgtaaaccgaaaacggtacgtggtcggtacgtaccgaacgtaccgtattccgttacgttcctacctacgtttccccg

SEQ ID NO: 419948 - DNA, 636 bp, Homo sapiens
  misc_feature: GZ8MTXP02IIP7U.8.33.C11.1.454.CMB.2.raw
  modified_base (255)..(255): a, c, t, g, unknown or other
  modified_base (263)..(263): a, c, t, g, unknown or other
  modified_base (305)..(305): a, c, t, g, unknown or other
  modified_base (326)..(326): a, c, t, g, unknown or other
  modified_base (580)..(580): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggagcgtagtccagccgtgggagtcacagagctctcctgngcagcctntggttcaccttcagtagctacggcatgcacgtcgggtacccnccaaactccgaaggcaagggngttggagtgggtgctagttgtttcatccgtaggaggctagtcgttacgaagttggggtaatggcgttaggaccgtccgggtaggaacgggcccgtattccaccgtatctaccgagaacgaacaacctaccgaagaacaactaagttagttacgtttaggaacccttagaaacgtacgtaccgtaacgtccgtaggaggtacgtacggtatactacgtacgtacggtaaaggaaacggggacggggaaaaccggnggacggtaacgttaccgtaacgttaccgttacggttacggtacggttacggtcggg

SEQ ID NO: 419949 - DNA, 612 bp, Homo sapiens
  misc_feature: GZ8MTXP02G4U57.8.33.C11.1.454.CMB.2.raw
  modified_base (211)..(211): a, c, t, g, unknown or other
  modified_base (260)..(260): a, c, t, g, unknown or other
  modified_base (266)..(266): a, c, t, g, unknown or other
  modified_base (284)..(284): a, c, t, g, unknown or other
  modified_base (295)..(295): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagcccaccctgtctttgtcctccgaggggaaancgcccaccctctcctgcagggccagtcagatgtgctctgagctgacaanacaacngccagctccgagcccctnatctagtggtncataccaagtacgggcctacgtggacccacgtccccaagtcccgtaggttccgaggtcggcgtaggtggggtatcggggacagtcttcactctccaccatcatcagccgtggactcgtagtaagattcgtgtacttagtttacttacgtgtacctaactagtccggtacgacgttccgggacccgttccgggggtacctaccggtttccggacccgggtacgggaacccgtaaggggtacggaacgtaactaccggtaaaacgtacgttacggcggtactccggacctaccgtacttccgtacttccttactacccg

SEQ ID NO: 419950 - DNA, 613 bp, Homo sapiens
  misc_feature: GZ8MTXP02G4GQT.8.33.C11.1.454.CMB.2.raw
  modified_base (210)..(210): a, c, t, g, unknown or other
  modified_base (244)..(244): a, c, t, g, unknown or other
  modified_base (250)..(250): a, c, t, g, unknown or other
  modified_base (257)..(257): a, c, t, g, unknown or other
  modified_base (263)..(263): a, c, t, g, unknown or other
  modified_base (280)..(280): a, c, t, g, unknown or other
  modified_base (291)..(291): a, c, t, g, unknown or other
  modified_base (416)..(416): a, c, t, g, unknown or other
  modified_base (422)..(422): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagcccaccctgtctttgtctccgaggggaaangccaccctctcctgcagggccagtcagatgtgcncttganctgacanacaacngcagctcccagcccctnatctagtggtncactccaaagtcgggccctacgtggaccactcccgagcccgtaggttccaggtcggcgtaggtgggtatggggaaccagtccttcactctaccacatcactcagccgtggactccgtagaaagtntggttnacgttaagtttactacgtgttaacaaacgttgtacccggtaacggaggtcccggacccggtccgggggtaccttaccgggtttcccggaccgtaggggaaccctaaggggtacggacgtaacgtaaccgaaaacggtccgtggttcggactcggacctaccggtattccgtcgttacccttcgtaaccccg

SEQ ID NO: 419951 - DNA, 594 bp, Homo sapiens
  misc_feature: GZ8MTXP02I61M8.8.33.C11.1.454.CMB.2.raw
  modified_base (211)..(211): a, c, t, g, unknown or other
  modified_base (270)..(270): a, c, t, g, unknown or other
  modified_base (276)..(276): a, c, t, g, unknown or other
  modified_base (286)..(286): a, c, t, g, unknown or other
  modified_base (297)..(297): a, c, t, g, unknown or other
  modified_base (439)..(439): a, c, t, g, unknown or other
  modified_base (446)..(446): a, c, t, g, unknown or other
  modified_base (473)..(473): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagcccaccctgttctttgtctccgaggggaaanacgcccaccctctcctgcgagggccagtcagatgttgcgcttgagctgacaacacaacngcagcnccagcccctnatctagtggtnacataccaaagtcggacctagtcggcactccccgagtcctacggttacaggtcggacgtagggtgggtagtggggaaccaggtacctttcaaccgttctacccacctatccaatcgacgtccgtggacgtcgtagaaacgtnttggttnactttagtttattactagtacaacgtnttaccggacgtaggtccggacccggttcggggccttacggttcccggacgtagggaccgaggtgaacgagtaacgaaacgtcgtacggtgactgaccaccgtatcgttctactttactccg

SEQ ID NO: 419952 - DNA, 649 bp, Homo sapiens
  misc_feature: GZ8MTXP02FYI48.8.33.C11.1.454.CMB.2.raw
  modified_base (296)..(296): a, c, t, g, unknown or other
  modified_base (441)..(441): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagaatgttggcgcttcgaagctggtaccaacacaaacctggccaggctcccaggcccctnatctatggtgcatcccaaacgacgggcccacgtcggaccactccccgagcccgaggttcaggtcggacgtaggtggggtatggggaacagtacttcaactctaccacctatccatccgagtcccgtaggactccgtagaaacgtnttggttgtacttagtttattacgttgtactaaactacgttaccgtaacggtacggtccgggtcccggttacccgggggccttacgttccggggacccgtaggggacccaaaggggtcggaaaggtacgttaaacgaaaccggtaacgtcgggtacggtcgtaacggtaccgtaaccgtacgttcggtcgtttaccttcgtttaacccg

SEQ ID NO: 419953 - DNA, 571 bp, Homo sapiens
  misc_feature: GZ8MTXP02JBVSJ.8.33.C11.1.454.CMB.2.raw
  modified_base (208)..(208): a, c, t, g, unknown or other
  modified_base (318)..(318): a, c, t, g, unknown or other
  modified_base (405)..(405): a, c, t, g, unknown or other
  modified_base (414)..(414): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaanagccaccctctcctgcagggccagtcagaatgttggcgccttgtaagctggtacccaacacaaacctggccaggcctcccaggccccctcatctatggtgcatccaaacngggccactggctactcccagccaggttcaggtcgcaggtgggtatggggacagtacttcactctacacctatcatcagccctggacncctagaagnttgttgactagtttattactgtacaactatccgtacggagtccggccggttcccgggggcctaccgtttccgggcccgtaggggacccaagggtggagacgtacaaaacggtctacggtcggctaaggccaacgtactccgtagttccttactaccc

SEQ ID NO: 419954 - DNA, 785 bp, Homo sapiens
  misc_feature: GZ8MTXP02FRR6Q.8.33.C11.1.454.CMB.2.raw
  modified_base (328)..(328): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccaggcctgggaggtcacagagactctcctgtgcagccctcgtgggttcaccttcagtagctacggcatgccacgtgggtcccaccaaactccgaggcaagggnttggagtgggtggctagtttgttcagtccgtagggaggctaggttcgttacgaaagttggggtaatcggcgttggaacccgggtccgggttagggaaacggggtcccgtagtttacccgaaccctacttccgtacccgaagaaccggaaccaaaaccgtacccgaaaacgggaaacctaaaccgtaaagttacggttaacgtttaacggggtaacccttaagggaaacctaacggtaacccgttaaacggtaccccgttagggaacgggtaccgtaacggggtacgttaaaaccgttaaccgttaacggttacggggttaaaacggggtaaaacgggggtaaccgggggggaaaacccgtacgggggtaaccgggggttaaaccgttaaccggtaaaacggtttacccggtttaacccggtttacgggtaaaccgggttccgggttaacccgggggg

SEQ ID NO: 419955 - DNA, 570 bp, Homo sapiens
  misc_feature: GZ8MTXP02J1CD2.8.33.C11.1.454.CMB.2.raw
  modified_base (299)..(299): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggcctcccaggccccctnatctatggtgcatccaacagggccactggcatcccagccaggttcagtcggcagtgggtatgggacagcttcactctcacctatcatcacgcctggacgccctagaacgtatgttgtacgttagtttattaccgttgtacaacgtactacggtaccggagttcggcccggttacccgggggccctacgtttccgggcccgtacgggaccgtaacgggtcggagacgtacgaaacgactcgtacggcgtcgcacgactactcgtcttactac

SEQ ID NO: 419956 - DNA, 602 bp, Homo sapiens
  misc_feature: GZ8MTXP02GXMDR.8.33.C11.1.454.CMB.2.raw
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagccgtgggagtcacagagactctcctgtgcagcctcgtgggtcaccttcagtagctacggcatgcacgtggtcccaccaaactccgaggcaagggtcttggagtgggtgctagtttcgttcatccgtgacggcagtgttacaagtggtatgctagacgcgtagaacgggcgattccgacatcctcgagacgacaactaccgaaggaacaacgaattacgtatttacggacccttagaaacacgtacctaaacgtccgtaggacgacgtacgggtatacgtaactagtacgtaacggaaacggggacgggggaaaccagggacgggtaacgtacgtaaccgtacgttaccgttacggtaccggtacgttaccgggg

SEQ ID NO: 419957 - DNA, 559 bp, Homo sapiens
  misc_feature: GZ8MTXP02GP7P7.8.33.C11.1.454.CMB.2.raw
  modified_base (243)..(243): a, c, t, g, unknown or other
  modified_base (248)..(248): a, c, t, g, unknown or other
  modified_base (257)..(257): a, c, t, g, unknown or other
  modified_base (261)..(261): a, c, t, g, unknown or other
  modified_base (276)..(276): a, c, t, g, unknown or other
  modified_base (285)..(285): a, c, t, g, unknown or other
  modified_base (292)..(292): a, c, t, g, unknown or other
  modified_base (348)..(348): a, c, t, g, unknown or other
  modified_base (366)..(366): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgagggaaagagccaccctctcctgcaggccagtcagatgtgcnctganctgacacanaacngcagctccagccctnatctatgtncatccanaggccacgtgcatcccgagccaggtcagtggcaggtggtatgggacagtctcactntcacatcaatcagtccgngacgccgtagaagtgtagttgacttagtttattagtagtacaactactacgtacgtagtcggtcccgtccgggggtacctacgtttccggacccgtacgggaacccgtaacgggttaggaacgtaacgtaacgaaaacgtaccgtagtcggtacgtaacgacctaccgtactccgttacgtcctttactaccg

SEQ ID NO: 419958 - DNA, 569 bp, Homo sapiens
  misc_feature: GZ8MTXP02FLGSO.8.33.C11.1.454.CMB.2.raw
  modified_base (209)..(209): a, c, t, g, unknown or other
  modified_base (244)..(244): a, c, t, g, unknown or other
  modified_base (249)..(249): a, c, t, g, unknown or other
  modified_base (256)..(257): a, c, t, g, unknown or other
  modified_base (261)..(261): a, c, t, g, unknown or other
  modified_base (267)..(267): a, c, t, g, unknown or other
  modified_base (275)..(275): a, c, t, g, unknown or other
  modified_base (281)..(281): a, c, t, g, unknown or other
  modified_base (284)..(284): a, c, t, g, unknown or other
  modified_base (291)..(291): a, c, t, g, unknown or other
  modified_base (301)..(301): a, c, t, g, unknown or other
  modified_base (306)..(306): a, c, t, g, unknown or other
  modified_base (325)..(325): a, c, t, g, unknown or other
  modified_base (363)..(363): a, c, t, g, unknown or other
  modified_base (372)..(372): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagatgtgcnctganctgacannaacngcagcnccagcccnatctangtncatccanggccagtgcntccanccagtcagtgcagtggtangggacagcttcactctaccactatcatcagcctggacncctagaagntgttgactagtttattactgtaccaactacgtaccgtaccggtagtccgggacccggtcccgggggcctaccggtttccggcccgttaggggacccgtaaggggttcggaacgtacgttaaccgaaaacggtaacgttcggtacggtacgtaacggaccctaacctaacgttccgttcgttaccttacgttaacccg

SEQ ID NO: 419959 - DNA, 632 bp, Homo sapiens
  misc_feature: GZ8MTXP02FY7NU.8.33.C11.1.454.CMB.2.raw
  modified_base (330)..(330): a, c, t, g, unknown or other
  modified_base (533)..(533): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagccgtgggaggtcacgagagactctcctgtgcagcctcgtggttcaccttcagtgctacggcatgcacgtcggggtcccaccaaactccgaggcaaaggggtnttgggaggtggggtggctagtttgttcatccgtggaggggctaggttgttacaaagttgggtatggctagaccggtccggtagggaacggggccgtattccgacctatcgtaccagacgacaacctccgaacggaacaacgtaatacgttagtttacgaacctagaaacacgtacctaacgtccgtaggaggacgtacgggtntaactacgtacgtacggtaaacggaacggggacgggggtaaacagggtacgggaacgttaccgaacgttaccgtaccgtttacggacgtcggtacgggg

SEQ ID NO: 419960 - DNA, 697 bp, Homo sapiens
  misc_feature: GZ8MTXP02JGI39.8.33.C11.1.454.CMB.2.raw
  modified_base (325)..(325): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagccgtgggagtcacagagactctctgtgcagcctcgtggttcaccttcagtagctacggcatgcacgtcgggtcccaccaaactccgaggcaagggtnttgggagtggggtgctaggtttgttcagttccgtaggacgggtctaggttcgttacaagttgggtatcggcgtggaccgtcggtaggaacgggtccgtattccgacctactcctaccgaagacgaacctaaccgtaccgaaacggaacctaaacgtaagttaggttaacgtttaggacttaccgtaacgaaaccgtacggtaaccgttaaacggtcccgtaggaaccggtaaccgtacgggttagtaaacgtacgtaaaccggtagggtaaaccgggaacgggggaaaccgggggaaccgacgggtaaccggggtaacgttaacccggtaaacggttacccgttaccggttacggtacgggtttacccgggg

SEQ ID NO: 419961 - DNA, 660 bp, Homo sapiens
  misc_feature: GZ8MTXP02GGE7F.8.33.C11.1.454.CMB.2.raw
  modified_base (252)..(252): a, c, t, g, unknown or other
  modified_base (299)..(299): a, c, t, g, unknown or other
  modified_base (310)..(310): a, c, t, g, unknown or other
  modified_base (410)..(410): a, c, t, g, unknown or other
tcagctcgcgtgtccacgaccggtgctcgatttagagtgagctcgttggggtttgggggaggaactgctcagttaggacccagagggaaccatggaagccccagctcagcttctcttcctcctgctactctggctcccagtttcagataccaccggagagattgtgttgacacagtcctccagcccaccctgtctttgtcctccgaggggaaagcgcccaccctctcctgcagggccagtcagatgttggcncttgagctagaccaacacaacctggccaggcctcccgacgcccctanatctatgggtnacatacccaagacgggccacgtggaccactcccagccgtaggttccaggtcggactaggtggggtaatcggggaactagccttcactcctaccaccctancctaaatccgacgtcccgtggaacgtcccgtaagaagtacgttgttacgtataaggttttacttactagtacaaacttacgtccgtaacgtacggtccggtacccggtccgggggtaccttacggttcccgggacccgtcgggggtaaccaagggggtcgtaaaggaccgttaacgaaaaccggtaacgttcgggaacggtcctaacggtacccaaccgttacgtccgttacgtacctaccgttaacccg

SEQ ID NO: 419962 - DNA, 701 bp, Homo sapiens
  misc_feature: GZ8MTXP02GU8NN.8.33.C11.1.454.CMB.2.raw
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctctttaagaggtgtccagtgtcaagtgcaactggtggagtcgtgggggagcgtagtccagccgtgggaggtcacgagagactctcctgtgcaggtccctcgtgggttcacccttcagtagcctacggcatgctacgtcggtcccaccaaactcgaggtacgaaggggattgggacggtggggtggctaggtttgttactagtccgtggacgggctaaggttcgttacgaagttgggtactggtaccgtacggaaccgtcgttaggaaaccgggtccgtacttcccgaacctacgtccttaccgaacggaacaaaccaaccgtaccgaaacggaaacctaacgtaaattaggtttaacgtttacgggaccttacggaaaccgaacggtacccgtaaacggttcccgaacgggtaacggtaccgtacgggttagtaacgttaaccgttacgtaggtaaacgggaaaggggtacggggaaacccgtaggtaccgggtaagtaccgtaacgtacgtcgttacgacggttcgtacgggg

SEQ ID NO: 419963 - DNA, 758 bp, Homo sapiens
  misc_feature: GZ8MTXP02I8OLJ.8.33.C11.1.454.CMB.2.raw
  modified_base (255)..(255): a, c, t, g, unknown or other
  modified_base (329)..(329): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagtcgtgggggagcgtagtccagccgtgggagtcacagagactctctgngcagcctcgtggttcacttcagtacgctacggcagtcgcacgtcgggtccaccaaactccgaggacgaagggtnttgggacggtggggtggactaggtttcgtttacagttccgtgggacggggtactaggttcgttacgaagttcggggtaatcggtcgtacggaccgggtcccggtagggaaaccggggtcccgtaagttacccaaccgtacttccgtaccgagaaccgtaacctaacccgtaaccgaaacggaaactaaaccgtaaagttaggtttaacgtttacggaacccttaagggaaaactaacgtacccgttaaacgtcccgtaagggacggtaaaccggtacggggttaactaacgtaacgttaacggtacgggtaaaaccgggaaagggggaaccgggggaaaaccgtacggggtaaccggggtaaacgtttaaccccggaaaggtttaacccgttacccggtttacgtaacccggtttcggtaacccggggg

SEQ ID NO: 419964 - DNA, 828 bp, Homo sapiens
  misc_feature: GZ8MTXP02HK332.8.33.C11.1.454.CMB.2.raw
  modified_base (211)..(211): a, c, t, g, unknown or other
  modified_base (322)..(322): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctgctctggctcccagtttcagataccaccggagagattgtgttgacacagtctccagcccaccctgttctttgtctccgaggggaaancgcccaccctctcctgcagggccagtcagatgttggcgtccttgaagctaggtaccaacacaaaccgtggaccaggcctcccgacggccccctacactccgtagtggtacncactaccgaaaagtcgggaccacgtcggtacaccttccccagtcccgtaggtttccaggtcggacgtagggttaggggttacgtaggggactacggtacctttacaaccttcctacctaaccctattacccgaaattccgaaaccgtcccggtaaggggacctacccggtaagtaacggactttcgggttataccgtttaaaggtttttacttaacccggtttaggtaaaacccttaacgttaccgggtttaaacccgggttaacccgggtacggggtttacccccgggggttacccccggggttccccggggggtaaaccccttttaccccgggttttccccgggggacccccggggttacgggggttaaaacccggaaaagggggttcggggaaacgtaaacccgtaaacccgggtaaaaacgggttcccgtttaaggggcccggggtaaacgttccgggaaccctaccgtttacgtttaccggtaccgttttacctttacccc

SEQ ID NO: 419965 - DNA, 662 bp, Homo sapiens
  misc_feature: GZ8MTXP02HIRVW.8.33.C11.1.454.CMB.2.raw
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggagcgtagtccagccgtgggagtcacagagactctcctgtgcagcctctgggttccaccttcagtagctacggcatcgcacgtcgggtcccaccaaactccgaaggacgaaggggtattgggaggtggggtgctagttgttcatccgtggaggctagtgttacaagtggtatgctgaccgtcggtagaacggccgtatccgaccacgtcctacgagaacgaaccaacgtaccgaacggaaacaaacgtaagttagttaacgtttacgggaaccttacggaaaccacgtaaccgtaacgtccgtaggaacggtaccgtacgggtagttaacgtacgtacgtaacggtaaacggggaaacggggaacgggggaaccgaacgggtacgggtaaaccgttaccgtaaaccgttaccgtaccgtttacggaccggtttacggacccggggg

SEQ ID NO: 419966 - DNA, 686 bp, Homo sapiens
  misc_feature: GZ8MTXP02H7ZI3.8.33.C11.1.454.CMB.2.raw
  modified_base (208)..(208): a, c, t, g, unknown or other
  modified_base (267)..(267): a, c, t, g, unknown or other
  modified_base (279)..(279): a, c, t, g, unknown or other
  modified_base (285)..(285): a, c, t, g, unknown or other
  modified_base (296)..(296): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctccagtttcagataccaccggagagattgtgttgacacagtctccagccacctgtctttgtctccgaggggaaanacgccaccctctcctgcaggccagtcagatgtgcgcttcgtagctgtaccaacacaacngccagcctccgngccccnactctagtggnacactaccaacgacggccaacgtggcactcccagccctaaggttcaggtcggactagggtcgggtaagtcggggactacggtacctttaccgaacctccgtaccaaccctattacaactaccgacgtcccgttacgggacggtccctaaggaaagtagtttcggttacgtacgtttagttttacttaccgttgttaaccaaagttcgttacggtaccgggtagtccggggtaccccggttcccgggggtcccttacgggtttcccggtaccccgttcgggggaacccgtaaggggtacggggtaacgaaacttaaccggaaaaccgtaacggttacggtcggaaccgttcggacctaaccgtcgttacgtcgtttacccgtttctacccg

SEQ ID NO: 419967 - DNA, 724 bp, Homo sapiens
  misc_feature: GZ8MTXP02JEZ7D.8.33.C11.1.454.CMB.2.raw
  modified_base (285)..(285): a, c, t, g, unknown or other
  modified_base (326)..(326): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttactcgttgctcttttaagaggtgtccagtgtcaagtgcaactggtggagtcgtgggggagcgtagtccagccgtggggagtcacagagactctcctgtcgcagccctcgtgggttcaccttcagtanctacggcatgcacgtgggtcccacaaactccgaggcaaggnttggagtgggtgctagtttgttacagtccgtaggagggtcaggttgttacgaagttgggtaatggcgttcggaccgtccgtagggaacgggggccctatttccgaaccctagtcctaccgagacgaacccaaccgtacccgaaaggaaccaaaccgtaaagttacgggttaacgttttacgggaaaccccgttaggaaaacccgtacggtaaacccgtttaaacggtaccccgttaggaaaccgggtaccgtaaccgggggttattaacgttaaaccgttacgtaacgggtaaacgggtaaacgggggaccgggggtaaaaccgcgggtaccggggtaaaccgtacccgtaaacggttacccgttaccgtttacggaacccgggttcgtaaccggggg

SEQ ID NO: 419968 - DNA, 706 bp, Homo sapiens
  misc_feature: GZ8MTXP02FI525.8.33.C11.1.454.CMB.2.raw
  modified_base (208)..(208): a, c, t, g, unknown or other
  modified_base (217)..(217): a, c, t, g, unknown or other
  modified_base (282)..(282): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgagggaangccaccctncctgcaggccagtcagatgtgcgcttgaagctgtacaacacaactggccagctcccaggcccctnatctatggtgcataccaacgaggggcccaacgtggaccactccccgagcccgtaaggttccaaggtcggacctaggtggggtactggggacaggtaccttcactctacaaccctatccatccagtccctagggacgcccgttagaaacgtagttcggtttacgacgttaacggttttatttaaaccggttcggttaacctaaaaccgtacgttacccgggttaaacccgggtagggtacccggggtccccgggttcccgggggggtacccttaacccgggtttacccgggggcccccgtttaacggggggaacccctaaagggggttaccgggaggtaaaccgttaaccgaaaaaccgggtaaccgtttggaacgggtcgtaacggtacgaacttaccgtatttccgttacggttcctttaccg

SEQ ID NO: 419969 - DNA, 616 bp, Homo sapiens
  misc_feature: GZ8MTXP02JVC3Y.8.33.C11.1.454.CMB.2.raw
  modified_base (208)..(208): a, c, t, g, unknown or other
  modified_base (243)..(243): a, c, t, g, unknown or other
  modified_base (282)..(282): a, c, t, g, unknown or other
  modified_base (393)..(393): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagatgtgcnctgagctgtacaacacaactgccaggctccaggcccctnatctatggtcgcatccaatacgggccacgtggcactcccagccaggttcaggtcggacaggtgggtatggggacaggtaccttcactctacaccatcatcagccctggacnccgtagaacgtatcggttagacttagtttacttaacgtgttaccaactagtaccggtaccggtaggtccggtacccggttcccgggggtaccctaccggtttcccgggaccccgttacggggaacccgtaagggggttcggaaacgtacgtaacgaaaaccggtaacgtcgggttacggcgtaacgccgaaacccgttcttccgtacgttaccttacgtaccg

SEQ ID NO: 419970 - DNA, 762 bp, Homo sapiens
  misc_feature: GZ8MTXP02HVZGW.8.33.C11.1.454.CMB.2.raw
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaacgtggtggagtcgtgggggagcgtagtccagccgtgggagtcacagagactctcctgtgcagcctcgtggtcaccttcagtacgctacggcatgcacgtcggcccaccaaactccgaaggacgaagggtgttgggagtggggtgctagttttcgttcattccgtaggacgggtctaggttgttacgaagttggggttatcggtaccgttcgggaaccggtcccggtagggaaaccggggcccgttaaagttcccgaacccgtaacttcccgtaccgaaacggaaccggtaacctaaacccgtacccgaaaacggaaaccctaaataaacggtttacgtttaacgttttaccggaacccgttaagaaacccgtaacgtaacccgttaaacggttcccgtagggaacggtaaccggtacggggttaacgttacgtaaccgttacggtaacggtaaacggggaaaacgggggaccgggggaaaccgtacggggacggggtaaaccggttacccgtaaacggtttacccgtaccggtttacggtaaccgggttccggtacccggggg

SEQ ID NO: 419971 - DNA, 552 bp, Homo sapiens
  misc_feature: GZ8MTXP02H6DKS.8.33.C11.1.454.CMB.2.raw
  modified_base (209)..(209): a, c, t, g, unknown or other
  modified_base (260)..(260): a, c, t, g, unknown or other
  modified_base (272)..(272): a, c, t, g, unknown or other
  modified_base (281)..(281): a, c, t, g, unknown or other
  modified_base (290)..(290): a, c, t, g, unknown or other
  modified_base (300)..(300): a, c, t, g, unknown or other
  modified_base (337)..(337): a, c, t, g, unknown or other
  modified_base (345)..(345): a, c, t, g, unknown or other
  modified_base (378)..(378): a, c, t, g, unknown or other
  modified_base (383)..(383): a, c, t, g, unknown or other
  modified_base (420)..(420): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanacgccaccctctcctgcagggccagtcagaatgtgcgcttgagctgacaanacaactgcagcnccagccctnatctatggncatccaacgnggccacgtggccatccccagccaggttcaggtcgacngtgggtangggacagcttcactctcaccatcaatcagcccnggacnccgtgaagatgttgactagtttatactgtacaaactntacggtaccggagtcggaccgtccgggggcctaccgtttccggcccgtaggggaaccctaagggtcgggagtacttaaccgaaaacggtctaggtcgacgtcgactaaccattccgagttaccctcgtaacc

SEQ ID NO: 419972 - DNA, 694 bp, Homo sapiens
  misc_feature: GZ8MTXP02GO7JN.8.33.C11.1.454.CMB.2.raw
  modified_base (329)..(329): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggagcgtagtccagccgtgggagtcacagagactctcctgtgcacgcctctggttccaccttcagtagctacggcatgcacgtcgggtcccgaccaaactccaggcaaagggtnttggaggtgggtgctagtttgttacagtcctgggacggctaggttcgttacgaaagttggggtactcggacgttcgggacccgccgggaaacgggtaaacggggcccgtaactttacccgaaccctacgtaccgtacccgaagaaccgtaaccaaaccgttaacccgaaacggaaaacctaaaccgtaaattacggttaacgttttacgggaaccttacggaaaccgtacgtaaccgttaacgtaccgtagaacggtacgtacgggtacgtaactacgtaacgtacggtaacggaaagggaccgggggaacacgggtacggaacgtacgtaacgttacgttaccgtacgtacgtacggtaccggg

SEQ ID NO: 419973 - DNA, 579 bp, Homo sapiens
  misc_feature: GZ8MTXP02HTAHW.8.33.C11.1.454.CMB.2.raw
  modified_base (326)..(326): a, c, t, g, unknown or other
  modified_base (411)..(411): a, c, t, g, unknown or other
  modified_base (416)..(416): a, c, t, g, unknown or other
  modified_base (421)..(421): a, c, t, g, unknown or other
  modified_base (429)..(429): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggaggcgtagtccagcctgggagtcacagagactctctgtgcagcctcgtgggttcaccttcagtagctacggcatgcacgtgggtcccaccaaactccgaggcaaggggnttgggagtggggtgctagttgttcagtcctggagggctaggttgttacaagttggtatgctgacgcgtgaacgggcatcacatcncaganacacncagaacanatgtattgactagaacacgacctaagtccgtagacggacgacgggtatactaacgtacgtacggtaacgggaacggggacgggggaaccgagggacgggtaacgttaccgaacggttaccgttccgtttacggacggttcggtacggggg

SEQ ID NO: 419974 - DNA, 568 bp, Homo sapiens
  misc_feature: GZ8MTXP02I8C2F.8.33.C11.1.454.CMB.2.raw
  modified_base (206)..(206): a, c, t, g, unknown or other
  modified_base (240)..(240): a, c, t, g, unknown or other
  modified_base (252)..(252): a, c, t, g, unknown or other
  modified_base (258)..(258): a, c, t, g, unknown or other
  modified_base (264)..(264): a, c, t, g, unknown or other
  modified_base (273)..(273): a, c, t, g, unknown or other
  modified_base (283)..(283): a, c, t, g, unknown or other
  modified_base (375)..(375): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgctccaggggaanagccacctctcctgcagggccagtcagatgtgcnctgagctgacanacaacngcagcnccagccctnatctatggtncatccaagtcggccagtggcatcccagccaggtcagtgcagtggtatgggacagcttcactctccacagtcatcagcctgacgcctagaatntgttcgatagtttacttacgtgttacaactactccggtaaccgtaggtcggcccggttcccgggggaccttacggtttcccgggcccgttaggggaacccgttaaggggtcggaaacgacgttaacgaaaaccgtaacgttggtacggtctaacggcctaaacgtacttcgttcggtacctttcgttaacccg

SEQ ID NO: 419975 - DNA, 717 bp, Homo sapiens
  misc_feature: GZ8MTXP02F7URA.8.33.C11.1.454.CMB.2.raw
  modified_base (329)..(329): a, c, t, g, unknown or other
  modified_base (636)..(636): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgacaacgtggtggagtcgtgggggagcgtagtccagcctgggagtcacagagactctcctgtgcagtccctcgtgggttcaccttcagtagctacggctatgcacgtcgggtccaccaaactccaaggcaagggnttgggagtgggtgctagttgttcagtccgtaggaggtctaggttgttacaagttcggtatcggctagggaccgtcggtaagggaccggggacctattaccgactacgtcgtaccgaagacgacctaaaccgtacgaaacggaactaactaaacgttggttaacgtttacgggaaccttacggaaaacgtaccgtaccgttaaacggtcccgttaagggacggttaaccggacggggtttaacgttaaccgtaacgttaacggtaacggggtaaaccggggaaacgggggaacgggggtaaaacccgnggggtaaccggggtaacgttaacccgggtaaacgtttacccggttccgtttaacgggtaacccggttcgggtaaccggggg

SEQ ID NO: 419976 - DNA, 594 bp, Homo sapiens
  misc_feature: GZ8MTXP02IMUQQ.8.33.C11.1.454.CMB.2.raw
  modified_base (213)..(213): a, c, t, g, unknown or other
  modified_base (275)..(275): a, c, t, g, unknown or other
  modified_base (278)..(278): a, c, t, g, unknown or other
  modified_base (284)..(284): a, c, t, g, unknown or other
  modified_base (293)..(293): a, c, t, g, unknown or other
  modified_base (303)..(303): a, c, t, g, unknown or other
  modified_base (351)..(351): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccacctgttctttgtcctccgagggggaaanacgccaccctctcctgcaggccagtcagatgttgctcttgagctgacaacacaactgcagcnccngccctnatcatggtncactcaacgnggccagtgcactcccagtccaggttccaggtccggacaggtgggtaangggacagtccttcactcctaccaccatcatcacgccgtggacgcctagaaatcgttgttcgtacttagtttacttacgttgtacaaacgtcgttaccggtacgtaggtccggccggttaccgggggccttacgggttccggaccgtaggggaacccgtaaggggtcggaacgtacgtaaccgaaaacggtcgtacggtacgacgtaacgaccgtaacgtacttcgtcgtttacttacgtaccg

SEQ ID NO: 419977 - DNA, 549 bp, Homo sapiens
  misc_feature: GZ8MTXP02H8VWW.8.33.C11.1.454.CMB.2.raw
  modified_base (209)..(209): a, c, t, g, unknown or other
  modified_base (251)..(251): a, c, t, g, unknown or other
  modified_base (260)..(260): a, c, t, g, unknown or other
  modified_base (266)..(266): a, c, t, g, unknown or other
  modified_base (282)..(282): a, c, t, g, unknown or other
  modified_base (391)..(391): a, c, t, g, unknown or other
  modified_base (399)..(399): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtcctccaggggaaanacgccaccctctcctgcagggccaatcagatgtgcgcttganctagtacanacaacngcagctccagcccctnatctatggtcgcatccaacgagggcctaacgtcggcactccgagccgtaggttcaggtcgctaggtggagtgggacagcttcaatccgtacacatcatcagcctggacnccgagaangtagtgtacgtagtttatagtgttacaacgtagtacgtacgacggttcggcccggtcggggcctacggttccggccgtcgggaaccgtaggtacggagaacgtacgtaaacgaacgtgtgacgtcgcgaccgtatcgtactctttactcg

SEQ ID NO: 419978 - DNA, 611 bp, Homo sapiens
  misc_feature: GZ8MTXP02FMBWP.8.33.C11.1.454.CMB.2.raw
  modified_base (277)..(277): a, c, t, g, unknown or other
  modified_base (283)..(283): a, c, t, g, unknown or other
  modified_base (294)..(294): a, c, t, g, unknown or other
  modified_base (410)..(410): a, c, t, g, unknown or other
  modified_base (420)..(420): a, c, t, g, unknown or other
  modified_base (451)..(451): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgttctttgtcctccgaagggaaagacgcccaccctctcctgcacgggccagtcagaatgttggctcttgtaagctagacaacacaaccngcagcncccacgccctnatctagtggtgcactaccgaacgacggccacgtggaccactcccgacgccgtaggttcgagtcggcgaggtgggtagtggacagtcttcactcacacatacatcgagccgtggacncgtagaagtntgttcgtcttagtttacttactagactaacncgttaccggtacgagtcccgggtcccgttccggggaccttacggttccggaccggtacggggtaaccgtaaggggtcggaaggtaactaaccggaaaaccgtaggtcggtcggtacgtcggtacctaaccgtagttccgttcgtaccttacgttaccccg

SEQ ID NO: 419979 - DNA, 962 bp, Homo sapiens
  misc_feature: GZ8MTXP02FJO2Z.8.33.C11.1.454.CMB.2.raw
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagaatgttggcgtccttgtaagctggtaccaacacaaaccgtggaccaggcctaccccacggccccccttcacgttacctagtcgggttcgaccaacttaccccgaaagtaaccgggggaccccaaccggttcggggacccaaaccgttccccccgaaacggaccccgtaaggggttttaccccaagggttccggggtacccgtaaaggggtttcggggggttaaacgtttgggggggaaaccctaaggggttaccctttttacccgaaaccctttacccttacccgaaaccccttaactttacccaaactttacccgaaacgggtcccccgtttagggggaaccgtacccgttaagggtaaaaccggtaaggttttcgggtttaccgggttaactttaaacgttttttaaacgttttaaaccgtttacgggttaaaaccttaaaccgttaacgttaaccccgggttaaacccgggtaacgggttcccgggtaccccggggttccccggggggtacccgtttaaccccgggttttaccccgggggtcccccggtttacgggggtaaaacccccggttaaaagggggttaccggggaaacgggttaaaccggttaaacccggaaaaaacccgggttacggttacgggtaacggggtttcccgaacggggtacccaaaccccgttaagtttcccgtttaacggtttccccgtttaccgtttaaaccccg

SEQ ID NO: 419980 - DNA, 741 bp, Homo sapiens
  misc_feature: GZ8MTXP02JZA6Q.8.33.C11.1.454.CMB.2.raw
  modified_base (283)..(283): a, c, t, g, unknown or other
  modified_base (330)..(330): a, c, t, g, unknown or other
  modified_base (352)..(352): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctggggagtcacagagactctcctgtgcagccctcgtggttccaccttcagtanctacggcatgcacgtgggtccccaccaaactccaaggacaaggggtnttgggaggtgggtgctagtttnttcgatccgtggagggctaggtgttacaagttggtactggtcgtagaccggtccgtagggaacgggcccgtattaccaaccctagtccaccgagaacgaaccaacgtacccgaaaggaacccaaagtaaacttaggttacgtttacggggaacccttaagggtaaaccaaccggtaacccgttaaacggttcccgtagggaaccgggtaaaccgttaaccggggtaagtttaactaaaccggttacgtaaacgggtaaaaccggggtaaagggggtaaaccggggggaaaaccgaacggggtaccgggggtaacggttaaacccccggtaacggtttacccgttacccggtttaaccgggttaacccggttacggggttaacccggggg

SEQ ID NO: 419981 - DNA, 689 bp, Homo sapiens
  misc_feature: GZ8MTXP02FPOH7.8.33.C11.1.454.CMB.2.raw
  modified_base (253)..(253): a, c, t, g, unknown or other
  modified_base (275)..(275): a, c, t, g, unknown or other
  modified_base (327)..(327): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagccgtgggagtcacagagactctccngtgcagcctctggttcaccttnagtagctacggcatgccacgtcggtcccgaccaaactccgaggacgaagggngttggagtggggtggtctagtttgtttcagttccgtggagggctaggttgttacaagttgggtatcggctgaccgtcgtagggaacggccgattccaccactctaccagacaacgaacctaccgaaacggaactaacctaaattaggttaacgttacggtaacccgttaacggaaacctaaccgtacccgttaacgtacccggtaggacgggtaaccgtacggggttagtaaacgtttaacgtaaacgttacgggtaaaccgggaaagggggaacgggggaaacccgaggggtaaccgggtaacggttaacccgaaacggttaccgttacccgtttacggtaccggttcggttaaccggggg

SEQ ID NO: 419982 - DNA, 777 bp, Homo sapiens
  misc_feature: GZ8MTXP02HL6OW.8.33.C11.1.454.CMB.2.raw
  modified_base (161)..(161): a, c, t, g, unknown or other
  modified_base (177)..(177): a, c, t, g, unknown or other
  modified_base (272)..(272): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttccncgttgctcttttaagnggtgtccagtgtcaagtgcaactggtggagtcgtgggggagcgtagtccagcctgggagtcacagagactctcctgtgcagctctggtcaccttnagtgctacggcatgcacgtgggtcccaccaaactccgaggaccaagggatggagtgggtggcagtttggttcatcccgtggagggctaggttcgttacgaagttggggtatcggacgttcggaaccggtccggtaggggaaacggggtacccgtagtttacccgaacccgtacttacccgtacccgaaggaaaccggtacccaaacccgttacccgaaacggggtaaaccctaaaccgtaaacgtttacggtttaacgttttacgggaacccgtttaacggaaacccgtaaccggtacccgttaaaacggttcccgtaaacggggtacgggtaaacccggtacgggggttaacgtttaacgtaaaccgtttaacggtacggttaaaccggggaaaacgggggtaaccggggggaacccgtaacggggtaccgggggtaacgttaacccggtaaacggttacccgttaccggtttacggtacccggttaccgggttaacccggggg

SEQ ID NO: 419983 - DNA, 560 bp, Homo sapiens
  misc_feature: GZ8MTXP02ISB4B.8.33.C11.1.454.CMB.2.raw
  modified_base (292)..(292): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgaagctggaccaacacaaactgccagctcccaggcccctnatctatggtgcatccaaacagggcccaacgtggcatccccagccaggttcagtcggcagtgggtatgggacagacttcaactctcaccatcaatcagcctggagcctgaagatgtgctagtttacttaactgtcaaactatcgtaacccgagtcgggccctccgggggacctacgtttcggccccgtacgggaacccgtaaagggtacggaggtaactacgaaaacgtaaaccgtagttcggctaaggcaccatctacgtcttctaac

SEQ ID NO: 419984 - DNA, 651 bp, Homo sapiens
  misc_feature: GZ8MTXP02FK3FP.8.33.C11.1.454.CMB.2.raw
  modified_base (307)..(307): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagcccaccctctcctgcagggccagtcagatgtgcgccttgtaagctggtaccaacacaaacctggccaggcctcccaggccccctcatctatggtncatcccaacgacggccacgtggacactccccagcccaggttcaggtcggctaggtagggtagtggggacaggtaccttcactctaccaccatccatcgacgcccgtagggacgtcctagaagattggttacgcgttaagtttattactgtaacaacgtacgttaccggtaaccggtaggttcccgggtacccggtccccgggggtaccttaaccgggtttcccgggaccccggttacgggggaaacccgtaaaggggtcgggaaacgtaacgttaaaccgaaaacgtaccggtaggttccggacgtcggtcccgaactacttcgtaccgttccttacgtacccg

SEQ ID NO: 419985 - DNA, 678 bp, Homo sapiens
  misc_feature: GZ8MTXP02G418W.8.33.C11.1.454.CMB.2.raw
  modified_base (240)..(240): a, c, t, g, unknown or other
  modified_base (556)..(556): a, c, t, g, unknown or other
tcagctcgcgtgtccacgaccggtgctcgatttagagtgagctcgttggggtttgggctgaactgggttttcctcgttgctcttttaagaggtgtccagtgtcaagtgcaactggtggagtcgtggggggaggcgtagtccagcctgggaggtcacagagactctcctgtgcagcctcgtggttcaccttcagtagctacggcatgcacgtcgggtcccaccaaactccgaggcaagggnttgggaggtgggtgctagttgttcatcgtggaggcagttgtacaagtggtatgcgtaggaccgtccggtaggaacgggccattccgacctactcctaccaaggacaccaactccgaagaaacacaatgttaagttccggaacctagaactacgtacccttaaaggtccctagggaacggtacgtacggggttattaacgtacgtacgtagggtaaacgggaagggggaacgggggaaccagggacgggattaccgaagttctcgtttagaccgtcggtcggggacctacggggtaccctcggtaccaccggttccncccgtcacgtccctaaccaccggaaccgggccctacgttcccgggtccccttccccggtcggcccgccccttggcccctacgacgggaacctccgacccgtacgacgacgacaccggaccgg

SEQ ID NO: 419986 - DNA, 605 bp, Homo sapiens
  misc_feature: GZ8MTXP02F1FX3.8.33.C11.1.454.CMB.2.raw
  modified_base (177)..(177): a, c, t, g, unknown or other
  modified_base (265)..(265): a, c, t, g, unknown or other
  modified_base (329)..(329): a, c, t, g, unknown or other
  modified_base (526)..(526): a, c, t, g, unknown or other
  modified_base (597)..(597): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagnggtgtccagtgtcaagtgcaactgggtggagtcgtgggggagcgtagtccagccgtgggagtcacagagactctcctgtgcagccctntgggtccaccttcgagtacgctacggcatgccacgtcgggccaccaaactccgaggcaagggtnttggaggtgggtgactagtttgttcagtccgtggagggctaggttcgtacaagttgggtaactggtcctggaccgtcgtagggaacgggcgtacttccacatcctaccgagtacgaacaaccgtcaaaggaacagaattcgtaagttcggaacctaggaactacgtacctaagtccgtagaacggtacgtacgggtntaactacgtacgaggtaaacggaggggacggggaacctgggacggtaattacgagtacttctacgtaccgnggtacggg

SEQ ID NO: 419987 - DNA, 631 bp, Homo sapiens
  misc_feature: GZ8MTXP02J25IE.8.33.C11.1.454.CMB.2.raw
  modified_base (208)..(208): a, c, t, g, unknown or other
  modified_base (280)..(280): a, c, t, g, unknown or other
  modified_base (293)..(293): a, c, t, g, unknown or other
  modified_base (304)..(304): a, c, t, g, unknown or other
  modified_base (308)..(308): a, c, t, g, unknown or other
  modified_base (401)..(401): a, c, t, g, unknown or other
tcagctcgcgtgtccacgaccggtgctcgatttagagtgagctcgttggggtttgggggaggaactgctcagttaggacccagagggaaccatggaagccccagctcagcttctcttcctcctgctactctggctcccagtttcagataccaccggagagattgtgttgacacagtctccagccaccctgtctttgctccaggggaancgccaccctctcctgcagggccagtcagaatgtggctcttgtaagctaggtaccacacaacctgccaggccncccaggccccctnatctatggtcnctancccaagacggccacgtcggcactccccagccctaaggttcaggtccggcaggtacggggtatggggactaggccttcaacttccaccaacctntaccatcgaccgtccgaggacgtcgagtaagtcttagtacgtaacgtttagttacgttactacgtaactaacgtacgtaccggacgggtacggtaccggtcccgggtacccgggtccgttaccgggttccgggaccggtacggggaacgtaacgggacggaacgtaaccgaacgtaaacgtacgtacggtcgactaaccggacctactcgttcgtaccgttcctactccg

SEQ ID NO: 419988 - DNA, 647 bp, Homo sapiens
  misc_feature: GZ8MTXP02I581H.8.33.C11.1.454.CMB.2.raw
  modified_base (248)..(248): a, c, t, g, unknown or other
  modified_base (254)..(254): a, c, t, g, unknown or other
  modified_base (268)..(268): a, c, t, g, unknown or other
  modified_base (294)..(294): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctactgctactctggctcccagtttcagataccaccggagagattgtgttgacacagtctccagcccaccctgtctttgtctccgaaggggaaagacgcccaccctctcctgcagggccagtcagatgtgcncttganctgtacacacaacngcagctccagcccctcatctatggtncatccaaagtacggggccagtggccactccccagccaggttcaggtcggcagggtgggtatggggacagtacttcactctcactatcatcagtccctggacgtcctagaacgtagtgttagacttagtttacttacgtgttaccaaactgttacccggtacgtaggtaccgggtcccggttacccgggggtcccttaaccggtttccgggaccccgggttacgggggaaacccgtaagggggtacgggtaaacgtaacgttaaaccggaaaaccggtacgttacgggtacgggtaccgtaacggtaccctaaaccgtacgtttccgttaccggtttaccttacctttaacccg

SEQ ID NO: 419989 - DNA, 627 bp, Homo sapiens
  misc_feature: GZ8MTXP02GQOJK.8.33.C11.1.454.CMB.2.raw
  modified_base (210)..(210): a, c, t, g, unknown or other
  modified_base (250)..(250): a, c, t, g, unknown or other
  modified_base (264)..(264): a, c, t, g, unknown or other
  modified_base (270)..(270): a, c, t, g, unknown or other
  modified_base (286)..(286): a, c, t, g, unknown or other
  modified_base (296)..(296): a, c, t, g, unknown or other
  modified_base (413)..(413): a, c, t, g, unknown or other
  modified_base (606)..(606): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagcccaccctgtctttgtctccgaggggaaanacgccaccctctcctgcgagggccagtcagaatgttggcncttgagctgacaanacaacngcagctccagcccctnatctatggtncataccaaagtacggccacgtggcactcccagcctaggtcagtcggcaggtggatgggacagtccttcacctctcacctatacctatccaagtcccgtaggacgcctaaggaaagtnttggttagacttaaggtttacttactcgtaacaaacgtcgttaccgtaaccgggtaggtcccggtcccggtcccgggggtaccttaccggtttcccgggacccggttaggggacccgtaaaggggtcggaacgaacgttaaaccgaaaacggtacgttcgggaccgacgtaacgtacccgacttacgttaccncggtttacccttctaaccccg

SEQ ID NO: 419990 - DNA, 649 bp, Homo sapiens
  misc_feature: GZ8MTXP02FNZ7F.8.33.C11.1.454.CMB.2.raw
  modified_base (330)..(330): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagccgtgggagtcacagagactctcctgtgcagccctcgtgggttcaccttcagtagctacggcatgcacgtcgggtcccaccaaacctccgaggcaaggggtnttgggaggtggggtggactagtttgttcatccgtaggacggctagttgtacgaagttggtactggctgaccgtcgtagggacgggtccgtattacccgactactcctaccgagacgaaccaaacctaccgaaacgaaacaactaaagttagttacgtttacggaaccttacggaaactaccgtaaccgtaaacgtcccgtaggacggtacgtacgggtagtaacgttacgtacgtaggtaaacgggaaggggaacgggggaacgaggacgggtaacgttaccgaacgttaccgttacgttacggacggtcgtaccgggg

SEQ ID NO: 419991 - DNA, 578 bp, Homo sapiens
  misc_feature: GZ8MTXP02JTEE3.8.33.C11.1.454.CMB.2.raw
  modified_base (257)..(257): a, c, t, g, unknown or other
  modified_base (259)..(259): a, c, t, g, unknown or other
  modified_base (325)..(325): a, c, t, g, unknown or other
  modified_base (367)..(367): a, c, t, g, unknown or other
tcagctcgcgtgtccacgaccggtgctcgatttagagtgagctcgttgggtttggggctggggagaggagcccagcactagaagtcggcggtgtttccattcggtgatcagcactgaacacaggaggactcaccatggagtttgggctgaacttgggttttcctcgttgcttcttttaagaggtgtccagtgtcaagtgcaactggtggagtcgtgggggagcgtagtccaggcctgggagtcacagagctctctgncngcctgtggttccacttcagtcgctacggcagtcgcacgtgggacccaccaaactcgagacgaaggngttggagtgggtgctagttgttacatcgtgaggctagtgtanagtgtatgcgtagacgtcgtaggacggctacgtcacactcacagacgaacactcgaacgaacactagtagtacttaggactacgaacacgtaccgtaacgtcgtaggacggacgtacggtatacgtactagtacgggtaaacggaaggggtacggggaactaacgggcggtaacgtaccgagttaccgtcgtttacggacgtcgtacgggg

SEQ ID NO: 419992 - DNA, 542 bp, Homo sapiens
  misc_feature: GZ8MTXP02F9S72.8.33.C11.1.454.CMB.2.raw
  modified_base (260)..(260): a, c, t, g, unknown or other
  modified_base (299)..(299): a, c, t, g, unknown or other
  modified_base (405)..(405): a, c, t, g, unknown or other
  modified_base (442)..(442): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtagtccagcctgggagtcacagagctctcctgtgcagcctntgggttcaccttcagtagctacggcatgcactgggtccnccaaaactccgaggcaaggggattgggagtggggtggctagttgtttcatccctggagggcagtgttcaatggtatgctgacgtcgtagacgggcgattcacatcnccagagacaactccagacacaatgtattgactgaacngccctaagtcctagaggacacggggtagtatactacgtgtacggaaagggacgggggaaccagcgggaagttccaagtactccgttagacgtcgtcgggg

SEQ ID NO: 419993 - DNA, 726 bp, Homo sapiens
  misc_feature: GZ8MTXP02IOI4E.8.33.C11.1.454.CMB.2.raw
  modified_base (255)..(255): a, c, t, g, unknown or other
  modified_base (275)..(275): a, c, t, g, unknown or other
  modified_base (302)..(302): a, c, t, g, unknown or other
  modified_base (325)..(325): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagtcgtgggggagcgtagtccagccgtgggagtcacagagactctctgngcagcctctggttcaccttnagtgctacggcatgcacgtgggtcccnccaaactccgaggacgaagggtntgggaggtgggtggctagtttgttcagtccgtggaggtctaggttgttacaagttgggtatgcgtacgaccggtcggtaggaaacgggtccgtagtccacctactcctaccgaagtacgaacctaaccgtaaccgaacgaaaccaaactaaacgttagttaacgtttacggaaccgttacgaaaccgtacgtaccctaaacggttcccgtaagggaacggtaaccggtaacggggtacgtttaaacgttaacccgttaaacggtacggggttaaaaccggggaaaacgggggtaccggggggtaaaaccgtacggggtaaccggggtaaccggtttaacccggtaaacggtttacccgttaccggtttaccggtaaccgggtacccgggttaacccggggg

SEQ ID NO: 419994 - DNA, 675 bp, Homo sapiens
  misc_feature: GZ8MTXP02G8V1F.8.33.C11.1.454.CMB.2.raw
  modified_base (390)..(390): a, c, t, g, unknown or other
  modified_base (560)..(560): a, c, t, g, unknown or other
  modified_base (610)..(610): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtagtccagccgtgggagtcacagagactctcctgtgcagtccctgtgggttccaccttcagtagctacggcatgccacgtcgggtcccaccaaactccgaggaccgaagggtattgggaggtggggtggctagtttcgttacattcccgtaggacgggtctaggttnttacaagtgggtatggccgttggaccgcgtagggacggggtacctattaccgacctatccgtaccgaagtacgaacctaacgtaccgaaacgtaacaaacctaagttagttacgtttacggaccttaagaacctacgtacctaacgtctacgggagtaccgtaacggttntaactacgttacgtacggtaaacgggaaacgggggtacggggaaacccgnggggtaaccggtaacgttaccgtaacgttaccgtcgtttacggaaccggtttcggtaaccggggg

SEQ ID NO: 419995 - DNA, 669 bp, Homo sapiens
  misc_feature: GZ8MTXP02F75HU.8.33.C11.1.454.CMB.2.raw
  modified_base (212)..(212): a, c, t, g, unknown or other
  modified_base (246)..(246): a, c, t, g, unknown or other
  modified_base (258)..(258): a, c, t, g, unknown or other
  modified_base (264)..(264): a, c, t, g, unknown or other
  modified_base (270)..(270): a, c, t, g, unknown or other
  modified_base (279)..(279): a, c, t, g, unknown or other
  modified_base (291)..(291): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccaccctgttctttgtcctccgagggaaancgccaccctctctgcagggccagtcagatgtgcnctgagctgacanacaacngcagcnccagccctnatctatggtacncactccaaacgcgggacccacgtcggctacgtccccaagccccgaaggttccaggtccggactagggtgggtaagtggggaaccaggtaccttcaacctctacccactataccattccgaagcccgtggactccgtaagaaagtgtgtttagcttaaagtttatttactgttaaccaactagttaccggtaaaccggtaggtcccggtcccggtacccgggggtacccttaaccgggtttccccgggaccccggtagggggtaaccccgtaagggggttacgggaacttaaacggtaaacgaaaacggtaaccgttaggggccggtaactaacggacctaaacccgttacttcccgtttacgtacctttaccgtaccg

SEQ ID NO: 419996 - DNA, 791 bp, Homo sapiens
  misc_feature: GZ8MTXP02J2EFH.8.33.C11.1.454.CMB.2.raw
  modified_base (208)..(208): a, c, t, g, unknown or other
  modified_base (301)..(301): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccagggaaanacgccaccctctcctgcagggccagtcagaatgttggcgtcttcgtaagctggtaccaacacaaacctggaccaggcctcccacggccccctnactctatggtgccactacccaacgacggggcccaacgttcggaccactccccgacgacccgtaggttccaggttccgggaccgtaagggtgggggtaacgttcggggaacctacgggtaccttccgtaaacttccctaccaacctactacctacgtcccgaaaccggtcccggttagggaccggtcccgtaaggaacgtaacgtttggttacgtaccgtttagttttaacgttaccgtttaggtaaccctaaacgtaccgttaccggtaaccccggggtacggttcccgggtaccccgggggttacccccggggggtaccccctttaccggggttttccccgggggacccccggtttaacccgggggaaaaccgtaaccgggggtttacgggaaccggtaaaccgttaaaccggaaaaccggttaacgtcggggttaccggacgttccggaccctaaccgacgtttcccgtcggttacccttcttacccg

SEQ ID NO: 419997 - DNA, 679 bp, Homo sapiens
  misc_feature: GZ8MTXP02FMJ5J.8.33.C11.1.454.CMB.2.raw
  modified_base (264)..(264): a, c, t, g, unknown or other
  modified_base (277)..(277): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactgggtggagtcgtgggggagcgtagtccagcctgggaggtcacagagactctcctgtgcagcctntgggttcaccttnagtagctacggcatgcacgtcgggtacccaccaaaacctccgaaggaccgaaaggggtgttgggaggtggggtggctagtttgtttacatccgtaggaggactagttgttacaagttgggtatggactggaccgtaccggtaggaacgggccgtacttaccaccactctaccgagaacgaacaactacgaaacggaaacaacgaattagttaacgtttacggaacctagaaaccgacgtaccgtaacgtaccgtaggaacggacgtacgggtaagtaactaacgtaacgtacggtaaacgggaaacgggggaacgggggaaacccgagggaccggggtaacgttaaccggtaaacggtttaccgttaccggtttacggtaaccgggttaccggtaccggggg

SEQ ID NO: 419998 - DNA, 615 bp, Homo sapiens
  misc_feature: GZ8MTXP02HWCRZ.8.33.C11.1.454.CMB.2.raw
  modified_base (330)..(330): a, c, t, g, unknown or other
  modified_base (456)..(456): a, c, t, g, unknown or other
  modified_base (477)..(477): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctcctgtgcagcctctgggttccaccttcagtagctacggcatcggcacgtcgggtcccgaccaaactccgaggacaaggggnttgggaggtggggtgctagtttcgttcagtccgtggacgggtcaggttgttacaagttgggtactgacgtgacgtccggtagacgggcgtatccgacactctacagacgaacactaccgagacaanatagtagtttcgactagaacncgacgtaagtccgtaggacgacgacggttagtacgttactaggtacggtaacgggaaacggggacgggggaaaccgaggacggggtaacgttacccgaacggttaccgttcggtttacggacggttcgggtaccgggg

SEQ ID NO: 419999 - DNA, 631 bp, Homo sapiens
  misc_feature: GZ8MTXP02I2HO2.8.33.C11.1.454.CMB.2.raw
  modified_base (281)..(281): a, c, t, g, unknown or other
  modified_base (290)..(290): a, c, t, g, unknown or other
  modified_base (300)..(300): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccaccctgttctttgtcctccgaggggaaagacgcccaccctctcctgcagggccagtcagatgttggcgccttgaagctgtacaacacaactgcagcnccagccctnatctatggtncatccgaacgcggccacgtcggaccactcccgagccgtaggttcgagtcggctaggtgggtagtgggacaggtacttcactctaccaccatcatacagtcccgtaggacgtcctagaagtattgttgacttagtttattacgtagttaccaacgttagtccggtaacgaggttcccgggaccggtacccgggggtccttaccggtttccgggacccgttaggggaacccgtaaaggggtcgggaaagtaccgttaaaccgaaaacggtacgttacgggtcggtaacgtccggaccgtaccgtacttccggttcgtttcctttaactacccg

SEQ ID NO: 420000 - DNA, 639 bp, Homo sapiens
  misc_feature: GZ8MTXP02IHAQH.8.33.C11.1.454.CMB.2.raw
  modified_base (202)..(202): a, c, t, g, unknown or other
  modified_base (212)..(212): a, c, t, g, unknown or other
  modified_base (253)..(253): a, c, t, g, unknown or other
  modified_base (269)..(269): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctccagtttcagataccacggagagattgtgttgacacagtctcagccacctgtctttgctcgagggaancgccacctcnctgcaggccagtcagatgtgctcttgagctgacacacaacngcagctccgacgcctnatctagtggtcacactaccaagtcggccacgtcggacctactcccgagtacccgtaggttcaggtcggacgtaggggtgggtagaggggaccagtaccttcaactccgtacacctatcactcacgccgtaggactcgtaagaagtacgttgttacgtacttaagttttacttaacgtacgtaactaaacgttacgttacccgggtacggtacggttccgggcccggttaccgggggtcccttacgggtttcccgggacccgttacggggaaacccgtaagggtacggaaacgtacgttaaaccggaaaacgttcggtacggtacgacgttaacgacctaacgtacgttcgttacggttcttacgtacccg

SEQ ID NO: 420001 - DNA, 634 bp, Homo sapiens
  misc_feature: GZ8MTXP02HNJFB.8.33.C11.1.454.CMB.2.raw
  modified_base (271)..(271): a, c, t, g, unknown or other
  modified_base (275)..(275): a, c, t, g, unknown or other
  modified_base (289)..(289): a, c, t, g, unknown or other
  modified_base (299)..(299): a, c, t, g, unknown or other
  modified_base (410)..(410): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagcccaccctgttctttgtcctccgaaggggaaagacgccaccctctcctgcagggccagtcagatgtgcgtcttgagctgtacaacacaacngccngcctccacgccctnatctatggtncatcaagtcggccagtgcactccgagccgtaggttcaggtcgacgtagggtaggtagtggacagtacttcactctccaaccatcatccagccgtaggacgcgtagaacgtnttgttacgtagttagtttattacgttacgtaactaacgtacgtaccggtacgtacggttccggcccgggttacccgggggtaccttaaccgggtttcccgggacccggtacggggaacccgtaaggggtacggtaacgtaacgtaaacggtaaaaccgtacgtacgggttcggtacgtaacgaaccgtaaccgttacgttacgttccgtacctttacgtacccg

SEQ ID NO: 420002 - DNA, 599 bp, Homo sapiens
  misc_feature: GZ8MTXP02F5IQK.8.33.C11.1.454.CMB.2.raw
  modified_base (270)..(270): a, c, t, g, unknown or other
  modified_base (276)..(276): a, c, t, g, unknown or other
  modified_base (285)..(285): a, c, t, g, unknown or other
  modified_base (294)..(294): a, c, t, g, unknown or other
  modified_base (303)..(303): a, c, t, g, unknown or other
  modified_base (379)..(379): a, c, t, g, unknown or other
  modified_base (390)..(390): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgttctttgtctccgaggggaaagacgccaccctctcctgcagggccagtcagatgttggcgcttgagctgtacaacacaacngcagcnccagccctnatctatgtncatccaagnggcactgcactccagccagtcagtcgcaggtggagtgggacagtcttcactctaccacatcatcacgccgtagacnccgtagaagtnttggttgacgttagtttatttacgtcgtactaaactcgtacccggtaaccggaggtcccgggacccggttacccgggggtccccttaaccggtttcccggggacccccgttagggggaaacccgtaaggggttcggaaacgtactaaaccggtaaaacgtacgtcgtcggacgtaacgccgactacgttcgtcgttacctacttacccg

SEQ ID NO: 420003 - DNA, 749 bp, Homo sapiens
  misc_feature: GZ8MTXP02HDQHR.8.33.C11.1.454.CMB.2.raw
  modified_base (329)..(329): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtagtccagcctgggagtcacagagactctcctgtgcagccctcgtggttccaccttcagtagctacggcatgcacgtgggtcccaccaaactccgaggcgaagggtnttggagtgggtgctagtttgttcagtccgtggagggctaggttcgttacgaagttggggtaatggtaccttagggaacccgtcccgggttaaggggaaaccggggtcccgtaatttacccgaaccctacgttaccctaccccgaaagaaccggaaaccctaaacccgttaaccccggaaaaggaaaccctaaaccgtaaaacgtttagggttaaacgttttaccgggaacccctaagggtaaaacccacggtaacccgttaaacgttcccgaagggtaaccggacggtaacggggttataaacgtacgttaaccgtagggtaaacccggggaaagggggaccgggggaaaccgtacggtacggggtaacgttaccgaaaacgttccgttacggtttacggacggttccggtaaccggggg

SEQ ID NO: 420004 - DNA, 777 bp, Homo sapiens
  misc_feature: GZ8MTXP02IKNLD.8.33.C11.1.454.CMB.2.raw
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaacgtgggtggagtcggtgggggagcgtagtccagccgtgggagtcacgagagactctcctgtgcacgtcctgtgggttccaccttcagtagcgtacggcatgcacgtcgggtccactaaacctcgaggacgaagggtattgggaggtggggtgcgttagtttgtttcagttcgtaggagggtctaaggttcgttacgtaaagttcggggttatcgtcgtacgaccggtcgggtagggaaacgggggtaccctagtaccctaccgtacttccgtaacccgaaggaaccggtaaacctaacccgtaacccgaaacgggtaaacctaaaacgttaaacggtttacgtttaaacggttttaccgggaacccgttacggaaaaccgtaacccggtaccgttaaaaccggttcccgttaaaggggacggtaaccgggtaccggggttagttaactaaccggtaaggtacgggtaaaacggggaaaacggggggacgggggtaaaacccgtcgggacgggggttaaacgtacccgtaaacggttaccgttaccggtttacggtacgtttaccggggtaaccggggg

SEQ ID NO: 420005 - DNA, 685 bp, Homo sapiens
  misc_feature: GZ8MTXP02HE4IN.8.33.C11.1.454.CMB.2.raw
  modified_base (310)..(310): a, c, t, g, unknown or other
  modified_base (371)..(371): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccaccctgtctttgtctccgaggggaaacaaccaccctctcctgcagggccagtcagaatgttggcgtccttgtaagctggtaccaacacaaacctggccaggcctcccacgcccctcatctatggtncatccaacgcgggccacgtcggcactcccagccgtaaggttcaggtggccgaggtgggtangggacagtacgttcactctacacctatcaactcgacgtcctagggtacgccgtagaaacgtacttggttacgtacttaagtttacttacgttagtaacctaaacgtacgtttaccgggtaaaccgagggttccgggaccccggttcccgggggaccctttacccggtttaccggggaccccggttacgggggtaaccgtaacggggttacgggaaacgtaaccggtaaaccaaaacgggtaccgttagggtcggtaccttacggaaccgtaaccctacggtttcctcggtttaccttaccgtacgtttcccccg

SEQ ID NO: 420006 - DNA, 518 bp, Homo sapiens
  misc_feature: GZ8MTXP02GNUKM.8.33.C11.1.454.CMB.2.raw
  modified_base (209)..(209): a, c, t, g, unknown or other
  modified_base (244)..(244): a, c, t, g, unknown or other
  modified_base (250)..(250): a, c, t, g, unknown or other
  modified_base (257)..(257): a, c, t, g, unknown or other
  modified_base (263)..(263): a, c, t, g, unknown or other
  modified_base (278)..(278): a, c, t, g, unknown or other
  modified_base (288)..(288): a, c, t, g, unknown or other
  modified_base (297)..(297): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaanagccaccctctcctgcagggccagtcagatgtgcncttganctgacanacaacngcagctccagccctnatctatggtncatccaacnggccactggcatcccagccaggttcagtcggcaggtggtatgggacagcttcactctcaccatcatcacgctggagcctagaacgtatgttagctagtttattactgtacaactatcgtacgacgtcggccgtaccgggggcctacgttccggccgtcgggaccaagggtcgagacgtacaaacgaacgtgtacgctggacacgactcgtctacgtactac

SEQ ID NO: 420007 - DNA, 662 bp, Homo sapiens
  misc_feature: GZ8MTXP02FKPOD.8.33.C11.1.454.CMB.2.raw
  modified_base (263)..(263): a, c, t, g, unknown or other
  modified_base (274)..(274): a, c, t, g, unknown or other
  modified_base (322)..(322): a, c, t, g, unknown or other
  modified_base (333)..(333): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagccgtgggagtcacagagactctcctgtgcagcctntggtcaccttnagtgctacggcatgcacgtcgggtccaccaaactccgaggcgaaggtnttggagtgggngctagttgttacagtccgtggaggctagtgttacaagttggtatcggtctacggacgtccggtaggaacgggtcccgtactttaccacctacgtcctaccgagaaccgaactaaaccgtccgaaacggaacaaaccgaaagttagttaactttacgggacctaacgaaaccacgtaccgtaagtccgtaggaacggacgtacggggttataaacgttacgtacgttacggtaaacgggaaacggggaacgggggaacccgagggtaccgggtaacggttacccgtaaacggttacccgttacgtttacggtacggtcggtacccggggg

SEQ ID NO: 420008 - DNA, 788 bp, Homo sapiens
  misc_feature: GZ8MTXP02H3AL1.8.33.C11.1.454.CMB.2.raw
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaactggtggagtcgtgggggagcgtagtccagccgtgggagtcacagagactctcctgtcgcacgcctcgtcgggttcaccttcagtacgctacggcatcgcacgtcgggtcccaccaaactccgaaggacgaaggggtagttggggaggttggggtggcgtaggtttcgttcagttccgtaggacgggtctaggttgttactaagtgggtatgccgtgaccgtccggtaggaaccgggccgtacttccgacctactacccgtacgaacgacgaaccaaacccgtaccgaaacggaacctaaacgtaaagtttacgttaacgttttacggaacccgttaaggaaacctaaccggtaccgttaaacggttcccggtaaggaaccggggtaaccggtaacgggggttacgttaaacgttaaaccggtttaaacgggttaacgggtaaaaccgggggtaaaacgggggtaaccggggggaaaacccgtaacgggggtaacccgggggttaaaccggttaacccggtaaaaccggtttacccgtttacccgggtttaacgggtaacccggggtttccggggttaaccccgggggg

SEQ ID NO: 420009 - DNA, 627 bp, Homo sapiens
  misc_feature: GZ8MTXP02JDZKG.8.33.C11.1.454.CMB.2.raw
  modified_base (302)..(302): a, c, t, g, unknown or other
  modified_base (338)..(338): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtagtccagcctgggagtcacagagactctcctgtgcagcctcgtggttcaccttcagtagctacggcatgcacgtgggtcccncctaaactccgaggcaaggggattgggagttggggngctagtttgttcattccgtggaggcagttgtacaagtgggtatgctgacgccgtggaacggccgattcaccatcctaccagacgaacaactcgaagaacacaattgtatttggaccctagaaccagtacccgtaaagtcccgtaggaacggacgtacggggttataacgttacctaacggttacgggtaaacggaaacgggggtaacgggggaaaacccgtaggggaccggggtaacgttacccgtaaaggttacccgttaccgtttcggaccggttcggtaccggggg

SEQ ID NO: 420010 - DNA, 686 bp, Homo sapiens
  misc_feature: GZ8MTXP02FISL5.8.33.C11.1.454.CMB.2.raw
  modified_base (273)..(273): a, c, t, g, unknown or other
  modified_base (304)..(304): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtcctccgaggggaaagacgccaccctctcctgcagggccagtcagatgttggcgtcttcgagctggtacaacacaacnggccagcctcccgacggccctcatcagtgtncactccaacgacggccacgtcggcaactcccgaagcctaggttcaggtcggactagggtcggggtagtcggggaactacgtacttcccaacgttcctaccaacctatacactccagtcccgtggaacgcccttaaggacggtacttggttacgacgtttaagtttacttaacgtcgttaacaaacgttacgtaccggttaaccggtaggttccgggtcccgggttcccggggggtaccccttaccgggtttccccgggacccgggttaccggggtaaacccggtaaagggggttaggaacggttaaacgaaccgtaaaacggtccgtaaggggtccgtcggaacgaccctaaacgacttccggtactacctttccgtaaccc

SEQ ID NO: 420011 - DNA, 720 bp, Homo sapiens
  misc_feature: GZ8MTXP02FZIIO.8.33.C11.1.454.CMB.2.raw
  modified_base (276)..(276): a, c, t, g, unknown or other
  modified_base (326)..(326): a, c, t, g, unknown or other
  modified_base (338)..(338): a, c, t, g, unknown or other
tcagctcgcgtgtccacgaccggtgctcgatttagagtgagctcgttgggtttggggctgagagaggagcccagcactagaagtcggcggtgtttccattcggtgatcggcactgaacacagaggactcaccatggagtttgggctgaactgggttttcctcgttgctcttttaagaggtgtccagtgtcaagtgcaactggtggagtcgtgggggaggcgtagtccagccgtgggagtcacagagactctcctgtgcagcctcgtggtcaccttnagtagctacggcatgcacgtcgggtcccaccaaactccgaggcaagggtntgggaggtgggnggtctaggttgttcagtccgtaggacgggtctaggttgttacgaagttcgggtatcggtcgttacgaccgtcggtagggaacgggacccgtacgttacccactactaccgtaccgaagacggtaaccaaaccgtaccgaaacggaaacctaaactaaagttacgttaacgtttacggaacctaacggaaaccgaaccgtaccgttaaacgtccgttaacggaacgggtaacgtacggggttaattaacgtaacgttaacggtacgggtaaacggggaaacgggggtaaccgggggaaaccggaggggtaccggggtaacggttacccgtaaaacggtttacccgttaccggtttacggtaccggttcgggttaacccggggg

SEQ ID NO: 420012 - DNA, 643 bp, Homo sapiens
  misc_feature: GZ8MTXP02FKUQL.8.33.C11.1.454.CMB.2.raw
  modified_base (268)..(268): a, c, t, g, unknown or other
  modified_base (277)..(277): a, c, t, g, unknown or other
  modified_base (283)..(283): a, c, t, g, unknown or other
  modified_base (292)..(293): a, c, t, g, unknown or other
  modified_base (295)..(295): a, c, t, g, unknown or other
  modified_base (308)..(308): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagcgccaccctctcctgcagggccagtcagatgttggcgtcttgaagctagacacacaacngcagctccngccctnatctatgtnnancatggcatgcacnccgagccagtcagtcggctagtggtatgggacagtctcactctacactatcatcacgcccgtaggactaccgtagaagtattgtagtacgttaagtttacttacgttgtaaccaaacgtacgttacccggtaaccggtaggttcccgggtcccggttcccgggggtaccctttaacccgggtttccccggggacccggtttaacgggggaaccccgggttaaaggggtacgggtaaacgtaacgttaaacccggaaaaaccggtacgttacgggacggtacgttaaccggaccctaaccgtacgttccgtttacggttaccttaccgttaacccg

SEQ ID NO: 420013 - DNA, 553 bp, Homo sapiens
  misc_feature: GZ8MTXP02I7NAG.8.33.C11.1.454.CMB.2.raw
  modified_base (304)..(304): a, c, t, g, unknown or other
  modified_base (374)..(374): a, c, t, g, unknown or other
  modified_base (391)..(391): a, c, t, g, unknown or other
  modified_base (397)..(397): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtagtccagccgtgggaggtcacagagactctcctgtgcagcctctgggttcaccttcagtagctacggcatgcacgtggtccncaaactccgaggcaagggattggagtgggtgctagttgttcatccgtggaggtcagttgtacagtggtangctgcgcgtgagggcgntcacanctcagagacacacagacacatagtattcgactacgacgacgtctaacgtcgtagacggacgacgggtagtactacgtagtacgtaacggaaacggacgggggaaccgaggacgggtaagtacgtaacgtacgtccgttacggacgtacgtacgggg

SEQ ID NO: 420014 - DNA, 707 bp, Homo sapiens
  misc_feature: GZ8MTXP02JPVBS.8.33.C11.1.454.CMB.2.raw
  modified_base (256)..(256): a, c, t, g, unknown or other
  modified_base (325)..(325): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagtcgtgggggagcgtagtccagccgtgggagtcacagagactctcctgngcagcctctgggtcaccttcagtgctacggcatgcacgtgggtcccaccaaactccgaggacgaagggnttagggaggtgggtgctagttgttcatccgtaggacggtctagtcgttacaagtgggtatgcgtagaccggtacgtaggaaacgggtcctacgttcaccctactctacccgagacgaaccaaacgtacgaaacggaaacaacgtaattagttaacggtttcgaaccgtagaaaccgtacgtaccgttaacggtacctagggaaccggtaaacggtaccggggttattaaaacgtaacccggttaaagttacggggtaaaaccgggaaaggggggaaccgggggtaaaaccgaacggggtaacgggggtaaccgtttaaacccggtaaaacggtttacccgtttaccggtttacgggaaccggtttcccgggttaaccggggg

SEQ ID NO: 420015 - DNA, 591 bp, Homo sapiens
  misc_feature: GZ8MTXP02IXL5P.8.33.C11.1.454.CMB.2.raw
  modified_base (301)..(301): a, c, t, g, unknown or other
  modified_base (318)..(318): a, c, t, g, unknown or other
  modified_base (329)..(329): a, c, t, g, unknown or other
  modified_base (355)..(355): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactggggttttcctcgtttgctcttttaagaggtgtccagtgtcaagtgcaactggtggagtcgtgggggagcgtagtccagcctgggagtcacagagactctctgtgcagcctctggttcaccttcagtagctacggcatgcacgtgggccncaaactccaggcaaggnttggagtgggngctagttgttcatccgtgaggcagtntacagtggtactgcgtgaccgtcggtaggaacgggccgagttcaccgtatcgtaccagacgacaactacagaacacaatacttagttgactagaaacacgactagtccgtagaggtaccgagggtatactaacgttacgcggtaaacggaaacgggggacgggggaaacccgaggggacgggaacggttacccgaaacggttcctaccggtttcgaaccgggttcggtaccggggg

SEQ ID NO: 420016 - DNA, 636 bp, Homo sapiens
  misc_feature: GZ8MTXP02FJMPT.8.33.C11.1.454.CMB.2.raw
  modified_base (251)..(251): a, c, t, g, unknown or other
  modified_base (302)..(302): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtcctccgaggggaaagacgccaccctctccctgcagggccagtcagaatgttggcnccttcgtaagctaggtaccaacacaaacctggccaggctcccaggcccctnatctatggtgcatccaagtacgggccacgtggcactcccagccaggttcagtcggctaggtgggtatggggacagtaccttcacttctaccacctatccatcagcctaggacgacctagaaacgagttgttacgtcttagtttacttactgtactaaactagtacggtaaccgtagtaccgggcccggttacccgggggacccttaccggtttcccggacccgttaggggaacccgtaaagggttcgggaagtaaaccgtaacgaaaacggtaaccgtggtacggtacctcggaccgtaaacctacgttacccgttcgttaccttacttaaccg

SEQ ID NO: 420017 - DNA, 707 bp, Homo sapiens
  misc_feature: GZ8MTXP02FPR8F.8.33.C11.1.454.CMB.2.raw
  modified_base (305)..(305): a, c, t, g, unknown or other
  modified_base (317)..(317): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagcgccaccctctcctgcgagggccagtcagattgttggcgtcttcgtaagctacggtaaccaacacaaacctggccagcctcccgacggccccctanactctagtggtnacataccgaaagtacgggccacgtggaccaactccccgaggaccctaggttaccaggtcggacgtagggtaggggtagtacgggaactacgtccgttccaaccttctacccaccattacgactacacgtcccggtaggacgtccgtaagtaaacgtgttagttcgaacgttttagtttaactttactacggttaaccaaactacggttacccgtaaccgggtaggtcccgggtacccgggtcccgggggtacctttacccgggtttccggacccggttacgggggaaaccgttaaggggcggtaaacgtacgtaaaccgaaaacggtacgtcgggtacggtacgtccgtaacccaaccgtacgttaccgttcgttaccttcgttaacccg

SEQ ID NO: 420018 - DNA, 656 bp, Homo sapiens
  misc_feature: GZ8MTXP02FF9QG.8.33.C11.1.454.CMB.2.raw
  modified_base (273)..(273): a, c, t, g, unknown or other
  modified_base (321)..(321): a, c, t, g, unknown or other
  modified_base (334)..(334): a, c, t, g, unknown or other
  modified_base (337)..(337): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactgggtgagtcgtgggggagcgtagtccagccgtgggagtcacagagactctctgtgcagcctgtggtcaccttnagtgcgtacggcatgcacgtcgggtccacaaactccgaggacaagggnttgggagtggggngtntagttgttcgatccgtggacgggctaggtgttacaagtggtatggactcgacgtccgtaggaacgggccgtacttccacgtactctaccgagaacgaaccgaacgtaccgaaacgaactaaaactaagttacgttaacgtttacgggaaccttaggaaacaacgtacccgttaaacggtccgtacggaacgggacgtaacggggtaacttaacgtaacgtaaacgtacggtaaacgggaaacgggggacgggggaaaccgagggacggtaacgtaccgtaaacggttacttaccgtttaggaccggtacgtaccggggg

SEQ ID NO: 420019 - DNA, 588 bp, Homo sapiens
  misc_feature: GZ8MTXP02HEXR1.8.33.C11.1.454.CMB.2.raw
  modified_base (210)..(210): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagngccaccctctcctgcagggccagtcagaatgttggcgccttcgtaagctggtaccaacacaaacctggccaggcctccccacggcccctcatctatggtgcatcccaacagggccaacgtggccaactccccagccaggttcagtcggcaggtgggtatgggacagtacttcgactctcaaccatcatcagccgtgacgcctagaagtagtggttgctagtttattacgtcgtacaactagtccgtaccggtaggtcggccgtcccgggggcctacgtttccggcccggtcgggaacccgtaagggtcgggaagtacgtacgaaaacgtaccgtaggtcggcgtaagccgaaccctagttacctgttcctttactacg

SEQ ID NO: 420020 - DNA, 675 bp, Homo sapiens
  misc_feature: GZ8MTXP02ILQD7.8.33.C11.1.454.CMB.2.raw
  modified_base (211)..(211): a, c, t, g, unknown or other
  modified_base (252)..(252): a, c, t, g, unknown or other
  modified_base (267)..(267): a, c, t, g, unknown or other
  modified_base (273)..(273): a, c, t, g, unknown or other
  modified_base (283)..(283): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagcccacctgttctttgtctccgaggggaaanacgccacctctcctgcagggccagtcagatgtgctcttganctgtacaacacaacngcagcnccacgccctnatctatggtcgcactaccgaaacacgggccacgtggacactcccagccgtaggttcaggtcggacgtagggttacgggtagtcggggaaccagggtacctttccgaaccttcgtaccctaacctactctaactccgaagtcccgtagggacgtacccgttaaggaaacgtgttaggtttacgtaccttaagttttaacttacgttacggttaaacctaaacgtaccggttacggtaccggtacgggtcccggttcccgggggtaccggtaccgtttacccgggtccggtaccgggaacggtaacgggttacgggaacggagtaaccgtaaacggtaaacgtacgtcggtacgtacgaactacgtaactcgtacgtcctttactactttcccg

SEQ ID NO: 420021 - DNA, 826 bp, Homo sapiens
  misc_feature: GZ8MTXP02F8G7Q.8.33.C11.1.454.CMB.2.raw
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaatggtggagtcgtgggggagcgtagtccagccgtgggagtcacagagactctcctgtgcagccctgtggtcaccttcagtgctacggcatgcacgtcgggtcccaccaaactccgaggacaagggtgttgggaggtggggtggtctaggtttgttacagtccgtaggacgggtctaggttgtacaagttcgggtaatggctagggaccgtaccgggttagggaaaccggggtcccgtaactttacccgaaccctaacgttcccgtaccgaacggaacggtaaacctaaaacccgtaccgaaacgggtaaaccctaaaccgtaaagtttacggtttaaacggtttaccggaaacccgtttaacgggaaaacctaaccggtaaccccgtttaaagggttaccccgttaaggggtaaaccgggaaaccgggttaaccgggggtttaacgttaaacgtttaaaaccggttaaaccggtttaacgggggtaaaacccggggaaaaggggggtaaacccggggggaaaacccgtacgggggtaaccgggggttaaaccgtttaaccccggtaaaacgggtttaccccgtttacccgggttttacggaacccgggtttaccggggtaacccggggg

SEQ ID NO: 420022 - DNA, 760 bp, Homo sapiens
  misc_feature: GZ8MTXP02GCAJX.8.33.C11.1.454.CMB.2.raw
  modified_base (315)..(315): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagacgccaccctctcctgcagggccagtcagaatgttggcgtcttcgtaagctggtaaccaacgacaaacctggccaggcctcccgacggcccctcatctagtggtncactaccaacgacgggcccaacgtggaccactccccgaagcccgtaagggtttcccaggtcggaccaagggttggggtaacgtcggggaacctaaggacccgtttccaacgttacctacccgaaccccatttacccgaaattccacgtacccgttagggaacgtacccgttaagaaacgtcgttaacggggtttacgtaacgttaagtttaacgttaaaccgttacgttaacctaaacgttaacgttacccgggtaaaccggttacgggttacccgggtaccccggggttacccgggggtacccgttaacccgggtttcccgggtaccccggttaccggggaacccggtaaaggggtacgggtaaacgtaacgtaaaccgtaaaacgtacggtacggacgtaccgtaacgtaccgaccgtacgttacgttcgttaccttactacg

SEQ ID NO: 420023 - DNA, 683 bp, Homo sapiens
  misc_feature: GZ8MTXP02I6KOI.8.33.C11.1.454.CMB.2.raw
  modified_base (280)..(280): a, c, t, g, unknown or other
  modified_base (334)..(334): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgctcttttaagaggtgtccagtgtcaagtgcaactggtggagtcgtgggggagcgtagtccagccgtggggagtcacgagagactctcctgtgcagcctcgtgggttcaccttnagtagctacggcatcgacacgtcgggtcccaccaaactccgaggacgaagggtnttcgggagtggggtgccgtagtttcgttcagttcccgtaggacggggtctagttcgttacgaagttgggtaatggcgttggaccgtccggtaggaacgggccgtagttccacctactctacaacgacgaacaacctaccgaagaaaccacaaacgttagttaacgtttacggaaccttagaaaaccgtacgacccgttaaacgttaccgtaggacgggtaaccgtacggggtattaacgtaaccgtacgtacgggtaaacggaaacgggggacgggggaaaccgagggaccggggtaacgttaccgaaacggttaccgtaccgtttacggaccggttacgtaccggggg

SEQ ID NO: 420024 - DNA, 810 bp, Homo sapiens
  misc_feature: GZ8MTXP02I1Q5W.8.33.C11.1.454.CMB.2.raw
  modified_base (344)..(344): a, c, t, g, unknown or other
  modified_base (404)..(404): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaacgtggtggagtcgtgggggagcgtagtccagcctgggagtcacagagactctcctgtcgcagtccctgtgggttccaccttcaagtacgcgtacggctatcgaccacgtcgggtcccaccgaaacgtccgaaggccgaaaggggtnttggggagttggggtagtcgtagtttcgtttacagttccgtaggacggggtctagggttnttaccgtaagttggggttatcggtcgtacgggtaccgtccggtagggaaacgggtcccgtacgttaccacccgtacgttacccgtaaccgaggtaaacgtaccgaaaccgtacccgaaaaggaaacctaaacgtaaaccgtttacggtttaaagtttacgggaactttacggaaacgtaaaccggtacgtaaccgttaacggttaccgtaacgggtaaacgtaaacgggtaacgggtttaacggtaacctttaaaaccggttaacgttaaaacgggggtaacggggtaaaaaccgggggttaacggggggtaaacccccagggggttaacccgggttaaacgttacccggttaaaaacgggttcccgtttacccggggtttaggttaaacccgggtttcccggggg

SEQ ID NO: 420025 - DNA, 614 bp, Homo sapiens
  misc_feature: GZ8MTXP02FY7OL.8.33.C11.1.454.CMB.2.raw
  modified_base (210)..(210): a, c, t, g, unknown or other
  modified_base (255)..(255): a, c, t, g, unknown or other
  modified_base (269)..(269): a, c, t, g, unknown or other
  modified_base (276)..(276): a, c, t, g, unknown or other
  modified_base (286)..(286): a, c, t, g, unknown or other
  modified_base (298)..(298): a, c, t, g, unknown or other
  modified_base (446)..(446): a, c, t, g, unknown or other
  modified_base (455)..(455): a, c, t, g, unknown or other
  modified_base (470)..(470): a, c, t, g, unknown or other
  modified_base (590)..(590): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtcctccgaggggaanacgccaccctctcctgcgacgggccagtcagattgtggctctganctgacaacacaacngcagccnccgagccctnatctagtggtcnctactaccaacgacggccagtggaccactcccgagccgtaggttcacggtcggacgtgggtagggtacgtcggggaactagtcctttacacctttcaccctaacctagtcctaaactcgacgtcccgtagggactccgtaagaaagtnttgtacgtnttaagtttatacgtntaccaaactgtaccgtaccggtagtccgggtccggtaccgggggtaccttaccggtccgggtaccgtacggggaaccgtagggtcgaacgtacgaacgtaaaacgtcgtaggtcggtacncgaccactctactcgtcctctacg

SEQ ID NO: 420026 - DNA, 610 bp, Homo sapiens
  misc_feature: GZ8MTXP02JHQBY.8.33.C11.1.454.CMB.2.raw
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggagcgtagtccagcctgggagtcacagagactctcctgtgcagcctcgtggttcaccttcagtagctacggcatcgcacgtgggtcccaccaaactccgaggaccgaagggattgggaggtggggtgctagtttgttcatccgtggaggctaggtgtacaagtggtatgctgacgtcgtaggaaacggccgagttccaccgtactctacgagacgacaactaccagaacacaatgtactttacgacctagaacacgacctaagtccgtagacggtacgacgggtagtaacgttactacgtacggtaacggaaacggggaacgggggaaccagggaccgggtaacgtttaccgaacggttaccgttaccgtttacggtaaccgtcggttacccgggg

SEQ ID NO: 420027 - DNA, 655 bp, Homo sapiens
  misc_feature: GZ8MTXP02HIQJI.8.33.C11.1.454.CMB.2.raw
  modified_base (244)..(244): a, c, t, g, unknown or other
  modified_base (304)..(304): a, c, t, g, unknown or other
  modified_base (388)..(388): a, c, t, g, unknown or other
  modified_base (452)..(452): a, c, t, g, unknown or other
  modified_base (485)..(485): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggacgcgtagtccagccgtgggagtcanagagactctctgtgcacgtcctcgtgggttccaccttcgagttgcgtacggcagtcgacncgtcgggtcccaccctaaacgtccgaggacgaaaggggtcttgggaggtggggtcgtcgtaggtttgttcgaagtcccgtaggngggtactaggttgttacaagtggttagtgcgtagaccgtccggtagggacggcgtactccaacnctcaccagacgtacaaccgtacgaagaacctanaaagttcgttagttaccgacgtagacctagaccctaagtccgtaggaacgtaccggtagtacgttaacacggttacgtacgggaaacggacgggggaccggggaactacggggacggttaaccgtaccaaacggttcgtttaccggtacggaccggttaccggtccgggg

SEQ ID NO: 420028 - DNA, 667 bp, Homo sapiens
  misc_feature: GZ8MTXP02JKUNH.8.33.C11.1.454.CMB.2.raw
  modified_base (277)..(277): a, c, t, g, unknown or other
  modified_base (378)..(378): a, c, t, g, unknown or other
  modified_base (385)..(385): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtagtccaggccgtgggagtcacagacgactctctgtgcagcctcgtggtcacttnagtagctacggcatgcacgtcgggtcccacaaaccgtccgaaggacgaagggtattgggaggtgggtgctagtttgttcagtccgtggaggctagtcgtanagtgtancgtcgtagccgcgtaggaacgggcctacgttaccaacctacgtccctaccgaacgaacgaaccgtaaaccgtacccgaaaggaaaccctaaactagttagttacgtttaacggacccttaggaaaccgtacgtacctaacggtcgtaacgggacggtaacggtacgggtattaacgtaccgtaggtaacggtaaacgggaacgggggaacgggggaactacggggacgggttaacgtaccgtaacgttccgttacggttacggaccggtacgggtcccgggg

SEQ ID NO: 420029 - DNA, 602 bp, Homo sapiens
  misc_feature: GZ8MTXP02GPM9G.8.33.C11.1.454.CMB.2.raw
  modified_base (208)..(208): a, c, t, g, unknown or other
  modified_base (240)..(240): a, c, t, g, unknown or other
  modified_base (245)..(245): a, c, t, g, unknown or other
  modified_base (251)..(251): a, c, t, g, unknown or other
  modified_base (256)..(256): a, c, t, g, unknown or other
  modified_base (262)..(262): a, c, t, g, unknown or other
  modified_base (270)..(270): a, c, t, g, unknown or other
  modified_base (280)..(280): a, c, t, g, unknown or other
  modified_base (291)..(291): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgctccgagggaagngccacctctcctgcaggccagtcagatgtgcnctgantgacanacacngcagcnccagcccnatctatggtncactccaacgnggccagtggcatccccgagccctaggttccaggtcggctaggtggtaagtgggactagtacttcacttcaccacctagtacactcacgtccgtggacgccgtagaacgtagttcgttgacgttagtttacttactagtaacaacgtagtaccgtaccggtagtccgggtcccggttccgggggcccttaccggtttcccggcccggtacgggaacccggtaaggggttacggaaacgtacgtaaaccgtaaacggaacgttcgggaacgcgttaacggacctaactacgtcgttcgttcttaccttacccg

SEQ ID NO: 420030 - DNA, 565 bp, Homo sapiens
  misc_feature: GZ8MTXP02IVEJG.8.33.C11.1.454.CMB.2.raw
  modified_base (284)..(284): a, c, t, g, unknown or other
  modified_base (299)..(299): a, c, t, g, unknown or other
  modified_base (374)..(374): a, c, t, g, unknown or other
  modified_base (405)..(405): a, c, t, g, unknown or other
  modified_base (417)..(417): a, c, t, g, unknown or other
  modified_base (440)..(440): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgttctttgtctccgaaggggaaagacgccaccctctcctgcaggccagtcagaatgtgcgcttgtagctgtaaccaacaacaacctggccaggccncccgacggcccctanactctagtggtgacactaccaacgacggccacgtcggcactcccagcctaggtcagtcgcaggtggtagtggacngctcactctacacatcatcacgcgtaggacncctagaaacgtntagttgacttagtttactacgtntaacctaaagtcgtaccgttacggacgtcggtcccggtccggggctaccggttccggccgtacggacgtaaggcgagaacacgaaacgtagcgtcgcgtaacgcacagttctacgtactcctacg

SEQ ID NO: 420031 - DNA, 614 bp, Homo sapiens
  misc_feature: GZ8MTXP02GZ18V.8.33.C11.1.454.CMB.2.raw
  modified_base (275)..(275): a, c, t, g, unknown or other
  modified_base (325)..(325): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactgggtggagtcgtgggggagcgtagtccagcctgggagtcacagagactctcctgtgcagcctcgtggtcaccttnagtagctacggcatgcacgtcgggtccaccaaactccgaggacaagggtnttgggagtggggtggctagttgttcatccgtggagggcagttgttacaattgggtatgctcgacgtccggtaggaacgggaccgattccacactactaccagacgtaacaactaccgaacgaacaacgaatagttagttacgacctaggaacacgaccgtaagtaccgtagacggacgacgggtagtaactacgtaacgtacggtaaacggaagggacgggggaaaccgacggacggggtaacgttaccgaaacgttaccgtaccgtttacggacgttcggtaccgggg

SEQ ID NO: 420032 - DNA, 742 bp, Homo sapiens
  misc_feature: GZ8MTXP02HJGG0.8.33.C11.1.454.CMB.2.raw
  modified_base (200)..(200): a, c, t, g, unknown or other
  modified_base (258)..(258): a, c, t, g, unknown or other
  modified_base (346)..(346): a, c, t, g, unknown or other
tcagctcgcgtgtccacgaccggtgctcgatttagagtgagctcgtggggagaggagcccagcacctagaagtcggcggtgtttccattcggtgatcagcactgaacacagaggactcaccatggagtttgggctgaactgggttttcctcgttgctcttttaagaggtgtccagtgtcaagtgcaactggtggagtcgngggggaggcgtagtcccagccgtggggacggtcaccagacgacttcctcctgtcgacngtccctcgtgggttcaccttcagtagctacggcatgcacgtcggggtcccacctaaacgtccgagggacgaaaggggtcgttaggggnggtgggtcgtacgttaggtttcgttacgtagttacgtggtacggtacccgtagttacgttaacgtaagttggtactcggtccgtacgggaccgtaccggggtaaggtaaccggggtcctaaacttcccaccgttacgtacccgacgaacggtaaacaaacccgtaccgtaaccgaaacgaaacctaacgtaagttagttacgttacggtaaacctagtaaaccgtacgtaaaccgtacgtccgaaggacggtacgtaacggttacgtactaaccgtaggttaacggtaaacgggaagggggtaaccggggtaacgacggggtaccggtacgttaaccggtaacgttccgtttacgttacggtacgggtccggtacggggtaccgttacgggtaccg

SEQ ID NO: 420033 - DNA, 710 bp, Homo sapiens
  misc_feature: GZ8MTXP02GF9TX.8.33.C11.1.454.CMB.2.raw
  modified_base (288)..(288): a, c, t, g, unknown or other
  modified_base (344)..(344): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaacgtggtggagtcgtgggggagcgtagtccagccgtgggacggtcacagagactctccgtgtgcacgcccttcgtcggttccaccgttnagtacgctacggcagtcgcacgtcggtacccaccaaacctccgaggacgaagggtntggaggtgggtgctagtttgtacagtccgtggacggtactaggttcgttacgaagttggtatcggcgttacgggaccggtaccggtaggggtaaccgggtcctacgttacccaacctactacccgtacgaacgacaacctaaaccgaccgaaacgtaaaccaaacgttaagttacgtttaacgtttcggaaaccctaacggtaacgaccgtaaccgttacgcgtacggacggtaacgtacgggttaatacgtaaccgtaaggtacggtaaaccggggaaaggggaaccggggaactaacggggacgggttaaaccgttaaccgaacggtttacttaccggtttacggacggttacggtacccgggg

SEQ ID NO: 420034 - DNA, 682 bp, Homo sapiens
  misc_feature: GZ8MTXP02FUSY7.8.33.C11.1.454.CMB.2.raw
  modified_base (305)..(305): a, c, t, g, unknown or other
  modified_base (329)..(329): a, c, t, g, unknown or other
tcagctcgcgtgtccacgaccggtgctcgatttagagtgagctcgttgggtttggggctgggagaggagcccagcactagaagtcggcgatgtttccattcggtgatcagcactgaacacagaggactcaccatggagtttgggctgaactgggttttcctcgttgctcttttaagaggtgtccagtgtcaagtgcaacgtggtggagtcgtgggggagcgtagtccagcctgggaggtcacgagagactctcctgtgcagcctctgggttcaccttcagtagctacggcatgcacgtgggtccnccaaactccgaggacgaaagggtnttgggaggtggggtgacgtagtttcgtttcattcgtaggaggtcaaggttgttacaagtgggtaactgcgtacggacggccgtaggaacggggcacttacaacctatcctaccgacgaacgactaaaccgaccgaaggaaaaccaactaaagttacgttaagtttacggaaccgttagaaaccgtacgacccttaaaggttcccgtaggaaccggtacgtaaccgggtacgttaaacgttaacccgtaacgtacgggtaaacgggaaacgggggtaaacgggggaacccgagggtaaccgggtaaacggttacgaaaacggttcccgttacgtttacggaaccggttccgggg

SEQ ID NO: 420035 - DNA, 753 bp, Homo sapiens
  misc_feature: GZ8MTXP02HQBTO.8.33.C11.1.454.CMB.2.raw
  modified_base (179)..(179): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgcttcttttaagnggtgtccagtgtcaagtgcaacgtggtggagtcggtgggggagcgtagtccagccgtgggagtcacgagagactcctctgtgcacgtcctcgtcgggttccacccttcgagtacgccgtacggctagtcgctaccgtcgggtccccacctaaaaccgtccgaggacgtaaaggggtgttaggggagggttggggtacggtctaaggttttcgttacctagtccggtagggacgggtcgtaggttgttacgaaagttgggtaagtgtccgtaggacccggtcggtaggaacgggtcccgtattacccgacctacttccgaccgtaagaaccgaacctaacccgtacccgaaagaaacctaaacgtaagtttacggttaacgttttacggaacccttaaggaaaccgtaccgtaaccgtaaacgtccgtaggaaaccggtacggtacgggtaactacgtaccgttaaggtacggtaaacggggaaacgggggaccggggtaaccgacgggaacgggtaaccgttaccgtaaacggttcccgttaccggtttcggaaccggtttccggtacccgggg

SEQ ID NO: 420036 - DNA, 654 bp, Homo sapiens
  misc_feature: GZ8MTXP02F7VD6.8.33.C11.1.454.CMB.2.raw
  modified_base (248)..(248): a, c, t, g, unknown or other
  modified_base (254)..(254): a, c, t, g, unknown or other
  modified_base (267)..(267): a, c, t, g, unknown or other
  modified_base (282)..(283): a, c, t, g, unknown or other
  modified_base (362)..(362): a, c, t, g, unknown or other
tcagctcgcgtgtccacgaccggtgctcgatttagagtgagctcggttgggtttgggggaggaactgctcagttaggacccagagggaaccatggaagccccagctcagcttctcttcctcctgctactctggctcccagtttcagataccaccggagagattgtgttgacacagtctccagcccaccctgttctttgtctccgaaggggaaagacgccaccctctctgcacgggcagcagatgtgcnctgtanctgacacacaacngcagctccacgcccnntctatggtcgcatacccaacgcggccacgtcggaccactcccgacgtccgaggttccgaggtcggactagggtggtagnggggactagccttcactcacacatcatcgagccgtgacgcgtagaagtagtgttacgtacttaagtttactttacgtacgtaactaacgtacgttaccgggtacgtacggggtaccggccccggggttaccgggggtacccctttaccggggtttacccgggtaccccgggttacgggggtaacccgtaaagggggttccgggaaacgtaaacggttaaccggaaaaccgtacggttcggtacggtacgtccggaacctaaccgttctcggttactttaccgtacttacccg

SEQ ID NO: 420037 - DNA, 621 bp, Homo sapiens
  misc_feature: GZ8MTXP02JSLHU.8.33.C11.1.454.CMB.2.raw
  modified_base (256)..(256): a, c, t, g, unknown or other
  modified_base (281)..(281): a, c, t, g, unknown or other
  modified_base (321)..(321): a, c, t, g, unknown or other
  modified_base (416)..(416): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgcttcttttaagaggtgtccagtgtcaagtgcaacgtggtggagtcgtgggggagcgtagtccagcctgggagtcacagagactctctgtncagcctcgtgggttcacttcagtcnctacgcatgcacgtgggcccacaaactccaggacaaggtntggagtgggtgctagtttgtcatcctaggaggcagttgttacaagttgggtatgctgacgccggtaggacgggaccgtataccacactcacaganaaccaactaccgaagaacaactagtacgttagttcggacctaggaaactacgacctaacgtccgtaggacgaacggtacgggtacgtaactaaaccgttaagtacgggtaaacgggaaacgggggaacgggggaaaccgaacgggacggggtaacgttaaccgaaacgttaccttaccgtttacggtacggtacggtaccggggg

SEQ ID NO: 420038 - DNA, 578 bp, Homo sapiens
  misc_feature: GZ8MTXP02IXTST.8.33.C11.1.454.CMB.2.raw
  modified_base (208)..(208): a, c, t, g, unknown or other
  modified_base (387)..(387): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacctgtctttgtctccgaggggaangccacctctcctgcagggccagtcagatgttgcgcttgaagctgtacaacacaactgcagctccagccctcatctatggtgcatccaacgagggccaacgtggaccactcccagccagggttcaggtcggcaggtggtatgggacagacttcactctacacctatcatcagcctggacnctagaagatgttgctagtttacttactgtacaactagtccgtacggacgtcggcccggttaccgggggccttaacggtttccggcccgttaggggaacccgtaaggggtcggaaagtacgttaaaccgaaaacggtaacgtacggtcgacgttcggacctaacgtacttcgttacgttcctttacgtaccc

SEQ ID NO: 420039 - DNA, 697 bp, Homo sapiens
  misc_feature: GZ8MTXP02FQWBH.8.33.C11.1.454.CMB.2.raw
  modified_base (244)..(244): a, c, t, g, unknown or other
  modified_base (261)..(261): a, c, t, g, unknown or other
  modified_base (307)..(307): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgcttcttttaagaggtgtccagtgtcaagtgcaactggtggagtcgtgggggagcgtagtccagccgtgggaggtcanagagactctcctgtgcngccctcgtggtcaccttcagtagctacggcatgcacgtcggacccnccaaactccgaaggacgaaggggtgttgggagggtggggtggtctaggtttcgttacagttccgtagggacggggtctaggtttcgttacgtaaaggttggggtactggtacgtggaaccgtccggtaagggaacggggtcctacgttcccacgactcctacgaagacgaacaacctaccgaaaggaacctaacgtaacgttacggttaacgtttaccggaaacccttacggaaaacctacggtaacccgtaacgtacccgtacggaacggtaaccggtacgggttacgtaataaccgtacgtaggtaaacggggacgggtaacgggggaacgacgggtacggaacgttaccgaacgttacgttaccgttacggacggttaccggtcggg

SEQ ID NO: 420040 - DNA, 684 bp, Homo sapiens
  misc_feature: GZ8MTXP02I90ZM.8.33.C11.1.454.CMB.2.raw
  modified_base (387)..(387): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggcccagtcagaatgttgcgccttcgtaagctggtaccaacacaaacctggccaggctcccaggcccctcatctatggtgcatccaacagggcccactcggcatcccagccaggtcagtcggcagtgggtagtggacagacgttcacttctacccacctntacctaagtcccagtacccctggggtaacgcccgtttacgggaaagaccggtttatttcgggtcctacggttttaatttaaaccgtcggttactaaactaaccgtttacggacccgtaaaggtaccgggtccggtaccgggggtccccgtaaccgtttcccggggtacccgtcgggggtaccgaaaccggggttggtacggaacttaccggaaaaccggtaaacgttaacgcggggttacgtaacggtaccgaaaaccccggtcttacccgttacgggtttaccttttaccgtaccc

SEQ ID NO: 420041 - DNA, 828 bp, Homo sapiens
  misc_feature: GZ8MTXP02ITE8Z.8.33.C11.1.454.CMB.2.raw
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacctgtctttgtctccagggaagagccacctctcctgcaggccagtcagatgtgcgcttgagctgtacaacacaactgccagctccagcccctcatctatggtgcactcccaaacgacggggcccaacgtcggacctaactcccccaacggccccgtaaggggtttccaaacggggtttccggggacccgtaaggggtttagggggttaaccgttaggggggaaccctaaacgggttacccgtttttccgaaaccccgtttcccttaaaccccgaaaccccccgtaagtttaccctaaacgtttacccaacggtaacccccgttacggggaaaccggtccccgtttaaagggaaaacggtacgtttaaggtttcgggtacccttaaaggtttttaaacttttaaaccgttaacggtttacctaaaaacccgttaacgtttacccggttaaacccgggtaccgggttaccggggtcccccggttaacccgggggggtcccgttaaacccggttttcccggggacccccggtttacggggaacccgtaaacgggggttacggggaacggtaacgtaaaccgtaaaaccggtaacgttcgggtacggtacgtccgaccgtaactacgttactacgttctttactaccg

SEQ ID NO: 420042 - DNA, 648 bp, Homo sapiens
  misc_feature: GZ8MTXP02I3A02.8.33.C11.1.454.CMB.2.raw
  modified_base (204)..(204): a, c, t, g, unknown or other
  modified_base (217)..(217): a, c, t, g, unknown or other
  modified_base (243)..(243): a, c, t, g, unknown or other
  modified_base (250)..(250): a, c, t, g, unknown or other
  modified_base (256)..(256): a, c, t, g, unknown or other
  modified_base (272)..(272): a, c, t, g, unknown or other
  modified_base (278)..(278): a, c, t, g, unknown or other
  modified_base (282)..(282): a, c, t, g, unknown or other
  modified_base (304)..(304): a, c, t, g, unknown or other
  modified_base (373)..(373): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccacctgtcttgctcgagggaancgccacctctccngcagggccagtcagatgtgctctganctgacanacaacngcagctccacgccctnatcagngtcncactcaagacggcagtcgcacnccgcgacgtagtcaggtcggactagggtaggtagtcgggactaacgtccgttcactccgtaacacgtanctatcgacgtaccgtgacgtactagaacgtcgtgttgacgttatttactacgtagtacaaacgttgtaccggtacgggttacgtacccggggtccggttacccggggttacctaccgggtttccccggggaccgtttacgggggaacgttaacgggggtacaaacggttaacggtaaacccgaaacggttaccgggtggggttaacccgaccggtaaccgtaccgttaaaacccggttcgttaccgtttacccggttacctttaaccgttccccg

SEQ ID NO: 420043 - DNA, 692 bp, Homo sapiens
  misc_feature: GZ8MTXP02FGIX6.8.33.C11.1.454.CMB.2.raw
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaagggaaagagcccaccctctcctgcgacgggccagtcagaatgttggctcctgtagctgtaccaacacaactgccaggctcccgacggcccctgatctaagtggtgcactacccgaagtacggggaccctacgtggaccacgtaccccgaagcccgaaggtttccgaggtcggtcgaggtgggtacgaggggacaggtcttaccacttctaccaactataccattaaccgcgtccctcggggactcccgtaaggaaacgtgttgtttacgacgttaagttttaacttacttacggtaaccaacgtacgtacccgttaaccgggacggtccggtacccccgggtcccgggggtaccctttacccgtttcccgggaccccggttaggggaaacccccgttaaggggtccggaagtaaccgttaaacccggaaacggtaacccgtttgacggggttcaaccggcctacacgtttaccgcttccttacctacccg

SEQ ID NO: 420044 - DNA, 593 bp, Homo sapiens
  misc_feature: GZ8MTXP02FU9OL.8.33.C11.1.454.CMB.2.raw
  modified_base (412)..(412): a, c, t, g, unknown or other
tcagctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgccagggccagtcagaatgttggcgccttgtaagctggtaccaacacaaacctgccaggctcccacggcccctcatctatgtgcactccaacgaggcccagtcggacactccccagccaggttcagtcggacaggtagggtatagggacaagtcgttacactactccaccaatccatcagccctgacncctgaaagacttgttcgctaagtttattaccgtgtaccaactattcgtaccgagtcgggacccgtccgggggccttacgtttccgggccctacggggacgaacgggtggaaagtacgtaacggaaaacggaccgttggtgtaaccctggaccaccgtactcgtacggtttcctacttaccg

SEQ ID NO: 420045 - DNA, 660 bp, Homo sapiens
  misc_feature: GZ8MTXP02GLFTQ.8.33.C11.1.454.CMB.2.raw
  modified_base (244)..(244): a, c, t, g, unknown or other
  modified_base (336)..(336): a, c, t, g, unknown or other
  modified_base (358)..(358): a, c, t, g, unknown or other
  modified_base (365)..(365): a, c, t, g, unknown or other
  modified_base (376)..(376): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaacttgggttttcctcgttgcttctttaagaggtgtccagtgtcaagtgacaacgtggtggagtcgtgggggagcgtagtccagccgtgggagtcanagagactctcctgtgcagcctcgtgggttcaccgttcagtacgtcgtacggctagtcgccacgtcggtcccaccaactccgagcgaagggtnttggagtgggtgcgtagttgtnactccgngtaggctagtnttacgaagttggtatggtctcgacggtccgtaggacgggtacctattccgacactccacgtagacgacaaaccgtccgaaaggaacctaagtaagttagttaacgtttggaacctagaaacgaccgtacgttaacgtcgtacgggaacgtaccggtaaggttacgttacgttaaaccgtaccggttaggaaacgggggttaaaggggaccgggggtaaccggacggggttacgtaacgtaacggtacgttacccgttaggacggttacgggtcggtaacccggg

SEQ ID NO: 420046 - DNA, 726 bp, Homo sapiens
  misc_feature: GZ8MTXP02FPNY3.8.33.C11.1.454.CMB.2.raw
  modified_base (205)..(205): a, c, t, g, unknown or other
  modified_base (309)..(309): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccacctgtctttgctccgagggaanagccaccctctcctgcagggccagtcagaatgttggacctccttcgtaagcgtaggtaaccaaacacaaaccgtggaccaaggtcctacccgaggtccccctanacttcgtagtggtcactactaaccgaaggtaccggacctacgtacggaccctaccgaccccgagaccgtaggttcaggtccggagtacgggtgggtacgcgggaacacgtcctcctactcctaccacctataccatcgacgccgtaggaacgtcgtaagtagtagttgttacgtaacgttaagtttaacttacgttagtaaccttaaacgttacggttaccggtaacccgggttaggtacccgggttacccgggttacccgggggtacccttaccgggtttacccgggtacccgggtaacgggtaaaccggtaacggggtacgggaaacgttaacgtaaaccgtaaaacggtaccgttacggttacgacgttaaccggacctaaaccgtacgtttcgtacgttacccgttactaccg

SEQ ID NO: 420047 - DNA, 761 bp, Homo sapiens
  misc_feature: GZ8MTXP02GWFUM.8.33.C11.1.454.CMB.2.raw
  modified_base (208)..(208): a, c, t, g, unknown or other
  modified_base (314)..(314): a, c, t, g, unknown or other
tcagctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaanacgcccaccctctcctgcgagggccagtcaagatgttggcgtccttgtaagtctacggtaccaaacacaaaccgtcggaccaggcctaccccgacggtccccctanacttcctagtcggtcgactactaccgaagtacgggcctaacgtggaccctactcccgacgacccgtaggttccgaggtccggactaggggttaggggtacgtacggggaacctagggtacctttctaaaccttccgtaaccccaaccgtaatacctaacgtaccgaccggtacccgttaggggaacgtacccgttaaagggggaaaccttacggtttgggttaccgtaacgtttaaacggttttacttaacggttacgtaaccgtaaacgttacgtacccggttaaccgggtcggtacccgggtcccggtaccgggggtaccttaacccggtttccgggaacccgggtacgggtaacccgtaagggtacggtaaacgtacgttacgaaaacgttacgtcggtacgacgtaacgtaccactacgtccgttacgttccttaaccgttcc

SEQ ID NO: 420048 - DNA, 717 bp, Homo sapiens
  misc_feature: GZ8MTXP02FMUJB.8.33.C11.1.454.CMB.2.raw
  modified_base (584)..(584): a, c, t, g, unknown or other
tcagctcgcgtgtccacgaccggtgctcgatttagagtgagctcgttggggtttgggggaggaactgctcagttaggacccagagggaaccatggaagccccagctcagcttctcttcctcctgctactctggctcccagtttcagataccaccggagagattgtgttgacacagtctccagcctaccctgttctttgtctccgaggggaaagcgcccaccctctcctgcacgggccagtcagatgtcggcgtccttcgaagctgtaaccaacacaaacctggaccaggcctcccgacggtccccctatatctagtcggtcacacctaccgaaacgtacgggacctacgtacggacctacgtaccccacggaccgtaaggtttccaggtccgggaccgtaggggttcggggtaacggtgggggaaacctacgtaccgtttaccgtacttacccgttaccaaaccctactacctaaacgtcccgtaacggtcccgttagggaccggtaccctaaggtaaaccggtagttcgtttaggtacttaaggttttactactagtaacctaaacgttcgtacgtaaccggnggtcccggaccggttccggggaccttcggtccggaccgtaggggtaccgaagggtcggaaacgtactaacggaaaccgtacgtcgggtcgtacgtaacggtaccctatacgttccttacgtactttaccgtcc

SEQ ID NO: 420049 - DNA, 563 bp, Homo sapiens
  misc_feature: GZ8MTXP02GLWOG.8.33.C11.1.454.CMB.2.raw
  modified_base (302)..(302): a, c, t, g, unknown or other
  modified_base (345)..(345): a, c, t, g, unknown or other
  modified_base (364)..(364): a, c, t, g, unknown or other
tcagctcgcgtgtccacgaccggtgctcgatttagagtgagctcgttgggtttggggctgggagaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctcctgtgcagccctctggggttcaccttcagtagctacggcatgcactggtccncaaactcaggcagggatggagtgggtgcagttgtcatcctagnggcagtgttcatggtatgntgacgcgtagacgggcagttcacatctaccagacgtacaactacgagaaactaacgattcgtacgttacgactacggaactacgtacgtaacgtcgtagaaggtaccgtaggtacgtaactacgtacgtacggtaaagggacgggaacggggacacgggaggtaacgtacgacgtactacgtacggacgtacggtcggg

SEQ ID NO: 420050 - DNA, 850 bp, Homo sapiens
  misc_feature: GZ8MTXP01DVTE4.9.24.C02.1.454.CMB.2.raw
  modified_base (205)..(205): a, c, t, g, unknown or other
  modified_base (307)..(307): a, c, t, g, unknown or other
tcagtgatacgtctcacgaccggtgctcgatttagtacagatcgttagggaaagggggaggaactgctcagttaggacccagagggaaccatggaagccccagctcagcttctcttcctcctgctactctggctcccagtgaccaccggagaaattgtgttgacacagtctccagccaccctgtccttgtctccgaaggggaaanacgcccaccctctcctgcagggccagtcagagtgttgcactagtagcctggtaccaacagaactccgtggccaggcctacccgaggcctcctctaattttangatgcaactccaaacgaggggccccaacgttcgggcccgttaccccgaggtccccgtaaggggtttccaagggttcgggacctaaggggtttcgggggtaccttcgggggaactacggtaacccttttccaacttcctacccaaacccgtaattcccgaaacgggtccaaacgggtacccccttaagggaacgtaccccgttaaggaaaacggtttaatttttttacgggaaccttttaatttttttttaaactttaaacccgttgggtttaaccctaagggtaccaaacgggttccgggggtttacgaaccccgttaaaaggggttccgggttaccttttcccgttaccgttaaaccggtttttccgggggaccggggtaaacgggggtaaccccgtaaagggggttcggggaaaccggaaccccgttaaaggggaaaccggttaaaccgttgggttaacggggcctttacggggaccctaaaccccgtaagttcccgttttacgttaccctttaccgtaaccgtttccccgtttaaccccg

SEQ ID NO: 420051 - DNA, 590 bp, Homo sapiens
  misc_feature: GZ8MTXP01DHXKQ.9.24.C02.1.454.CMB.2.raw
  modified_base (205)..(205): a, c, t, g, unknown or other
  modified_base (236)..(236): a, c, t, g, unknown or other
  modified_base (262)..(262): a, c, t, g, unknown or other
  modified_base (268)..(268): a, c, t, g, unknown or other
  modified_base (286)..(286): a, c, t, g, unknown or other
  modified_base (292)..(292): a, c, t, g, unknown or other
  modified_base (306)..(306): a, c, t, g, unknown or other
  modified_base (405)..(405): a, c, t, g, unknown or other
tcagtgatacgtctcacgaccggtgctcgatttagtacagatcgttagggaaagggggaggaactgctcagttaggacccagagggaaccatggaagccccagctcagcttctcttcctcctgctactctggctcccagtgaccaccggagaaattgtgttgacacagtctccagccaccctgtccttgtctccgaaggggaaanacgcccaccctctcctgcagggccagtcagngtgtgcacctagtagcctggaccaanagatcnggcaggctccagctcctnatttangatgcatccaacgngggcccacgtggccgtcccagcccgtagggttcaggtcggctagggtcggggtcctaggggacaggtctttcacttcacaacatcaagcagcctagacncctagaagtatttgacttattttatactgtcagcagcggtcgaccgtaagtcggtacttcgtcgtacgtttcgggcgggtacggaccgtaagggtgggaacgaaccgaggaaccgaacgtggtcgggcttcggacctaaccgtacttccgttcgttcctttactaaccgtttcccgttaaccccg

SEQ ID NO: 420052 - DNA, 621 bp, Homo sapiens
  misc_feature: GZ8MTXP01AHARW.9.24.C02.1.454.CMB.2.raw
  modified_base (203)..(203): a, c, t, g, unknown or other
  modified_base (301)..(301): a, c, t, g, unknown or other
tcagtgatacgtctcacgaccggtgctcgatttagtacagatcgttagggaaagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaanagcccaccctctcctgccagggccagtcagagtgttggcacctagtagcctggtaccaacagaactcctggccaggctcccaggctctcattttacgngatgacactaccgaacgacgggcctacgtcggccgtacccgacgtcccgtaggttcagggtcggacgtaggtcggggtcgtaggggaactacgtaccttaccaccttcctaccaaccataccgagcacgtccctagacgtccgtagtaacgttatttacgtactttattttacttacgtgttacgagacgtagtcggtcgacgtagtcgtccttcgtcgtacggttcgggacggtacggtacgagggtcgaacgacgacgacgacgtcggtcgcgttcgacctaaccgtattcgtcgttccttactccgttcccgtcccg

SEQ ID NO: 420053 - DNA, 812 bp, Homo sapiens
  misc_feature: GZ8MTXP01A69SO.9.24.C02.1.454.CMB.2.raw
  modified_base (204)..(204): a, c, t, g, unknown or other
  modified_base (310)..(310): a, c, t, g, unknown or other
tcagtgatacgtctcacgaccggtgctcgatttagtacagatcgttagggaaagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaangcccaccctctcctgcagggccagtcagagtgttggcacctagtagcctggtaccaacagaactcccgtggccagggcctccccgaggtcctcctacatttttagngtatcgactaactacccgaaacgacgggccctacggtcggcccgtaccccgagtacccgtagggttcagggtcggacgtaggggttccggggttaccgtaggggaacctaacggtaccctttaccgaacccttcctaacccaaaccctacgtaccgaacggtaccgaacggtacccgtaaggacgtaccgttaaggtaaacgtttacgttttacgtaacttttaacgttttttaacgttaacgttacgttacgtaacggtaccgtaacggtaccggggttacggtaaccggttaagggttccggttaccgtttaccgttaccgttaccgggtttaccgggggaaccggggtaaccggggtaacccggtacggggtaacgggaaccggtaaccggaacggtaaaccggttacggttcgggtacgggttaccgttccggttaccgtaaccgttacgttaaccgtttccgtttaccgttaccgttaaccgtttccccgttccccg

SEQ ID NO: 420054 - DNA, 640 bp, Homo sapiens
  misc_feature: GZ8MTXP01DTCF5.9.24.C02.1.454.CMB.2.raw
  modified_base (205)..(205): a, c, t, g, unknown or other
  modified_base (264)..(264): a, c, t, g, unknown or other
  modified_base (296)..(296): a, c, t, g, unknown or other
  modified_base (303)..(303): a, c, t, g, unknown or other
  modified_base (431)..(431): a, c, t, g, unknown or other
tcagtgatacgtctcacgaccggtgctcgatttagtacagatcgttagggaaagggggaggaactgctcagttaggacccagagggaaccatggaagccccagctcagcttctcttcctcctgctactctggctcccagtgaccaccggagaaattgtgttgacacagtctccagccaccctgtccttgtctccgaaggggaaanacgcccaccctctcctgcagggccagtcagagtgtgcacctagtagcctggtaaccaanagaactccgtggccaggctcccgaggctcctntatttangatgcataccaacgacgggccacgtcggccgtacccgagcccgtaggttcaggtcggcgaggtcgggtcgtaggggactagtaccttcacttcacaccatacagcagccctagacgtcctagaagttnttttagactttaagtttttacttacgtgttacagcgtacggtcggtcgtacgtaaggttcggtctttccgtaccgttacggtttacggggcgggtaacggggaccgtaagggtcgggaaacgaacccgagggaaccgttaaacgtgggtcggacgttcggacctaacctagttccgttcgtcctttacgtaactttcccgttaaccccg

SEQ ID NO: 420055 - DNA, 786 bp, Homo sapiens
  misc_feature: GZ8MTXP01AZU4C.9.24.C02.1.454.CMB.2.raw
  modified_base (204)..(204): a, c, t, g, unknown or other
  modified_base (219)..(219): a, c, t, g, unknown or other
  modified_base (329)..(329): a, c, t, g, unknown or other
tcagtgatacgtctcacgaccggtgctcgatttagtacagatcgttagggaaagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaangcccaccctctccgngcgacggcagtcgagtagtggtcgacctaccgtacgtacgtccgtacggtaaccaacgagactccgtcggaccgacggccctacccgaggtccctccctattaatttagngtagtcgactacctacccgaacggacgggcccctacggtccgggacccgtacccgacgtaccgttaggttcgaggtcggacgtacggggttcgggtcggagggaactacgtaccttaccaccttccaccaactactacgacggaccacgtaccgtacggacgtaccggtaagtaacgtttagtttacgttactttaagtttttacgttacgttacgtacgtacgtacgtacggtcggggtacgaaccggttacggttcgttaccgtttaccgttaccggttaccggtttacgggggaccgggggttaaaccgggaaccgggttaaacggggtacgggaaccggtaaccgggaaacggtaaacccggttaacgggtcggtaccgggttaccgttcggacccctaacggttcttccgttccgtttccttaccttaacccgtttccccgtttaaccccgg

SEQ ID NO: 420056 - DNA, 574 bp, Homo sapiens
  misc_feature: GZ8MTXP01DJ7OU.9.24.C02.1.454.CMB.2.raw
  modified_base (204)..(204): a, c, t, g, unknown or other
  modified_base (293)..(293): a, c, t, g, unknown or other
  modified_base (299)..(299): a, c, t, g, unknown or other
  modified_base (312)..(312): a, c, t, g, unknown or other
tcagtgatacgtctcacgaccggtgctcgatttagtacagatcgttagggaaagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaanagccaccctctcctgcagggccagtcagagtgttggcacctacgtagcctggtaccaacagaatcctggccaggcctcccaggctcctnatttangatgcatccaacngggccacgtggcctccagccaggttcagtgcaggtcggtctgggacagtacttcactctcaccatcagcagcctagagctagaatattttgacttattttatactgtcagcagcggtgaccaagtcggtcttcgtcgtacgtttcgggacggtaacgggaccgtaagggtggaacgaacccgaaggtaacttaaacgtggtcgggttacttcggacctaacctattccgttcgttcctttctaacgtttcccgttaaccccg

SEQ ID NO: 420057 - DNA, 667 bp, Homo sapiens
  misc_feature: GZ8MTXP01D8V5L.9.24.C02.1.454.CMB.2.raw
  modified_base (205)..(205): a, c, t, g, unknown or other
  modified_base (260)..(260): a, c, t, g, unknown or other
  modified_base (292)..(292): a, c, t, g, unknown or other
  modified_base (299)..(299): a, c, t, g, unknown or other
  modified_base (603)..(603): a, c, t, g, unknown or other
tcagtgatacgtctcacgaccggtgctcgatttagtacagatcgttagggaaagggggaggaactgctcagttaggacccagagggaaccatggaagccccagctcagcttctcttcctcctgctactctggctcccagtgaccaccggagaaattgtgttgacacagtctccagccaccctgtccttgtctccgaaggggaaancgcccacctctcctgcagggccagtcagagtgtggcacctagtagcctggaccanagaactcctggccaggcctcccgaggctcctntatttangatgcatacccaacgacgggccacgtggccgtccgacgtccgaggtttcaaggtcggctaggggttcggggtccgtagggggaacctacggtaccctttccaccgttctaccctaaaccctagtaccgacggaccgtacgtacccgtagaccgtactaggtaacgttatttacggtactttaactttttattaccgtaggttacacggtaccgtacggccggtacgtacccgtaggttccggttacttccgtcgttacggttcgggacgggtaacgggaccgtaaaggggtcgaacgtaaccgnggtaacggagtggtcggacgttcgaccaacctgtccgttcgtcttactccgttcccgtaacccg

SEQ ID NO: 420058 - DNA, 594 bp, Homo sapiens
  misc_feature: GZ8MTXP01CC8FB.9.24.C02.1.454.CMB.2.raw
  modified_base (206)..(206): a, c, t, g, unknown or other
  modified_base (266)..(266): a, c, t, g, unknown or other
  modified_base (292)..(292): a, c, t, g, unknown or other
  modified_base (299)..(299): a, c, t, g, unknown or other
  modified_base (361)..(361): a, c, t, g, unknown or other
  modified_base (377)..(377): a, c, t, g, unknown or other
  modified_base (511)..(511): a, c, t, g, unknown or other
tcagtgatacgtctcacgaccggtgctcgatttagtacagatcgttagggaaaggggggaggaactgctcagttaggacccagagggaaccatggaagccccagctcagcttctcttcctcctgctactctggctcccagtgaccaccggagaaattgtgttgacacagtctccagccaccctgtccttgtctccgaaggggaaanacgcccaccctctcctgcagggccagtcagagtgttgcacctagtagcctaggtaccaanagaatcgtggcaggctcccagctctntatttangatgcaataccaaacgagggcccaacgtggccgtccaggccaggttcagtgcaggtcggtcngggacagtcttcatcncaccatcagcaagccctagacgactagaagtatttatacttattttattactgtacagtacaacggtcgggttcgaccgtaaagtcggtccttcgtccgtacgtttcggggacggtaacgggaaccgtaagggnggaacgaaccgagtaaaccggaaacgtggtgggttccgttggaccaactacttcgtcgttacttctaacgttccttaaccccg

SEQ ID NO: 420059 - DNA, 541 bp, Homo sapiens
  misc_feature: GZ8MTXP02GR846.9.24.C02.1.454.CMB.2.raw
  modified_base (204)..(204): a, c, t, g, unknown or other
  modified_base (263)..(263): a, c, t, g, unknown or other
  modified_base (296)..(296): a, c, t, g, unknown or other
  modified_base (420)..(420): a, c, t, g, unknown or other
  modified_base (423)..(423): a, c, t, g, unknown or other
tcagtgatacgtctcacgaccggtgctcgatttagtacagatcgttagggaaagggggaggaactgctcagttaggacccagagggaaccatggaagccccagctcagcttctcttcctcctgctactctggctcccagtgaccaccggagaaattgtgttgacacagtctccagccaccctgtccttgtctccaaggggaaanagccaccctctcctgcagggccagtcagagtgttggcacctagtagcctggtaccaaanagaatcctggccaggctccaggctctcatttangatgcatccaacaggccactggcgtcccagccaggttcagtggcagtgggtctgggacagacttcactctcacatcagcagcctagagcctgaaagattttgcatttttaattactgtacaganagngtcgcgaagtaggtcgttctctacttcggtcgggacgggaacggaacggaggacggaacgaacgaacgaaacgtacgtcgtcgtcgacgaaccgactactctcttctactacttcccg

SEQ ID NO: 420060 - DNA, 659 bp, Homo sapiens
  misc_feature: GZ8MTXP02HF28Z.9.24.C02.1.454.CMB.2.raw
  modified_base (203)..(203): a, c, t, g, unknown or other
  modified_base (299)..(299): a, c, t, g, unknown or other
tcagtgatacgtctcacgaccggtgctcgatttagtacagatcgttagggaaaggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaanagccaccctctcctgcagggccagtcagagtgttggcacctacgtagcctggtaccaacagaactcctggccaggctcccaggcctcctcatttangatgcactaccaacgacggccacgtcggccgtcccagcctaggttcaggtcggacgtaggtcggggtcgtggggactagtaccttcacttcctacaacctataccagacacgaccctagacgtaccgtagtaagttatttgactttaattttacttacgttgtactagtacgtaggtcgtacgtaccgtaaggttcggtacctttccgtaccgttacggtttcggggacgggtaacggggtaaccgtaaaggggtacgggaacggacccgaaggtaaaccggtaacgttcgggtacggtaccgtacggaccgtaacccgtacgttccgttcgttaccttacctaccgtttcccgttcccg

SEQ ID NO: 420061 - DNA, 580 bp, Homo sapiens
  misc_feature: GZ8MTXP02GF4GV.9.24.C02.1.454.CMB.2.raw
  modified_base (203)..(203): a, c, t, g, unknown or other
  modified_base (298)..(298): a, c, t, g, unknown or other
  modified_base (312)..(312): a, c, t, g, unknown or other
  modified_base (406)..(406): a, c, t, g, unknown or other
tcagtgatacgtctcacgaccggtgctcgatttagtacagatcgttagggaaagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaanagccaccctctcctgcagggccagtcagagtgttggcacctacgtagcctggtaccaacagaatcctggccaggcctcccaggctcctcatttangatgcatccaaacngggccacgtggccgtcccagccaggttcagtggcaggtcgggtctggggacaggacttcactctcaccatccagcagcctagacgcctgaagtnttttgactattttatactgtcagcagtcgtgacctaaggtcggtacttcgtctacgtttcggggacggtagggaccgaagggtcggaacgacccgaggaaccgtaaacgtggtacggacgttcggaccaaccgtagttccgttcgttcctttacctacgtttccctttcccccg

SEQ ID NO: 420062 - DNA, 556 bp, Homo sapiens
  misc_feature: GZ8MTXP02JC7Q4.9.24.C02.1.454.CMB.2.raw
  modified_base (203)..(203): a, c, t, g, unknown or other
  modified_base (298)..(298): a, c, t, g, unknown or other
  modified_base (304)..(304): a, c, t, g, unknown or other
tcagtgatacgtctcacgaccggtgctcgatttagtacagatcgttagggaaagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaanagccaccctctcctgcagggccagtcagagtgttggcacctacgtagcctggtaaccaacagaactccgtggccaggcctcccgaggcctccctnatttangatcgcactccaaagacgggccacgtcggccgtcccagcctaggttcaggtggctaggtcgggtctggggacaggtacttcacttccactacatcaagcagccctagacgtcctaagtcccggaattttgtcatttttatacttgtcagtcagcgtgccaagtggcttcgtcacgtttcggcggagggaccaaggtcggacgaccgagacgaacgtgtacgctgcaaccgactctcgtctctactcttcccg

SEQ ID NO: 420063 - DNA, 560 bp, Homo sapiens
  misc_feature: GZ8MTXP02HFNE9.9.24.C02.1.454.CMB.2.raw
  modified_base (203)..(203): a, c, t, g, unknown or other
  modified_base (300)..(300): a, c, t, g, unknown or other
  modified_base (407)..(407): a, c, t, g, unknown or other
  modified_base (543)..(543): a, c, t, g, unknown or other
tcagtgatacgtctcacgaccggtgctcgatttagtacagatcgttagggaaagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaanagccaccctctcctgcagggccagtcagagtgttggcacctacgtagcctggtaccaacagaactcctggccaggctcccgaggcctcctcatttangatgcatccaaacaggggcccacgtggccgtccccagccctagggttccaggtggcaggtcggggtctggggacagacttcactctcaccatcagcagccctagacncctagaagtattttgacttattttattactgttcagtcagcggtcgaccgtaagtcggtaccttctccgtacgtttcgggcgggaagggaccgaagggtggaacgaccgaggacgagtcggtcggctgcaaccgtntctgtctcactctcccg

SEQ ID NO: 420064 - DNA, 594 bp, Homo sapiens
  misc_feature: GZ8MTXP02IN0BQ.9.24.C02.1.454.CMB.2.raw
  modified_base (202)..(202): a, c, t, g, unknown or other
  modified_base (295)..(295): a, c, t, g, unknown or other
  modified_base (401)..(401): a, c, t, g, unknown or other
tcagtgatacgtctcacgaccggtgctcgatttagtacagatcgttagggaaaggggaggaactgctcagttaggacccagagggaaccatggaagccccagctcagcttctcttcctcctgctactctggctcccagtgaccaccggagaaattgtgttgacacagtctccagccaccctgtccttgtctccaggggaaangccaccctctcctgcagggccagtcagagtgttggcacctagtagccctggtaccaacagaatcctggccaggctcccaggctcctcatttangatgcataccaacgacggcccacgtcggcctccccgagccgtaggttcaggtggctaggtcggtctggacagtacttcactctcacctatccagcacgcctagacncgtagtagtatttgtacttattttacttacttgtactagtacgtacgtcgtacgaccgtaaggttcggtcctttccgtacgtacggtttcgggacgggtaacgggtaccgtaagggtacggtaacgaccgaggaacgtaacgtggtcgtcgtcgaccaacgtactcgttcgttacttactacgttcccttccg

SEQ ID NO: 420065 - DNA, 659 bp, Homo sapiens
  misc_feature: GZ8MTXP02IQPIO.9.24.C02.1.454.CMB.2.raw
  modified_base (202)..(202): a, c, t, g, unknown or other
  modified_base (262)..(262): a, c, t, g, unknown or other
  modified_base (299)..(299): a, c, t, g, unknown or other
tcagtgatacgtctcacgaccggtgctcgatttagtacagatcgttagggaaagggggaggaactgctcagttaggacccagagggaaccatggaagccccagctcagcttctcttcctcctgctactctggctcccagtgaccaccggagaaattgtgttgacacagtctccagccaccctgtccttgtctccaggggaanagccaccctctcctgcagggccagtcagagtgttggcacctacgtagccctggtaccaanagaatcctggccaggctcccaggcctcctcattttangatgcactaccaaacgcgggaccctacgtcggcccgtaccccgacgcccgtaggttccgaggtcggacgtagggtcggggtcgtaggggactacgtaccttccacttcctacacctatccacgcacgtacctagacgaccgtagtaattagttttgtactttaatttttattacttacgtacacgtacgtagtcgtacgtaccgtaggttcgtaccttcgtccgttacggttcgggacgggtacgggtaaccgtaggggtacggaacggaaccgaggtaaaccggtaacggttcggtacggtacgtcgacctaaccgtacgttccgttacgttccttaccgttacctttcccgttacccg

SEQ ID NO: 420066 - DNA, 585 bp, Homo sapiens
  misc_feature: GZ8MTXP02FUIFC.9.24.C02.1.454.CMB.2.raw
  modified_base (202)..(202): a, c, t, g, unknown or other
  modified_base (299)..(299): a, c, t, g, unknown or other
tcagtgatacgtctcacgaccggtgctcgatttagtacagatcgttagggaaaggggaggaactgctcagttaggacccagagggaaccatggaagccccagctcagcttctcttcctcctgctactctggctcccagtgaccaccggagaaattgtgttgacacagtctccagccaccctgtccttgtctccaggggaaanagccaccctctcctgcagggccagtcagagtgttggcacctacgtagcctggtaccaacagaatccctggccaggcctcccaggcctcctcatttangatgcatccaagagggccacgtcggcctcccagccaggttcagtgcaggtcgggtctgggacagtacttcactctcaccatccagcagcctagacgcctagaagtattttgacttatttttattactgtacagctagcgtcgaccgtaaggttcggtcttccgtcgttacgtttcgggacgggtacgggtaaccgaaggggtcggaacgaccgaaggaacgtaacgtggtacggactcggacctaaccgtacttccgtacgttcctttacacttcccgtttccccg

SEQ ID NO: 420067 - DNA, 649 bp, Homo sapiens
  misc_feature: GZ8MTXP02I8SA7.9.24.C02.1.454.CMB.2.raw
  modified_base (203)..(203): a, c, t, g, unknown or other
  modified_base (260)..(260): a, c, t, g, unknown or other
  modified_base (297)..(297): a, c, t, g, unknown or other
  modified_base (301)..(301): a, c, t, g, unknown or other
tcagtgatacgtctcacgaccggtgctcgatttagtacagatcgttagggaaagggggaggaactgctcagttaggacccagagggaaccatggaagccccagctcagcttctcttcctcctgctactctggctcccagtgaccaccggagaaattgtgttgacacagtctccagccacctgtccttgtctccgaggggaaanagcccaccctctcctgcgagggccagtcagagtgtgcactacgagcctaggaccaanagactctggccaggcctccgaggctcctctatttagngatnacacaccaacgcggaccacgtcggcccgtaccgacgtccgtaggttcgaggtcggacgtaggtccgggtacgtacgggactacgttacctacctacctcctaccacctacgtaccgacgacgacgtaccgtaagacgtacgtagtaacgtttagtttacgttactttattttacgttacgtacgtacgacgtacgtacggtcgtacgtacgtaggtcgttacttccgtacgttacggttacgggacgggtaacggtaacgacgggtacgacgaaccggtagtacgtacgtcggtcgacctcgaccaaccgttacgttaccgttacgttaccttccgtcccttacccgc

SEQ ID NO: 420068 - DNA, 622 bp, Homo sapiens
  misc_feature: GZ8MTXP02H2PBS.9.24.C02.1.454.CMB.2.raw
  modified_base (202)..(202): a, c, t, g, unknown or other
  modified_base (214)..(214): a, c, t, g, unknown or other
  modified_base (270)..(270): a, c, t, g, unknown or other
tcagtgatacgtctcacgaccggtgctcgatttagtacagatcgttagggaaagggggaggaactgctcagttaggacccagagggaaccatggaagccccagctcagcttctcttcctcctgctactctggctccagtgaccaccggagaaattgtgttgacacagtctccagccaccctgtccttgtctcgaggggaaangccacctctccngcagggccagtcagagtgttggcactacgtagcctggtaaccaacagaactcccgnggcccaggcctccccgaggcctcctcatttatgatgcactccaacagggccagtcggccgtcccagccaggttcaggtggctaggtcggggtctggggacaggtacttcacttcacacatcagcagcctagacgccgtagaagttattcgtattattttatactgttacacgtacagtcgttcgaccgtaaggtcgggtcctttcgtaccggttaaccgtttcggggacggggtaacggggaaccgtaaaggggacggaacggaaccgaagggaaacgtaaaccggttcggtacggccgtggaccgaaccgtacttacggtcgtttaccttccgtaaccgtttccctccccg

SEQ ID NO: 420069 - DNA, 722 bp, Homo sapiens
  misc_feature: GZ8MTXP02JGYFC.9.24.C02.1.454.CMB.2.raw
  modified_base (203)..(203): a, c, t, g, unknown or other
  modified_base (261)..(261): a, c, t, g, unknown or other
  modified_base (302)..(302): a, c, t, g, unknown or other
tcagtgatacgtctcacgaccggtgctcgatttagtacagatcgttagggaaagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaanagccaccctctcctgcagggccagtcagagtgttggcactacgtagcctggtaccaanagaactccgtggccaggcctcccgaggcctcctctatttangatgactatccaaacgagggccctaacgtcggccgtccccgagccctaggttccaggtcggctaggtcggggtcgtaggggactaggtaccttccgacttccgtaccaaccctatccaacgcctaacgccctaaggaccgtacccgttaggaaagttacgtttttagacctttaatttttaactttaaccgttgttaccgagtaccgtaaggtccggttacgtacccgtaaaggttcgggtaccctttcgttaccgttaaccggtttcggggaacgggttaacgggggaacccgtaaagggggtacgggaaaccgtaaccgaacgggtaaaccggtaaacgttcgggtacgggtaccgtcggaaccctaaccgtaactttccgttacgttccctttacgtaccgtttaccctttcccccg

SEQ ID NO: 420070 - DNA, 638 bp, Homo sapiens
  misc_feature: GZ8MTXP02HQ8EM.9.24.C02.1.454.CMB.2.raw
  modified_base (203)..(203): a, c, t, g, unknown or other
  modified_base (299)..(299): a, c, t, g, unknown or other
  modified_base (393)..(393): a, c, t, g, unknown or other
tcagtgatacgtctcacgaccggtgctcgatttagtacagatcgttagggaaagggggaggaactgctcagttaggacccagagggaaccatggaagccccagctcagcttctcttcctcctgctactctggctcccagtgaccaccggagaaattgtgttgacacagtctccagccaccctgtccttgtctccaggggaaanagccaccctctcctgcagggccagtcagagtgttgcacctagagccctggtaccaacagaactccgtggccaggcctcccaggcctcctcatttangatgcactcccgaaacgacggggcccacgtggccgtccccaggcccgaggttcaggtggcaggtcgggtctggggacagacttcactctcaccntccagcagccctagacgccgtagaagtacttttgtacttatttttattacttgttacagtactacgtcgtcgaccgtaggttcggtctttcgtccgtacgtttccggggacggggtaacggggtacccggaaaggggttacgggaacggaaccggaacggaaccggtaaacggttcggtacgggccgttacggacctaaccgtacttccgttcgttcctttaccgttacctttttccccgtaccc

SEQ ID NO: 420071 - DNA, 612 bp, Homo sapiens
  misc_feature: GZ8MTXP02HB9FP.9.24.C02.1.454.CMB.2.raw
  modified_base (204)..(204): a, c, t, g, unknown or other
  modified_base (262)..(262): a, c, t, g, unknown or other
  modified_base (301)..(301): a, c, t, g, unknown or other
tcagtgatacgtctcacgaccggtgctcgatttagtacagatcgttagggaaagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaangccaccctctcctgcagggccagtcagagtgttggcacctacgtagcctggtaccaanagaactcctggccaggctcccaggcctcctcattttagngatgacactaccaacgcggacctacgtcggcccgtcccgacgtccgtaggttcaggtcggacgtagggtcgggtcgtagggacacgtaccttccacttcctccacactacgagcacgacctagacgtacgtagtaagttatttgtactttattttacttacgtgtactagacgtagtcgtacgacgtaggtcgtcttcgtacgttacggttcgggacgggtacggaccgtaagggtacggaacgacgaggaacgtacgtcggcgacgtacgactaacgtacgtcgttcgttacttacttcccgtacctacg

SEQ ID NO: 420072 - DNA, 628 bp, Homo sapiens
  misc_feature: GZ8MTXP02G2JSP.9.24.C02.1.454.CMB.2.raw
  modified_base (204)..(204): a, c, t, g, unknown or other
  modified_base (305)..(305): a, c, t, g, unknown or other
tcagtgatacgtctcacgaccggtgctcgatttagtacagatcgttagggaaagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaanagccaccctctcctgcagggccagtcagagtgttggcacctagtagcctaggtaccaacagaactccgtggccaggcctcccgaggcctcctcattttagngatgactactaccgaacgacggcccacggtcggcccgtacccaggtccgtaggttcgagggtcggacgtaggttccggggtcgtaggggaactagtacttaccacttcctaccacctagtaccgacgaccgacgtcccgtagacgtaccgtagtaagttagtttagtactttaattttacttacgtagtactagtacgtagtcgtacgacgtagtcgtacttcgtcgtacgttcggacggtacggacgtaggacggacgacgagacgtacgtcggtacgcgtacgacaacgtactacgtacgttctacgtacttcccgtcccg

SEQ ID NO: 420073 - DNA, 696 bp, Homo sapiens
  misc_feature: GZ8MTXP02FXAK9.9.24.C02.1.454.CMB.2.raw
  modified_base (265)..(265): a, c, t, g, unknown or other
  modified_base (294)..(294): a, c, t, g, unknown or other
  modified_base (301)..(301): a, c, t, g, unknown or other
tcagtgatacgtctcacgaccggtgctcgatttagtacagatcgttagggaaagggggaggaactgctcagttaggacccagagggaaccatggaagccccagctcagcttctcttcctcctgctactctggctcccagtgaccaccggagaaattgtgttgacacagtctccagccaccctgtccttgtctccgaaggggaaagacgcccaccctctcctgcagggccagtcagagtgttggcactacgtagcctggtaccaanagaatcctggccaggctcccaggctcctntatttangatgcactaccaaacgacggccacgtcggcccgtacccgagtcccgtagggttcagggtcggcgtaggggtccggggtaccgtaggggaactacgtaccttacacttccaccacctatccgagaccacgacccgtaagacgtaccgtagtaaagttattttacgtactttaatttttaacttacgttacgtacgacgtacgtaggtccggtacgaccgtaggttcggtacctttccgtacgttaccggtttcggggacggggtaacgggtaacggtaaggggtacgggaaacggaaccggaacggtaaaccggtaacggttcggtacggtacgtaccgtaccgaaccgttacgttaccgttacggttacctttacgtacctttccccgttacccg

SEQ ID NO: 420074 - DNA, 644 bp, Homo sapiens
  misc_feature: GZ8MTXP02HKWKK.9.24.C02.1.454.CMB.2.raw
  modified_base (203)..(203): a, c, t, g, unknown or other
  modified_base (301)..(301): a, c, t, g, unknown or other
tcagtgatacgtctcacgaccggtgctcgatttagtacagatcgttagggaaagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaanagccaccctctcctgcagggccagtcagagtgttggcacctagtagcctggtaccaacagaatcctggccaggcctcccgaggcctcctctatttagngatgactactaccgaacgacggccacgtcggcctccagtccgtaggttcaggtcggacgtagggtccgggtcgtagggactacgtccttacactcctaccactatccgagacacgtactagacgtcgtagtaagttatttagtactttatttacttactagtacgagtacgtaggtcgtacgtacgtaggttcgttacctttacgttaccgttacggttacggggacgggtaacgggtaacgtaacggggtacggaaccgaaccggaaaggtaaccgtacggtcggtaccgcgtacgaccctaacgtcgtcgttacgttaccttactacctttcccgtacccg

SEQ ID NO: 420075 - DNA, 806 bp, Homo sapiens
  misc_feature: GZ8MTXP02F76QV.9.24.C02.1.454.CMB.2.raw
  modified_base (205)..(205): a, c, t, g, unknown or other
  modified_base (264)..(264): a, c, t, g, unknown or other
  modified_base (302)..(302): a, c, t, g, unknown or other
tcagtgatacgtctcacgaccggtgctcgatttagtacagatcgttagggaaagggggaggaactgctcagttaggacccagagggaaccatggaagccccagctcagcttctcttcctcctgctactctggctcccagtgtaccaccggagaaattgtgttgacacagtctccagccaccctgtccttgtctccgaggggaaangcccaccctctcctgcagggccagtcagagtgttggcacctacgtagcctggtaccaanagaatcctggccaggcctcccaggcctcctctatttangatgaccatacccaaacgacggggcccacgtcggcccgtaccccgacggccgtagggtttcaggttcggaccgtaggggttccggggtccgtaggggacctaacggtacctttaccaccttcctacccgaaccctagttcccgaaaggccctaacgggtacccgttaacggacgtacccgtaacgtaaagtttagtttttacggtactttaacgtttttaactttaaccgttacgtttaccgaacggttaccgtacggttaccggtacggtacccgtaaacgggttcgggttacctttcccgttaccggtttaccgggttttacccggggaacgggggttaaccgggggaaacccgggtaaaagggggttaccgggtaaaacgggtaacccggaaacgggtaacccgggtaaaacggttcgggtacgggtaccgttaccggaccctaaccgttacgttaccgtttacggtttcccttaacgttaccgtttcccctttacccccg

SEQ ID NO: 420076 - DNA, 579 bp, Homo sapiens
  misc_feature: GZ8MTXP02IKRU0.9.24.C02.1.454.CMB.2.raw
  modified_base (204)..(204): a, c, t, g, unknown or other
tcagtgatacgtctcacgaccggtgctcgatttagtacagatcgttagggaaagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaaanagccaccctctcctgcagggccagtcagagtgttggcacctacgtagcctggtaccaacagaactcctggccaggcctcccaggcctcctcatttatgatgcatccaaacaggggccacgtggccgtcccagccgtaggttccagtggctaggtcggggtctggggacagtacttcactctccacatcagcagcctagagtcctagaacgtattttgacttattttattactgtacacgctagcgtcgccaagtcgtcttcgtctacgtttcgggacggtacgggaccgtaagggtcggaacgaccgaggaaccgtaaacgtgtacggctacgaccgaaccgtattcgtcgttccttctaccttccgttaccccg

SEQ ID NO: 420077 - DNA, 762 bp, Homo sapiens
  misc_feature: GZ8MTXP02FVMEU.9.24.C02.1.454.CMB.2.raw
  modified_base (203)..(203): a, c, t, g, unknown or other
  modified_base (300)..(300): a, c, t, g, unknown or other
tcagtgatacgtctcacgaccggtgctcgatttagtacagatcgttagggaaagggggaggaactgctcagttaggacccagagggaaccatggaagccccagctcagcttctcttcctcctgctactctggctcccagtgaccaccggagaaattgtgttgacacagtctccagccaccctgtccttgtctccgaggggaanacgccaccctctcctgcagggccagtcagagtgttggcactagtagcctggtaccaacagaatccgtggccaggctcccgagcctcctctattttangatgctactaccaaacgacgggcccacgtcggtcccgtaccccacggtcccgtagggtttccagggtcgggacgtacggggtcggggttaccgtagggggaaacctacgggttaccctttaccgaacccgtttccaccgtaaacccctaagttccccgaaaggacctaaccggtacccgttaaaggaccgtacccgttaaggtaaaacgtttagtttttacgtactttaacttttttaacgttaccgttgtaacgtacggtacgtaaccggtcgggtaccgtaccggttaaggttcgggttccctttaccgttccgttaaccgggtttccggggacggggtaacggggaaccgtaaacgggggtagaaccgggaaaccgtaggggtaaaccgtaaacggttggtaccgggtctacgacccgtaactcgttcgttacgttcgtttaccacctttcccgtcccg

SEQ ID NO: 420078 - DNA, 795 bp, Homo sapiens
  misc_feature: GZ8MTXP02GYPB6.9.24.C02.1.454.CMB.2.raw
  modified_base (203)..(203): a, c, t, g, unknown or other
  modified_base (299)..(299): a, c, t, g, unknown or other
  modified_base (307)..(307): a, c, t, g, unknown or other
tcagtgatacgtctcacgaccggtgctcgatttagtacagatcgttaggggaaagggggaggaactgctcagttaggacccagagggaaccatggaagccccagctcagcttctcttcctcctgctactctggctccagtgaccaccggagaaattgtgttgacacagtctccagccacctgtccttgtctccgaggggaaanacgccaccctctcctgcgagggccagtcagagttgttggcacctacgtagcctaggtaaccaacagactcgtggccaggcctaccgaggcctcctntatttacngatcgacactaccgaacgcgggcccacgtcggccgtcccacggtccgtaggttacgaggttcggcgtaggggtccggggtacgtacggggaactacggttacccttacgacccttcctaccaacctactccgaacggtccgaaacgtcccgtaaaggaccgtaccgtaaggtaaacgtttacgtttttacgtacctttttaagtttttaacgtttacgttcggttaccgagggtaccttacgggttaccgtcgggtaaccgttaagggttccggtttacctttaccggttaccggtttaccggggtttaccgggggaaccggggttaccggggtaacccgggtaacggggttacgggaaacccggtaaaccgggtaacggtaaacccggttaaggttcggggttaccgggcccgttaaccggaccctaaccggtttaccgtttcgtttcccgtttacgtaccctttacccgtttcccccggtaccccg

SEQ ID NO: 420079 - DNA, 504 bp, Homo sapiens
  misc_feature: GZ8MTXP01EDW1L.9.59.F04.1.454.CMB.2.raw
  modified_base (201)..(201): a, c, t, g, unknown or other
  modified_base (314)..(314): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganacacagtcaccatcaattgtcgggcgagtcaggatgttggcgaccgcttagtctggtatcagcaagaaaccaggaaaggcctagactctaatctatggtgcgtccggttgcanagtgcgtccaggaacattcagcggcggtggatcgtagggcagatttcactctcaccatcaatcacctgacaggctgagtatttgactaacttactactgtcagcaggctaacacggctcgaccccaacttcgggccaggggacacgacgtggaagagttaaacgactggtaggctgcacctaattcgtcg

SEQ ID NO: 420080 - DNA, 504 bp, Homo sapiens
  misc_feature: GZ8MTXP01EM6ZL.9.59.F04.1.454.CMB.2.raw
  modified_base (200)..(200): a, c, t, g, unknown or other
  modified_base (417)..(417): a, c, t, g, unknown or other
  modified_base (425)..(425): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtggctgcatctgtggganactcagtcaccatcaattgtcggcagtcaggatgttggcgacgcttagtctggatcagcaagaaaccaggaaaagccctagactcctaatctatggtagcgtccggttgcacagtgtcgtcccaggaacgattcagcggcggtgatcgtagggcagatttcactctcacatcaatcacctgcaggctgaggtatttgactaactttacactgtcagnaggctaanaggctcgaccccaacgttcggccaaggggacaccggatggaagaattaaacggacttggagctacgcttaccaattctg

SEQ ID NO: 420081 - DNA, 521 bp, Homo sapiens
  misc_feature: GZ8MTXP01D6SIK.9.59.F04.1.454.CMB.2.raw
  modified_base (200)..(200): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtggctgcatctgtggganactcagtcaccatcaattgtcgggcagtcaggatggttggcgaccgcttagtctggtatcagcaagaaaccaggaaaggcctagactcctaatctatggtgcgtccggttgcacagtggcgtcccaggaacgattcagcggcggtgatcgtagggcagtatttcactctcacatcaatcactgacaggctgagtatttgactaacttactactgtctagcaggctaacaggcctcgacccctaaccgttccgggaaccgacggggacacgacgtaggaacgttaagttaaacgaactggtaggctgcacctaagttcttcg

SEQ ID NO: 420082 - DNA, 556 bp, Homo sapiens
  misc_feature: GZ8MTXP01DG449.9.59.F04.1.454.CMB.2.raw
  modified_base (200)..(200): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtggctgcatctgtggganactcagtcaccatcaattggtcgggcagtcaggatgttggcgacgcttagtctggtatcagacaagaaaccgaaggaaaacggcctaagacctacctaatctagtggtgccgttcccggttgcacgaggtcggaccgtacccgaaggaacgattcgaggcggcggtaggatcgtagggcagtactttcactctacacatcaatcactgcagctgagtatttgactaacttacgtactgtacagcaggactaacgacggcctccggaccccctaacgttccgggaaccgaggggaccacggacgtaggaacgttaaacttaaacggactggtacggctcggacacctaattcgttcg

SEQ ID NO: 420083 - DNA, 598 bp, Homo sapiens
  misc_feature: GZ8MTXP01EG2S8.9.59.F04.1.454.CMB.2.raw
  modified_base (201)..(201): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgtcgggcgagtcaggatgttggcgaccgcttagtctggtatcagcaagaaaccgaaggaaacgcctagacctactaatctagtggtcgcggttcccggtgacacgtaggtcggccgtacccgaagggtaacgtacttacgagggccggggtacggggttagggaattccgggtaaggggccaaggttactttccacttctaccacctataccaatcacctgcaggtctagagttatttgacttaacttactattgtcagcaaggtctaaacgcggccttcccgaccccctaacgttcccgggaaccgaacgggggaccacggacgtagggaacgttaacgttaaacgacgttggtaggcttgaccacctaagttcttcg

SEQ ID NO: 420084 - DNA, 538 bp, Homo sapiens
  misc_feature: GZ8MTXP01BLATP.9.59.F04.1.454.CMB.2.raw
  modified_base (200)..(200): a, c, t, g, unknown or other
  modified_base (412)..(412): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtgctgcatctgtggganactcagtcaccatcaattgcgggcgagtcaggatggttggcgaccgtcttagtctggtatcagcaagaaaccgaggaaaacggcctagactactaatctatggtcgcgtcccggttgcacgaggtcggcgtacccgaaggaacgtattcgaggcggcggtaggatcgtagggcagtactttcactctcacatacaatcactgcagctgagtntttcgactaacttatactgtcagcgaggctaacgacggcctccgacccctaacgtcgggaaccgaggggacacgacgtaggaagttaacgttaacgacgtggtacggctcgccaactcgttcttcg

SEQ ID NO: 420085 - DNA, 507 bp, Homo sapiens
  misc_feature: GZ8MTXP01CT94N.9.59.F04.1.454.CMB.2.raw
  modified_base (201)..(201): a, c, t, g, unknown or other
  modified_base (398)..(398): a, c, t, g, unknown or other
  modified_base (431)..(431): a, c, t, g, unknown or other
  modified_base (476)..(476): a, c, t, g, unknown or other
  modified_base (507)..(507): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgtcgggcgagtcaggatggttggcgaccgcttagtctggtatcagcaagaaaccaggaaaaggccctagactcctaatctatggtgcgtccggttgcacgagtgtcgtccaggaacgattcagcggcggtggatcgtaggggcagtattcactctcacatcaatcactgcaggctgagntttgactaacttactacttgtcagcaggctaanacggctcgccccaacgttccggaacgaggggacacgacgtggganaagttaacgactgtagctgcactaattcgtn

SEQ ID NO: 420086 - DNA, 507 bp, Homo sapiens
  misc_feature: GZ8MTXP01EPI48.9.59.F04.1.454.CMB.2.raw
  modified_base (199)..(199): a, c, t, g, unknown or other
  modified_base (232)..(232): a, c, t, g, unknown or other
  modified_base (244)..(244): a, c, t, g, unknown or other
  modified_base (288)..(288): a, c, t, g, unknown or other
  modified_base (296)..(296): a, c, t, g, unknown or other
  modified_base (489)..(489): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtggctgcatctgtgganactcagtcaccatcaattgtcgggcagtcaggntgttggcgacgnttagtctggatcagcagaaaccaggaaagccctagactcctaanctatggtncgtcccgtgcacagtgcgtccagagattcgagcggcggtgatcgtagggcagtactttcactctcacatcaatcacctgcaggctggtaggtatttagctaacttacgtactgtccagcaggcctaaacgcggcctccgcccccaaccgttcgggccaggggaccacgcgtagggacaagttaaacgacttgngctgcacctaattcgtcg

SEQ ID NO: 420087 - DNA, 537 bp, Homo sapiens
  misc_feature: GZ8MTXP01BJGMC.9.59.F04.1.454.CMB.2.raw
  modified_base (312)..(312): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagactcagtcaccatcaattgtcgggcgagtcaggatggttggcgaccgcttagtctggtatcagcaagaaaccaggaaacgcctagactctaatctatggtgcgtccggttncagagtgcgtccaggaacgattcaggcggcggtggatcgtagggcagatttcactctcaccatcaatcacctgacagctagaggtatttgactaacttactactgtcagcaggctaacgaggctccgccccctaacgttccggccgaggggaccacggacgtagggaagttaacgttaaacgttacgtggttacggcttcggaccttaccgtaacttcgttaacg

SEQ ID NO: 420088 - DNA, 496 bp, Homo sapiens
  misc_feature: GZ8MTXP01DIB1N.9.59.F04.1.454.CMB.2.raw
  modified_base (199)..(199): a, c, t, g, unknown or other
  modified_base (467)..(467): a, c, t, g, unknown or other
  modified_base (491)..(491): a, c, t, g, unknown or other
tcagtgatacgtctcacgaccggtgctcgatttagtacacacacttagggattgggggcaggagtcagacccagtcaggacacagcatggacatgagggtcccgctcagctcctggggctcctgctgctctggttcccggttcgagatgcgacatccagatgacccagtctccatcttccgtggctgcatctgtggganactcagtcaccatcaattgtcgggcgagtcaggatgttggcgacgcttagtctggatcagcaagaaaccaggaaaaggcctagactctaatctatggtgcgtccggttgcacagtggcgtccaggaacgattcagcggcgtggatcgtagggcagatttcactctcaccatcaatcactgcaggctgagtatttgactaacttacgtactgtcagcaggctaacgaggctcgcccccaacgttcggaaccaggggacacggctagganagttaacgactgtaggctgcactnttctg

SEQ ID NO: 420089 - DNA, 537 bp, Homo sapiens
  misc_feature: GZ8MTXP01CWIPD.9.59.F04.1.454.CMB.2.raw
  modified_base (201)..(201): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganacacagtcaccatcaattgtcgggcagtcaggatgttggcgacgcttagtctggatcagcaagaaaccaggaaaaggccctagactcctaatctatggtgcgtcccggttgcacagtggcgtcccaggaacgattcaggcggcggtaggatcgtagggcaagtatttcactctcaccatacaatcacctgcaggctagagtatttgactaacttacgtactgtcagcaggctaacgaggcctcgccccctaacgttcggaaccgaaggggaccacggacgtaggaacgttaacgttaaaacgacgtggtaggcttacggcttacctaagttcttcg

SEQ ID NO: 420090 - DNA, 497 bp, Homo sapiens
  misc_feature: GZ8MTXP01CITV8.9.59.F04.1.454.CMB.2.raw
  modified_base (201)..(201): a, c, t, g, unknown or other
  modified_base (301)..(301): a, c, t, g, unknown or other
  modified_base (464)..(464): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganacacagtcaccatcaattgtcgggcagtcaggatgttggcgaccgcttagtctggatcagcagaaaccaggaaaaggccctagactcctaatctatggtncgtcccggttgcacagtggcgtcccaggaacgattcgagcggcggtggatcgtaggggcagatttcactctcacatcaatcactgcaggctgagatttgctaacttactactgtcagcaggctaacagctcgccccaacttcggccaggggcacgcgtagganacgttaaacgactgtacggctgcaccaattctg

SEQ ID NO: 420091 - DNA, 525 bp, Homo sapiens
  misc_feature: GZ8MTXP01CH8MM.9.59.F04.1.454.CMB.2.raw
  modified_base (201)..(201): a, c, t, g, unknown or other
  modified_base (314)..(314): a, c, t, g, unknown or other
  modified_base (334)..(334): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganacacagtcaccatcaattgcgggcagtcaggatgttggcgaccgcttagtctggtatcagcaagaaaccaggaaaacggccctagactcctaatctatggtgcgtcccggttncacagtgcgtcccaggaacnttcgagcggcggtagatcgagggcagtattcactctcacatcaatcacctgcaggtctagaggtatttgactaacttacgtactggttcacgcaaggctaacgacggcctcgaccccaaccgttccggaacgtacggggacacgacgtaggagaacgttaacgaacgtgaggctgcacctaagttcgttcg

SEQ ID NO: 420092 - DNA, 517 bp, Homo sapiens
  misc_feature: GZ8MTXP01ED13I.9.59.F04.1.454.CMB.2.raw
  modified_base (201)..(201): a, c, t, g, unknown or other
  modified_base (337)..(337): a, c, t, g, unknown or other
  modified_base (476)..(476): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgtcgggcgagtcaggatggttggcgaccgcttagtctggtatcagcaagaaaccaggaaaaggccctagactcctaatctatggtgcgtccggttgcacgagtggcgtccgaggaacnttcagcggcggtggatcgtagggcagatttcactctcaccatcaatcactgcaggctgaggtatttgactaacttactactgtcagcaggctaacgaggctcgaccccaaccttcggaaccgaggggacacggttacgnggaagaacttaaacgactggtggctgcacctaagttcttcg

SEQ ID NO: 420093 - DNA, 537 bp, Homo sapiens
  misc_feature: GZ8MTXP01BVTWO.9.59.F04.1.454.CMB.2.raw
  modified_base (513)..(513): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatggttggcgaccgcttagtctggtatcagcaagaaaccaggaaaaggccctagactcctaatctatggtgcgtccggttgcacgagtcggcgtcccaggaacgattcgaggcggcggtgggatcgtagggcagatttcactctcacatcaatcacctgcaggctgagtatttgactaactttacgtactgtccagtcaggctaacgaggcctccgccccctaaacgttccgggaaccagggggacacggacgtgggaattaacgttaaacgacttggnggaactggccacctaattcgttcg

SEQ ID NO: 420094 - DNA, 531 bp, Homo sapiens
  misc_feature: GZ8MTXP01AR8N3.9.59.F04.1.454.CMB.2.raw
  modified_base (201)..(201): a, c, t, g, unknown or other
  modified_base (311)..(311): a, c, t, g, unknown or other
  modified_base (358)..(358): a, c, t, g, unknown or other
  modified_base (394)..(394): a, c, t, g, unknown or other
  modified_base (523)..(523): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatctagatgacccagtctccatcttccgtggctgcatctgtggganacacagtcaccatcaattgtcgggcgagtcaggatgttggcgaccgcttagtctggtatcagcagaaaccaggaaaaggcctagactcctaatctatggtgcgtccggtncacagtggcgtcccaggaacgattcgagcggcggtggatcgtagggnagatttcactctcacatcaatcactgcagctgagtntttgctaacttactaactgtacagtcaggctaaacgacggcctaccgccccctaaaccgttccgggaaccgacgggggacacggaccgtagggacgttaagttaacggaactggtacgctgccaacctnttcgttcg

SEQ ID NO: 420095 - DNA, 521 bp, Homo sapiens
  misc_feature: GZ8MTXP01B68A3.9.59.F04.1.454.CMB.2.raw
  modified_base (201)..(201): a, c, t, g, unknown or other
  modified_base (481)..(481): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgcgggcgagtcaggatggttggcgaccgcttagtctggatcagcaagaaaccaggaaacggcctagactcctaatctatggtgcgtccggtgcacgagtcggcgtcccaggaacgattcagcggcggtgatcgtagggcagatttcactctcaccatacaatcacctgacgagctgagtatttgactaacttatactgtcagcaggctaagacggtcctcgaccccctaacgtccggaaccgaggggacacgacgtaggaanaacgttaaacgactggacggtctgccactaacgttcttcg

SEQ ID NO: 420096 - DNA, 550 bp, Homo sapiens
  misc_feature: GZ8MTXP01AR0FB.9.59.F04.1.454.CMB.2.raw
  modified_base (201)..(201): a, c, t, g, unknown or other
  modified_base (309)..(309): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgcgggcagtcaggatgttggcgaccgcttagtctggtatcagcaagaaaccaggaaacgccctagactctaatctatggtgcgtccggtncacgagtcggctccgaggaacgacttcgaggcgggacggtggattcgtaggggctagtactttcactctcacctatacaatcacctgaccaggtctagacggttatttgacctaacttacgtactgtcagcagtctaacgcggcctccgacccctaacgtcggaaccgaaggggttacacggacgtagggaacgttaacgttaaacgacgttggcggctacgacttacctcgttcgttccg

SEQ ID NO: 420097 - DNA, 564 bp, Homo sapiens
  misc_feature: GZ8MTXP01BYWOD.9.59.F04.1.454.CMB.2.raw
  modified_base (200)..(200): a, c, t, g, unknown or other
  modified_base (315)..(315): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtggctgcatctgtggganactcagtcaccatcaattgcgggcgagtcaggatggttggcgaccgtcttagtctggtatcagcaagaaaccaggaaacgcctagacctactaatctagtggtgcggttccggtncacgaggtcggcgtacccaagggtaacgattcgaggcggtcggtaggatcgtagggctagtactttcactctacaccatacaactcactgacaggctagaggtatttgactactttacgacttgtcagacgaggtacctaacgacggcctacccgacccctaaccgttccgggaaccggaacggggaccacggacgtagggaacgttaaacgttaaacgacgtggcggctacgcacctaagttcgttcg

SEQ ID NO: 420098 - DNA, 546 bp, Homo sapiens
  misc_feature: GZ8MTXP01AXUBD.9.59.F04.1.454.CMB.2.raw
  modified_base (201)..(201): a, c, t, g, unknown or other
  modified_base (311)..(311): a, c, t, g, unknown or other
  modified_base (433)..(433): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganacacagtcaccatcaattgtcgggcagtcaggatgttggcgacgcttagtctggtatcagcaagaaaccaggaaaaggcctagactcctaatctatggtgcgtccggttncacagtggcgtccgaggaacgattcgagcggcggtggatcgtagggcagtatttcactctcaccatcaatcactgcagctgagtatttgactaacttacgtactgtcagcaggactaaacgngcctcgacccccaaaccgttcgggaacccagggggaccacggacgtagggaacttaacgttaaaacggaacgttcggtagggtcctcggaccttaccctaattccggtttccg

SEQ ID NO: 420099 - DNA, 514 bp, Homo sapiens
  misc_feature: GZ8MTXP01DG6RO.9.59.F04.1.454.CMB.2.raw
  modified_base (201)..(201): a, c, t, g, unknown or other
  modified_base (334)..(334): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganacacagtcaccatcaattgtcgggcgagtcaggatgttggcgaccgcttagtctggtatcagcaagaaaccaggaaagcctagactctaatctatggtgcgtcccggttgcacagtcggcgtcccaggaacgnttcgagcggcggtggatcgtagggcagtattcactctcaccatcaatcacctgcaggctgaggtatttgactaacttactactgtcagcaggctaacaggctcgtacccccaacgttccggcgaggggacacggacgtggaagttaagttaaacgactggtggctgcacctaattcttcg

SEQ ID NO: 420100 - DNA, 509 bp, Homo sapiens
  misc_feature: GZ8MTXP01BBFW4.9.59.F04.1.454.CMB.2.raw
  modified_base (201)..(201): a, c, t, g, unknown or other
  modified_base (300)..(300): a, c, t, g, unknown or other
  modified_base (311)..(311): a, c, t, g, unknown or other
  modified_base (329)..(329): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgtcgggcagtcaggatggttggcgacgcttagtctggatcagcaagaaaccaggaaaaggcctagactctaatctatggtncgtccgtgcanagtcgcgtccgaggaacnttcaggcggcggtgatcgtagggcagtatttcactctacaccatacaatcacctgcagctgaggtatttgactaacttacgtactgtcagcaggctaacaggctacgcccctaacttcggaaccaggggccacgacgtagaagaagttaaacgacgtgtaggctggacacgaacttcgtg

SEQ ID NO: 420101 - DNA, 508 bp, Homo sapiens
  misc_feature: GZ8MTXP01C3GIA.9.59.F04.1.454.CMB.2.raw
  modified_base (201)..(201): a, c, t, g, unknown or other
  modified_base (307)..(307): a, c, t, g, unknown or other
  modified_base (329)..(329): a, c, t, g, unknown or other
  modified_base (477)..(477): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgtcggcagtcaggatgttgcgacgcttagtctggatcagcaagaaaccaggaaaaggcctagactctaatcatggtgcgtcccggttncacagtcggcgtcccaaggaanattcgaggcggcggtaggatcgtagggcagactttcactctcaccatcaatcacctgcaggctggagtatttgactaacttacgtactgtaccagccaggctaacacggctaccgccccaacgttcggcccaggggacacgagtgganagttaacgactgaggctgcacctaattcctg

SEQ ID NO: 420102 - DNA, 571 bp, Homo sapiens
  misc_feature: GZ8MTXP01EMM65.9.59.F04.1.454.CMB.2.raw
  modified_base (200)..(200): a, c, t, g, unknown or other
  modified_base (235)..(235): a, c, t, g, unknown or other
  modified_base (248)..(248): a, c, t, g, unknown or other
  modified_base (256)..(258): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtggctgcatctgtggganactcagtcaccatcaattgtcgggcagtcaggtanggttggcgaccgnttagtctnnnatcagacagaaacagaaagacctagactctaatctatgtgcgtccggttgcacagtcggcgtccaggaagattacagcggcgggtgggagtcgtagggcgagtatttctactctacaccaatacaactactacctgacgagtcgtagaggtagttttgtactaaacttaactactagtctaacgacgacggtactaaaccgacggtccgtccgacccccgaaacccgttaccggacccgaacggggaacgaaccgaaccgttacggtaaggtaacgttaaaacgtaaacgtacggttacggtcgttcgtaacg

SEQ ID NO: 420103 - DNA, 492 bp, Homo sapiens
  misc_feature: GZ8MTXP01E16S6.9.59.F04.1.454.CMB.2.raw
  modified_base (466)..(466): a, c, t, g, unknown or other
tcagtgatacgtctcacgaccggtgctcgatttagtacacacacttagggattggggcaggagtcagacccagtcaggacacagcatggacatgagggtccccgctcagctcctggggctcctgctgctctggttccccggttcgagatgcgacatccagatgacccagtctccatcttccgtggctgcatctgtgggagactcagtcaccatcaattgtcgggcgagtcaggatgttggcgaccgcttagtctggatcagcagaaaccaggaaaaggccctagactcctaatctatggtgcgtcccggttgcacagtgtcgtcccaggaagattcagcggcggtgggatcgtagggcagatttcactctcaccatcaatcacctgcaggctgaggtatttgacaacttactactgtcagcaggctaacaggctcgccccaacttcggcaggggacacgactgganattaacgactgtgctgcacaattctg

SEQ ID NO: 420104 - DNA, 516 bp, Homo sapiens
  misc_feature: GZ8MTXP01BY8WN.9.59.F04.1.454.CMB.2.raw
  modified_base (201)..(201): a, c, t, g, unknown or other
  modified_base (312)..(312): a, c, t, g, unknown or other
  modified_base (315)..(315): a, c, t, g, unknown or other
  modified_base (340)..(340): a, c, t, g, unknown or other
  modified_base (369)..(369): a, c, t, g, unknown or other
  modified_base (395)..(395): a, c, t, g, unknown or other
  modified_base (428)..(428): a, c, t, g, unknown or other
  modified_base (493)..(493): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgtcgggcagtcaggatggttggcgaccgcttagtctggtatcagcaagaaaccaggaaaacgccctagactctaatctatggtgcgtccggtncanagtgctccaggaacattcaggcggnggtaggatcgtagggcagtatttcactcncacatcaatcacctgacagctgagtntttagactaacttctactgtcagcaggcaaacncggctccgacccctaacgtccgggcaacgggacacgacgtggaagttaacgttaaacgactaagnggctgccactaacgttcttaacg

SEQ ID NO: 420105 - DNA, 525 bp, Homo sapiens
  misc_feature: GZ8MTXP01EBMIC.9.59.F04.1.454.CMB.2.raw
  modified_base (205)..(205): a, c, t, g, unknown or other
  modified_base (250)..(250): a, c, t, g, unknown or other
  modified_base (350)..(350): a, c, t, g, unknown or other
  modified_base (402)..(402): a, c, t, g, unknown or other
  modified_base (474)..(474): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagactnagtcaccatcaattgtcgggcgagtcaggatggttggcgaccgtnttagtctggtatcagcaagaaaaccgaggaaaacggccctagactacctaatctatggtgcgtccgtgcacgagtgcgtcccaggaacgatcgaggcggnggtaggatcgtagggcagtattcactctcacatcaatcactgcagctgagtntttgactaacttctactgtcagcaggactaacgacggcctccggacccctacgtcgggccaggggacacggngtaggaagttaacgttaaacgactggtcgaactcgaccaactcgttcttcg

SEQ ID NO: 420106 - DNA, 531 bp, Homo sapiens
  misc_feature: GZ8MTXP01DC8YB.9.59.F04.1.454.CMB.2.raw
  modified_base (202)..(202): a, c, t, g, unknown or other
  modified_base (403)..(403): a, c, t, g, unknown or other
  modified_base (416)..(416): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctcggttccccggttcgagatgcgacatccagatgacccagtctccatcttccgtggctgcatctgtggganacacagtcaccatcaattgtcgggcgagtcaggatggttggcgaccgcttagtctggtatcagcaagaaccaggaaacgcctagactctaatctatggtgcgtccggttgcacgagtcggcgtccgaggaacgattcgaggcggcggtaggatcgtagggcagtatttcactctcacatcaatcactgacaggctagagtntttgactaacttntactgtcagcaggctaacgacgcctccgacccctaaccgttccggaaccgagggaccacgacgtgggaacttaagttaacggaactggtacggcttaggccactaacttcgttcg

SEQ ID NO: 420107 - DNA, 565 bp, Homo sapiens
  misc_feature: GZ8MTXP01CAKOP.9.59.F04.1.454.CMB.2.raw
  modified_base (200)..(200): a, c, t, g, unknown or other
  modified_base (232)..(232): a, c, t, g, unknown or other
  modified_base (246)..(246): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttcgtggctgcatctgtggganactcagtcaccatcaattgcgggcagtcaggntggttggcgaccgnttagtctggtatcagacaagaaaccgaaggaaaacggccctaagacctactaatctagtggtgcgtcccggttgcacgagtcggcgtcccgaggaaacgtatcgaggtcggcggtaggactcgtagggctagtactttcactctacaccatcaatcactgacaggctagagtatttgactaacttactatcgtcaagcaaggaccttaagacggtcctaccgacccccgtaacgtccgggaaccgaaggggacaaccggagttagggaacttaaacgttaaacgacgtcggtaggtcctggcccaacgtcttcgttccg

SEQ ID NO: 420108 - DNA, 511 bp, Homo sapiens
  misc_feature: GZ8MTXP01C57TE.9.59.F04.1.454.CMB.2.raw
  modified_base (383)..(384): a, c, t, g, unknown or other
  modified_base (387)..(387): a, c, t, g, unknown or other
  modified_base (396)..(396): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagactcagtcaccatcaattgcgggcgagtcaggatgttgcgaccgcttagtctggatcagcagaaaccaggaaaaggcctagactcctaaatctatggtgcgtcccggttgcacagtggcgtcccaggaacgattcagcggcggtggatctagggcagatttcactctcaccatcaatcaccnnagntgagtattntactaacttaactactgtcagacagactaacagctcgaccccacccgtccggccgacgggacgacgacgtagaagaagttaaacgttaaacgtaagtgcgtgcactaacttcgtg

SEQ ID NO: 420109 - DNA, 511 bp, Homo sapiens
  misc_feature: GZ8MTXP01EJ21A.9.59.F04.1.454.CMB.2.raw
  modified_base (200)..(200): a, c, t, g, unknown or other
  modified_base (363)..(363): a, c, t, g, unknown or other
  modified_base (427)..(427): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtggctgcatctgtggganacacagtcaccatcaattgtcgggcagtcaggatgttggcgaccgcttagtctggtatcagcaagaaaccaggaaaaggcctagactcctaatctatggtgcgtcccggttgcacagtggcgtcccaggaacgattcaggcggcggtggatcgtaggggcagntttcactctcaccatcaatcacctgcaggctgaggtatttgactaacttacgtacttgtcaagnaggctacaggctcgccccaacttcggcccagggaccacgacgtggaattacgttaaacgactgtaggctgcacctaattcgtcg

SEQ ID NO: 420110 - DNA, 502 bp, Homo sapiens
  misc_feature: GZ8MTXP01ALRSY.9.59.F04.1.454.CMB.2.raw
  modified_base (199)..(199): a, c, t, g, unknown or other
  modified_base (243)..(243): a, c, t, g, unknown or other
  modified_base (398)..(398): a, c, t, g, unknown or other
  modified_base (423)..(423): a, c, t, g, unknown or other
  modified_base (432)..(432): a, c, t, g, unknown or other
  modified_base (475)..(475): a, c, t, g, unknown or other
  modified_base (495)..(495): a, c, t, g, unknown or other
tcagtgatacgtctcacgaccggtgctcgatttagtacacacacttagggattgggggcaggagtcagacccagtcaggacacagcatggacatgagggtccccgctcagctcctgggctcctgctgctctggttccccggttgagatgcgacatccagatgacccagtctccatcttccgtggctgcatctgtggganacacagtcaccatcaattgcgggcagtcaggatgtggcgaccgnttagtctggatcagcagaaaccaggaaagccctagactcctaatctatggtgcgtcccggttgctacgagtggcgtcccgaggacgattcgaggcggcggtagggatcgtaggggcaggatttcactctcaccatcaatcactgcaggctgagtntttgctaacttactactgtacagcnggctaaacnggcctcgcccctaacgtcgggccaggggttccacgacgtgganagttaacgatgtgctgcacnttcgtcg

SEQ ID NO: 420111 - DNA, 570 bp, Homo sapiens
  misc_feature: GZ8MTXP01AG2VI.9.59.F04.1.454.CMB.2.raw
  modified_base (202)..(202): a, c, t, g, unknown or other
  modified_base (419)..(419): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctggtggganacacagtcaccatcaattgtcgggcgagtcaggtatggttggcgaccgtcttagtctggtatcagacaagaaacgaggaaacgcctagactctaatctatggtcgccgtccggtgcacgaggtcggccgtacccgaggaacgattcgaggcgggcggtaaggactcgtagggctagtacttcactctacacatcaatcactgacgagtctggagttntttcgacttaacgttactactggtacagtacgagtcctaacgagggccctaccggaccccctaaccgttccgggaacaacgggggttaccacggacgtcgggaattaaacgttaacggacgtggtcggctcggccacgtaacttcgttccg

SEQ ID NO: 420112 - DNA, 561 bp, Homo sapiens
  misc_feature: GZ8MTXP01EYS4K.9.59.F04.1.454.CMB.2.raw
  modified_base (198)..(198): a, c, t, g, unknown or other
  modified_base (243)..(243): a, c, t, g, unknown or other
  modified_base (306)..(306): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtgctgcatctgtgganactcagtcaccatcaattgtcggcgagtcaggatgttggcgacgnttagtctggatcagcaagaaaccaggaaaacgccctagactctaatctatggtgcgtccggtncacagtcgtccgtacccgaggaaacgtcttcgaggtccggcgggttaaggattcgtaaggggcagtattttaccgactctaccacataccaagtcaacctgacagggtcaggaggtatttcgaactaacttactatgtacagcaaggactaacgacggtctcccgaccccctaacgtccgggaaccgtaggggaccaacgacgtagggaattaaacgttaacgacgtggacggctgccttaccaatttcgtaacg

SEQ ID NO: 420113 - DNA, 575 bp, Homo sapiens
  misc_feature: GZ8MTXP01A116C.9.59.F04.1.454.CMB.2.raw
  modified_base (202)..(202): a, c, t, g, unknown or other
  modified_base (226)..(226): a, c, t, g, unknown or other
  modified_base (230)..(230): a, c, t, g, unknown or other
  modified_base (234)..(234): a, c, t, g, unknown or other
  modified_base (246)..(246): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctggtggganactcagtcaccatcaattgcgggnagtnaggntgtggcgaccgnttagtctggtatcgagcaagaaaccgaaggaaaacggccctaagactacctaatctagtggtcgccgttcccggttgcacgaggtcggccgtacccgaggaacgcttcgaggcgggcgggtagggactcggtagggctaggtactttcgactctaccacatacatccactgccagctaggagttatttcgactaacgttactactggtcagcgaaggctaacgacggtcctcccgaccccctaaccggtcggaaccgtaacggggacacggacgtagggaattaacgttaaacgagtgttacggctcgacttacctaagttcgttaacg

SEQ ID NO: 420114 - DNA, 560 bp, Homo sapiens
  misc_feature: GZ8MTXP01APYZY.9.59.F04.1.454.CMB.2.raw
  modified_base (201)..(201): a, c, t, g, unknown or other
  modified_base (225)..(225): a, c, t, g, unknown or other
  modified_base (246)..(246): a, c, t, g, unknown or other
  modified_base (310)..(310): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgcgggnagtcaggatgttggcaccgtnttagtctggtatcagcaagaaaccaggaaacggcctagactcctaatctatggtgcgtccggtncgacgaggtcggcgtaccgaggaacgattcgaggcggcggtaggatcgagggcagtactttcactctacacatcatcacctgacaggctggtagtatttcgacttaacttactacgtgtacacggctacggtacctaaacgcgtacctcccgaccccgtaacgttccgggccgaacgggggttacacgaccgtagggtaattaacgttaaacggacgtgggtcggcgtcgaccacgtaacttcgttaacg

SEQ ID NO: 420115 - DNA, 535 bp, Homo sapiens
  misc_feature: GZ8MTXP01BLE6A.9.59.F04.1.454.CMB.2.raw
  modified_base (201)..(201): a, c, t, g, unknown or other
  modified_base (249)..(249): a, c, t, g, unknown or other
  modified_base (314)..(314): a, c, t, g, unknown or other
  modified_base (398)..(398): a, c, t, g, unknown or other
  modified_base (527)..(527): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgtcgggcgagtcaggatggttggcgaccgnttagtctggtatcagcaagaaaccaggaaaacgcctagactcctaatctatggtgcgtccggttncacgagtggcgtccgaggaacgattcgaggcggcggtaggatcgtaggggcagtactttcactctacaccatcaatcactgacngctgagtatttcgactaacttctacgtgtcagcaaggctaacgcggcctccgacccctaacgttccggccggacggggacacgacgtgggaattaacgttaaacgacgttgggacgcgtcgaccacctnttcgttcg

SEQ ID NO: 420116 - DNA, 567 bp, Homo sapiens
  misc_feature: GZ8MTXP01A4K8R.9.59.F04.1.454.CMB.2.raw
  modified_base (201)..(201): a, c, t, g, unknown or other
  modified_base (205)..(205): a, c, t, g, unknown or other
  modified_base (520)..(520): a, c, t, g, unknown or other
  modified_base (529)..(529): a, c, t, g, unknown or other
  modified_base (546)..(546): a, c, t, g, unknown or other
  modified_base (560)..(560): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtggctgcatcgtgtggganactnagtcaccatcaattgtcgggcgagtcaggatggttggcgaccgtcttagtctggtatcagacaacgaaaccgaggaaacgcctagactacctaatctagtggtcgcggttcccggttgccacgaggttcggaccgtacccgaaggaacgtagttcgaggccggtcgggtaggactcggtagggctaggtactttcacgttctaccacctatacaactcaccgtgacaggctaggagttattgacttacttactctgtcaacgtcaaggctaacgacggcctaccgaccccctacgtcgaaccggacgggacacgngtacggaanaacgttaacgacgttgngctcgcttaccgtnttcgttc

SEQ ID NO: 420117 - DNA, 593 bp, Homo sapiens
  misc_feature: GZ8MTXP01C2HS8.9.59.F04.1.454.CMB.2.raw
  modified_base (201)..(201): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtggctgcatcgtgtggganacacagtcaccatcaattggtcgggcgagtcaggtattggtggcgaccgtcttagtctggatcagcaagaaaccaaggaaaacgcctagacctacctaatctagtcggtgtccggtcccggttgcacgtagtcggccgtaccgaggtaacgattcgaggtcggcgtagatcgtagggcagtcttcactctacacctatcaactcactgacgaggtctaggtagttatttacgaccttaacttacggtacttggtacaggtacaacggtactaacgtacggccttacccgacccccgtaaacgttccggaaccgacggggacacggacgtagggacgttaaacgttaaacggactttgggcggtctacggacttaccctaagttcctttaacg

SEQ ID NO: 420118 - DNA, 722 bp, Homo sapiens
  misc_feature: GZ8MTXP01BSEXP.9.59.F04.1.454.CMB.2.raw
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtggctgcatctgtgggagactcagtcaccatcaattggtcgggcgagtcaggtatggttggcgaccgtcttagtctggtatcagacaagaaaccgaaggaaaacggcctaagactctaatctatggtgccgttccggtgcacgaggtcggcgtacccgaaggaacgtacttcgagggcgggcgggttaggaacgttcggtagggcctaaggtactttccacttctaccacctataccaaactcctaaccgttcgaccgtagggtacttagggtaaggttactttcggaaccttaaaccgtttacttaaccgttgtaccaacggtaccgtaacgggtaccttaaacggaccggtacccgtaccccggtacccccccgtaaaccggtttcccgggggaaccccggtaacgggggttaacccaaccgggttaaccggtaaacggggtaaaccgttaaaacggtttaaaaccgggttaaaccggttcgggttacgggaaccgttaccggacccgttaacccttaaccggtttccgtttaacccg

SEQ ID NO: 420119 - DNA, 630 bp, Homo sapiens
  misc_feature: GZ8MTXP01B6O5I.9.59.F04.1.454.CMB.2.raw
  modified_base (201)..(201): a, c, t, g, unknown or other
  modified_base (207)..(207): a, c, t, g, unknown or other
  modified_base (228)..(228): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtggctgcatctggtggganacaacngtcaccatcaattggtcgggngagtcgaggtattggttcggcgtaccgtcttagtctggtatcagacaagaaacgaggaaaacgcctagactactaatctagtggtcgccggttccgtagcgacgtaggtcggccgtacccgaaggaacgtagttacgagggccgggtacgggttaggacttcggtagggactaggttactttccactctacacctatacaactcacctgacgaggtctagaggttatttcgactaacttacgtactgtacagcaggtcctaacgacggtccctccgaccccctaaccgttccgggaaccgaacggggttaccaaccggttacgtaacgggtaacgttaaacgtttaaaacgggacgtttgggtacgtcgttcggacccttacgtaacgtttcccgttaaccg

SEQ ID NO: 420120 - DNA, 573 bp, Homo sapiens
  misc_feature: GZ8MTXP01AH35W.9.59.F04.1.454.CMB.2.raw
  modified_base (201)..(201): a, c, t, g, unknown or other
  modified_base (348)..(348): a, c, t, g, unknown or other
  modified_base (417)..(417): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattggtcgggcgagtcaggatgttggcgaccgtcttagtctggtatcagacaacgaaacgaggaaaacggccctaagacctcctaatctatggtgcgtccggtgcagagtggcgtccaggacatgaggcggnggtgatcgagggcagtattcactctacacatacaatcacctgacaggctgagtattgactacttacgtntgtcagcaggctaacaggcctccggaccccctaaaccgttccgggaacccgtaacgggggactaacccggaacgtacgggggtaaacttaaacggtttaaaaccggaccgttaaggggtacggtccgttcggaccttacccgttaattcgtttccg

SEQ ID NO: 420121 - DNA, 626 bp, Homo sapiens
  misc_feature: GZ8MTXP01CRDLM.9.59.F04.1.454.CMB.2.raw
  modified_base (202)..(202): a, c, t, g, unknown or other
  modified_base (252)..(252): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtggctgcatcgtggtggganactcagtcaccatcaattggcgggcgagtcgaggatggttggcgaccgtnttagtctggtatcagacaagaaaccgaaggaaaacggccctaagactactaatctagtggtgccgttccggttgcacgtaggtcggccgtacccgaggtaacgtattcgaggcggggtcggtagggatcggtagggctagtattcactcacactatacaactcaccgtgacgaggtctaggacggttattttacgaccttaaactttacgtacgttgtaccgaggtacaggacctaaacgcggtccctacccgaccccctaaccggttcccgggaaccggaacgggggttaccaaccggagttaacgggaacgttaaaacgttaaaccgaccgttgggtacgtccgtcggaccttaacccgttgttcccgtaag

SEQ ID NO: 420122 - DNA, 565 bp, Homo sapiens
  misc_feature: GZ8MTXP01D76Y7.9.59.F04.1.454.CMB.2.raw
  modified_base (200)..(200): a, c, t, g, unknown or other
  modified_base (307)..(307): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtggctgcatctgtggganactcagtcaccatcaattgcgggcgagtcaggatggttggcgacgtcttagtctggtatcagcaagaaaccaaggaaaacggcctagacctcctaaatctagtggtnccgtccggttgcacgagtcggcgtacccgaaggaaccgtattcgaggcggcggtgggaatcgtagggcaaggtactttcaactctacaacattaccaaatcgactgactaggctaggagtatttgactaacttacgtactgtacagacaggactaagacgctccgaccccctaacgtccggaacgacggggacacgacgtagggaacaagtttaaaacggacttgggtacgccggttaacgaccttactcgttcgtcg

SEQ ID NO: 420123 - DNA, 567 bp, Homo sapiens
  misc_feature: GZ8MTXP01EUHRI.9.59.F04.1.454.CMB.2.raw
  modified_base (200)..(200): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtggctgcatctgtggganactcagtcaccatcaattgtcgggcagtcaggatggttggcgaccgtcttagtctggtatcagacaagaaaccgaggaaacgccctagactcctaatctagtggtcgtccgtccggttgcacgaggtcggccgtacccgaaggtaacgattcgaggcgggtcggtagatcgtagggctagtactttcgactctacactatacaactcacctgacgaggtctagaggttactttagactaactttacgtacttgtcagcaggactaacgcggtcctccgaccccctacgttccgggaaccgaacggggacacgacgtaggaattaaacgttaacggacttggcggtctcgacacctaagttcttaacg

SEQ ID NO: 420124 - DNA, 603 bp, Homo sapiens
  misc_feature: GZ8MTXP01EH9RW.9.59.F04.1.454.CMB.2.raw
  modified_base (200)..(200): a, c, t, g, unknown or other
  modified_base (204)..(204): a, c, t, g, unknown or other
  modified_base (313)..(313): a, c, t, g, unknown or other
  modified_base (385)..(385): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtggctgcatctgtggganactnagtcacatcaattgcgggcagtcaggatggttggcgacgcttagtctggtatcgagcaaagaaaccaaggaaaacgccctagactactaatctatggtgccgtccggtncagagtcggcgtaccaggacgattcgaggcggcggtagatcggtagggctagtatttcactcacacatcaancaccgtgacgaggtctggtaacgtattttcgaaccttaacttacggtactgtacacgtacgaacggtacctaacgtacggcctaccggacccccctaaacggttcccgggaaccggtaacgggggacctaacggttacgtacgggtaaacgttaaacgtttaaaacccgggattcgggtacggtccttacggacccttaaaccgtctttcgttcccgg

SEQ ID NO: 420125 - DNA, 819 bp, Homo sapiens
  misc_feature: GZ8MTXP01BBNCX.9.59.F04.1.454.CMB.2.raw
  modified_base (199)..(199): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtggctgcatctgtgganactcagtcaccatcaagttggtcgggcgagtcgagggattggttcggcgtaccgtgttagtctggtatcagacaagaaaccgaggaaaacgcctagacctacctaatctagtggtcgtccggttcccggttgctacgtaggtccgggccgtacccgaagggtaacgtacgttacggacggggtccggggtaccggggttaagggtaacgttcgggtaacgggggtaccctaaagggtttaccttttacccgtaacccgttaccctttaaccccgaaacccttaaacttaacccctaaaacttcccccgtaaacccggttcgggaaacccggtacggggttaccgttaaggggttaaaccgggtttatttttaaccggaaaccctttaaacccttttacggttaaccgtttcggttaaccgtaacggaccgtaaaccgggtaaccgttaaaacccggccggggtaccccttaaaccccggtacccccccgtaaacccgggtttcccggggaaacccgggtaaacggggaacccgtaaccggttacgtaaagggggtaaacttaaacgttaaacggttacgtgggtcgaacgttcgacccttacgtaacgtttcgtttaacc

SEQ ID NO: 420126 - DNA, 528 bp, Homo sapiens
  misc_feature: GZ8MTXP01DZMV3.9.59.F04.1.454.CMB.2.raw
  modified_base (184)..(184): a, c, t, g, unknown or other
  modified_base (201)..(201): a, c, t, g, unknown or other
  modified_base (245)..(245): a, c, t, g, unknown or other
  modified_base (306)..(306): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgnggctgcatctgtggganacacagtcaccatcaattgcgggcagtcaggatgttggcgacgnttagtctggatcagcaagaaccaggaaacgcctagactctaatctatggtgcgtcccggtncacgagtcggcgtcccgaggaacgattcgaggcggcggtagggactcgtagggcaagtctttcactctacaccatcaatcactgcagctgagtatttcgactaacttacgtcttgtcagcaggactaacgacgcctccgaccccctaacgttccggccgaggggacacggacgtagggaacaacgttaacgaacgtggaggtctagccactaacttcgttcg

SEQ ID NO: 420127 - DNA, 560 bp, Homo sapiens
  misc_feature: GZ8MTXP01C129S.9.59.F04.1.454.CMB.2.raw
  modified_base (201)..(201): a, c, t, g, unknown or other
  modified_base (362)..(362): a, c, t, g, unknown or other
  modified_base (539)..(539): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaagttggtcgggcgagtcaggtatggttcggcgaccgtcttagtctggtatcgagacaaagaaaaccaagggaaaacggccctaagaacctcctaatctagtggtcgccgttccggttgcacgtagtcggccgtaccgaggaacgtntcgaggcggcggtagatcgtagggctagtattcactcacacatacaatcactgcagctagagtatttcgactaacttacgtactgtactagacgaggacctaacgacggcctccgaccccctacggtccggaaccgacggggacacggacgtaggaattaaacgttaacgacttggngctgcacctaattcgttaacg

SEQ ID NO: 420128 - DNA, 553 bp, Homo sapiens
  misc_feature: GZ8MTXP01EBS2J.9.59.F04.1.454.CMB.2.raw
  modified_base (200)..(200): a, c, t, g, unknown or other
  modified_base (311)..(311): a, c, t, g, unknown or other
  modified_base (337)..(337): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtggctgcatctgtggganactcagtcaccatcaattgtcgggcagtcaggatgttgcgacgtcttagtctggatcagcaagaaaccgaggaaacggccctagactacctaatctatggtgcgtccggtncacgaggtcgccgtccgaggtaacgnttcgaggcggtcgggtagggaactcggaaggggctaggtactttacgactctacacctatacaactcactgacagtctagagttatttagacttaacttactactggtccagtcaggctaacgacggcctcgaccccctaacgtcggccgacggggacacgttacgtaggaagttacgttaaacgacgtggtacggctcgacacctaattcgttcc

SEQ ID NO: 420129 - DNA, 569 bp, Homo sapiens
  misc_feature: GZ8MTXP01EWB3O.9.59.F04.1.454.CMB.2.raw
  modified_base (201)..(201): a, c, t, g, unknown or other
  modified_base (426)..(426): a, c, t, g, unknown or other
  modified_base (550)..(550): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgtcgggcgagtcaggatgttggcgacgcttagtctggatcagcaagaaaccaggaaaacggccctagactcctaatctatggtgcgtccggttgcacgagtcggcgtcccaggaacgattcgaggtcggcggtaggaatcgtaggggactacggtacttttcgaactctacacccattacaatccacctgccagggctggaaggttntttacgactaacttacgtactgtacagcgagtactaacgacgcctaccgacccctaaccgtcggaaccgaacggggacaacggacgtagggaacgttaaacgttaaacggacgtggtacggtcncgacacgtaacttcgttcg

SEQ ID NO: 420130 - DNA, 548 bp, Homo sapiens
  misc_feature: GZ8MTXP01A2NRX.9.59.F04.1.454.CMB.2.raw
  modified_base (201)..(201): a, c, t, g, unknown or other
  modified_base (259)..(259): a, c, t, g, unknown or other
  modified_base (313)..(313): a, c, t, g, unknown or other
  modified_base (451)..(451): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgcgggcagttaggatggttggcgacgtcttagtctggtancagacaagaaaccaggaaaacgccctagacctctaatctatggtgcgtccggtncacgagtgtccgtaccaggaactacttcgaggcggtcggtggaacttcgtaaggggcaaggtactttcactcacaccatacaatcacctgcaggctagacgtatttgactaacttactacgtgtcagcaggctaacgnggacctccgaccccctaacgttccggccgtaaggggaccacggacgttaggaagtaacgttaaacgcgttggtggctcggcacacttcgttcgttcc

SEQ ID NO: 420131 - DNA, 605 bp, Homo sapiens
  misc_feature: GZ8MTXP01C9RWJ.9.59.F04.1.454.CMB.2.raw
  modified_base (201)..(201): a, c, t, g, unknown or other
  modified_base (323)..(323): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganacacagtcaccatcaattggtcgggcgagtcaggtatggttggcgaccgtcttagtctggtatcgagacaagaaaaccgaggaaacgccctagactactaatctagtggtcgccgtccggtncacgtaggtcggaccgtacccgaaggtaaaccgtcgttcgagggccggggtcgggttaagggaacgttcggtaaggggactaaggttactttccgaacttcaccacctataccaactccacgtgacgaggctaggagttatttacgacttaacttacgtactgtacacgcgtaacggctaacgacggtccctaccgaccccctaacggtccgggaaccggaacggggacacggacgtaggaacttaacgttaaacgacgtgacgtcgtcgacactgttcgtc

SEQ ID NO: 420132 - DNA, 597 bp, Homo sapiens
  misc_feature: GZ8MTXP01B4JM8.9.59.F04.1.454.CMB.2.raw
  modified_base (201)..(201): a, c, t, g, unknown or other
  modified_base (223)..(223): a, c, t, g, unknown or other
  modified_base (242)..(242): a, c, t, g, unknown or other
  modified_base (397)..(397): a, c, t, g, unknown or other
  modified_base (573)..(573): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgtgacatccagatgacccagtctccatcttccgtggctgcatcgtggtgganactcagtcacatcaattgcggnagtcagatgtgcgaccgtnttagtctggatcagacaagaaaccaggaaacgccctaagacctacctaatctagtcggtcgcggtccggtgcacgtacggtcggaccgtcccgaaggaatacgttcgaggcggggcggtaggactcgtagggcagtactttcgactcacacctanacaatcacctgacaggtctagaggttatttacgactaaacctttacgtacttaggacagaccgtaacggactaacgacggcctacccgacccccgtaaaccgttccggaaccggaacgggaccaccggttaaggtacggtaagttaaacgttaaaacggacgtcgggtacggttcncggtaccacctaacgtttcttccg

SEQ ID NO: 420133 - DNA, 553 bp, Homo sapiens
  misc_feature: GZ8MTXP01B410O.9.59.F04.1.454.CMB.2.raw
  modified_base (200)..(200): a, c, t, g, unknown or other
  modified_base (225)..(225): a, c, t, g, unknown or other
  modified_base (318)..(318): a, c, t, g, unknown or other
  modified_base (528)..(528): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtggctgcatctgtggganactcagtcaccatcaattgtcgggngagtcaggatgttggcgtaccgtcttagtctggtatcagacaagaaaccgaggaaacgcctagactactaatctagtggtcgcgtcccggttncacgagtcgtccgtacccgaggtaacattcgaggcgggcggtaggatcgtagggctagtactttcactctacactatacaatccacctgacaggtctaggagttatttgactaacttacgtactgtacagcgaaggcctaacgcggcctccgaccccctaacgtcggaaccgaggggactacgacgtaggaattaacgttaacgacgtgnggtctacgcttacctaagttcgtcg

SEQ ID NO: 420134 - DNA, 674 bp, Homo sapiens
  misc_feature: GZ8MTXP01ALS3V.9.59.F04.1.454.CMB.2.raw
  modified_base (183)..(183): a, c, t, g, unknown or other
  modified_base (201)..(201): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgnggctgcatcgtgtggganacacagtcaccatctaattgtcgggcagtcaggattggttcggcgtaccgtcttaggtctggtatcgagcaagaaaccgaaggaaaacggccctaagactacctaatcgtagtggtcgccggttcccggtgacgacgtaggtcggccgttacccgagggaacgtacttcgagggtccgggtcgggtagggacgtcggtagggcctaagtacgtttccactcgttaccacctaataccgaaacttccgaacccgttgaccgtaagggtctaggtaacggtttatttcgaaaccttacgtttacctaacgttgtaccacggtacgtaacggtactaaccggtaccgggtcccttacccggtaccccccttaaacgggttcccgggaaccgtaacgggggccaaacgggttacgtagggaaacgttaacgttaaacccggttgtgggtacgcctagcccttaactgttcgtttccg

SEQ ID NO: 420135 - DNA, 583 bp, Homo sapiens
  misc_feature: GZ8MTXP01BCI4E.9.59.F04.1.454.CMB.2.raw
  modified_base (182)..(182): a, c, t, g, unknown or other
  modified_base (199)..(199): a, c, t, g, unknown or other
  modified_base (203)..(203): a, c, t, g, unknown or other
  modified_base (252)..(252): a, c, t, g, unknown or other
  modified_base (299)..(299): a, c, t, g, unknown or other
  modified_base (414)..(414): a, c, t, g, unknown or other
  modified_base (424)..(424): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccgttgagatgcgacatccagatgacccagtctccatcttccgnggctgcatctgtggganactnagtcaccatcaagttggcgggcgaagtcaggtatggttcggcgtaccgnttagtctggatcagcaagaacaggaaacgcctagactactaatctanggtgccgtcccgtgcctagagtcggcctccgaaggaactagttcgaaggccgggtcggtagggactcgtaggggcctagtactttccactactcacctatcaaactcacctgacngactgagttntttcacgtaactttacgattggtacacggtacgaggcctaaagaccgggtcctcccgaccccgtaacggtccggaacgggaacggggccacggttacgtaggtaagaaaccgttaaggaaccgttggacgaacttcggacttacccgtaagttcctcgg

SEQ ID NO: 420136 - DNA, 541 bp, Homo sapiens
  misc_feature: GZ8MTXP01EQW1Q.9.59.F04.1.454.CMB.2.raw
  modified_base (201)..(201): a, c, t, g, unknown or other
  modified_base (249)..(249): a, c, t, g, unknown or other
  modified_base (316)..(316): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgtcgggcgagtcaggatggttggcgaccgnttagtctggtatcagcaagaaaccaggaaaaggccctaagactactaatctagtggtgcgtccggtncacagtcggcgtcccgaggaacgattcgaggcggcggtaggatcgtagggctagactttcactctcaccatcaatcactgacagtctgagtatttgactacttactactgtacagtcaggactacgaggtcctaccgcccctaaacgttcggaaccgacgggaccacggaccgttggaacgttaacgttaaacggaccttggacggctcgacacgtaattcgttc

SEQ ID NO: 420137 - DNA, 583 bp, Homo sapiens
  misc_feature: GZ8MTXP01DYWUN.9.59.F04.1.454.CMB.2.raw
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctggtgggagactcagtcaccatctaattggtcgggcgagtcaggtatggttggcgaccgtcttagtctggtatcagacaagaaaccgaaggaaaacggcctagactactaatctagtggtcgtcgttccggttgcacgtaggtcggccgtacccgaaggtaacgacttcgaggcgggtacggtaggtagtcggtagggctaaggtactttccacttctaccacatacaactcacctgcaggtctaggagttactttgactaactttactactgtacagacgacggcttaacgacggtccctccgacccccgtaacgtcgggaaccaggggaccacgttagtacggaattaacgttaacgacgttgtcgctcgaccttactcttcgtttcg

SEQ ID NO: 420138 - DNA, 533 bp, Homo sapiens
  misc_feature: GZ8MTXP01ARHDL.9.59.F04.1.454.CMB.2.raw
  modified_base (200)..(200): a, c, t, g, unknown or other
  modified_base (211)..(211): a, c, t, g, unknown or other
  modified_base (293)..(293): a, c, t, g, unknown or other
  modified_base (313)..(313): a, c, t, g, unknown or other
  modified_base (332)..(332): a, c, t, g, unknown or other
  modified_base (360)..(360): a, c, t, g, unknown or other
  modified_base (373)..(373): a, c, t, g, unknown or other
  modified_base (386)..(386): a, c, t, g, unknown or other
  modified_base (399)..(399): a, c, t, g, unknown or other
tcagtgatacgtctcacgaccggtgctcgatttagtacacacacttagggattgggggcaggagtcagacccagtcaggacacagcatggacatggagggtccccgctcagctcctggggctcctgctgctctggttcccggttgagatgcgacatccagatgacccagtctccatcttccgtggctgcatctgtggganactcagtcacntcaattgcggcagtcaggatgttggcaccgcttagtctggatcagcagaaaccaggaaaaggcctagactcctaatcttagnggtcgcgtccggttgcaacnggtcgcgtaccaggaaacncttcaggcggcggtaggactgtacgggnagtatttcacttnacaccatccaaancgactgacgacgngtagtagtagttacgtactacttacgtactacgtcacgacgacgacgacgacgaccgtccgtacccgtaccgtcggcgacggacgacgacgtagaagaacgttaacgacgtgtagcgcgacactaacgttcgtc

SEQ ID NO: 420139 - DNA, 547 bp, Homo sapiens
  misc_feature: GZ8MTXP01A4JLR.9.59.F04.1.454.CMB.2.raw
  modified_base (287)..(287): a, c, t, g, unknown or other
  modified_base (523)..(523): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagactcagtcaccatcaattgtcgggcagtcagggatgttgggcgaccgcttagtctggatcagcagaaaccaggaaagcctagactntaatctatggtgcgtcccggttgcacgagtggcgtcccgaggtaacgattcaggcggcggtacgggatcgtagggctagtatttcatctcacatcgaatcaccctgcacggctgacgtatttcgactaacgttactacgtagtccagcgagacgtaactacggctccgcccccaaccgttcgaacccgacggggaccaacggaaccgtggaacgagttaaacgttacaacgggtgnttaccgcgttacctcttaacgtcg

SEQ ID NO: 420140 - DNA, 520 bp, Homo sapiens
  misc_feature: GZ8MTXP02JOU0N.9.59.F04.1.454.CMB.2.raw
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcagtcaggatgttggcgaccgcttagtctggtatcagcagaaaccaggaaaggccctagactcctaatctatggtgcgtcccggttgcacagtggcgtcccaggaacgattcgagcggcggtggatcgtagggcagatttcactctcaccatcaatcacctgcaggctgaggattttgacaacttactactgtcagcaggctaaacaggcctcggacccccaacgttccggacccgagggggaccaacggactagggacgaacgttaaacgaacgtgtggctcgcaccatcttcg

SEQ ID NO: 420141 - DNA, 530 bp, Homo sapiens
  misc_feature: GZ8MTXP02HI2UK.9.59.F04.1.454.CMB.2.raw
  modified_base (201)..(201): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganacacagtcaccatcaattgtcgggcagtcaggatggttggcgaccgcttagtctggtatcagcagaaaccaggaaagccctagactctaatctatggtgcgtcccggttgcacagtggcgtcccgaggaacgattcagcggcggtggatcgtagggcagatttcactctcaccatcaatcacctgcaggctgaggtatttgactaaacttactactgtacagcaggactaacgaggcctacgaccccccgtaacttcccgggacccgagggggaccacggacgtggaacgtaacttaaaacgaactggtcggactcgacaccgatctcg

SEQ ID NO: 420142 - DNA, 495 bp, Homo sapiens
  misc_feature: GZ8MTXP02FWNQM.9.59.F04.1.454.CMB.2.raw
  modified_base (200)..(200): a, c, t, g, unknown or other
  modified_base (427)..(427): a, c, t, g, unknown or other
  modified_base (466)..(466): a, c, t, g, unknown or other
tcagtgatacgtctcacgaccggtgctcgatttagtacacacacttagggattggggcaggagtcagacccagtcaggacacagcatggacatgagggtccccgctcagctcctggggctcctgctgctctggttccccggttcgagatgcgacatccagatgacccagtctccatcttccgtggctgcatctgtggganacacagtcaccatcaattgtcgggcgagtcaggatgttggcgaccgcttagtctggtatcagcagaaaccaggaaaagccctagactcctaatctatggtgcgtcccggttgcacagtggcgtcccaggaacgattcagcggcggtggatcgtagggcagatttcactctcacatcaatcactgcaggctgagatttgctaaacttctactgtcagcaggctaaacnggctcgacccccaacttcggccaggggacacgactgganaacttaaacgaactgtagctgcacatctg

SEQ ID NO: 420143 - DNA, 504 bp, Homo sapiens
  misc_feature: GZ8MTXP02IMH97.9.59.F04.1.454.CMB.2.raw
  modified_base (201)..(201): a, c, t, g, unknown or other
  modified_base (331)..(331): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgtcgggcgagtcaggatgttggcgaccgcttagtctggtatcagcagaaaccaggaaaaggccctagactctaatctatggtgcgtcccgttgcacagtggcgtccaggaanattcagcggcggtgatcgtagggcagatttcactctcaccatcaatcactgcaggctgaggtatttgactaacttactactgtacagcaggctaacaggctcgacccccaacgttcggaccagggggacaccggatagggactaattaacgaactgtaggctgcaccatctcg

SEQ ID NO: 420144 - DNA, 555 bp, Homo sapiens
  misc_feature: GZ8MTXP02GSY4W.9.59.F04.1.454.CMB.2.raw
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagactcagtcaccatcaattgtcgggcgagtcaggatgttggcgacgcttagtctggtatcagcagaaaccaggaaaagccctagactcctaatctatggtgcgtccggttgcacagtggcgtcccaggaacgattcagcggcggtggatcgtagggcagatttcactctcaccatcaaatcacctgcaggctgagtatttgactaacttatactgtcagcaggctaacgaggcctcgaccccctaacgttccgggaccgacgggggaccaacggacgtagggaaacgtaaacgtttaaaaaccggaaccgtggttacgggaccttacggacccaacccgtaattccggtttaccg

SEQ ID NO: 420145 - DNA, 505 bp, Homo sapiens
  misc_feature: GZ8MTXP02FW7I8.9.59.F04.1.454.CMB.2.raw
  modified_base (431)..(431): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagactcagtcaccatcaattgtcgggcgagtcaggatgttggcgaccgcttagtctggtatcagcagaaaccaggaaaaggccctagactcctaaatctatggtgcgtcccggtgcacagtggcgtcccaggaacgattcagcggcggtggatcgtagggcagatttcactctcaccatcaatcactgcaggctgagatttgacaaacttactactgtcagcaggctaaacnggactcgcccccaacttcggaccaggggacacgactggagtaactaacgaactggtggactggcaccatcttag

SEQ ID NO: 420146 - DNA, 535 bp, Homo sapiens
  misc_feature: GZ8MTXP02IHBB2.9.59.F04.1.454.CMB.2.raw
  modified_base (201)..(201): a, c, t, g, unknown or other
  modified_base (377)..(377): a, c, t, g, unknown or other
  modified_base (437)..(437): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgtcgggcgagtcaggatggttggcgaccgcttagtctggtatcagcagaaaccaggaaaacgccctagactcctaatctatggtgcgtccgttgcacagtggcctccgaggacgattcaggcggcggtggatcgtagggcagtatttcactctcacancaatcactgcaggctgaggtatttgactaaactttactacttgtacagcaggactaacgnggcctacggccccctaacgttccggaccgagggggaccacgaccgtagggactaaacgttaaacgaacgtggtacgcgttacgacaccctagtcttcg

SEQ ID NO: 420147 - DNA, 529 bp, Homo sapiens
  misc_feature: GZ8MTXP02J2PNG.9.59.F04.1.454.CMB.2.raw
  modified_base (201)..(201): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgtcgggcagtcaggatggttggcgaccgcttagtctggtatcagcaagaaaccaggaaaacggcctagactcctaatctatggtgcgtccggtgcacagtggcgtccgaggaacgattcgaggcggcggtggatcgtagggcagtattcactctcaccatcaatcactgacgagctgaggtatttgactaaacttctacgtgtcagtcaggactaacgacggcctccgacccctaaccgtcggaccgacggggaccacggactggacgtaacgtaaaccgaacgtgtacggctcgaccacctagtcttcg

SEQ ID NO: 420148 - DNA, 517 bp, Homo sapiens
  misc_feature: GZ8MTXP02JX1AH.9.59.F04.1.454.CMB.2.raw
  modified_base (201)..(201): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgtcgggcagtcaggatgttggcgaccgcttagtctggtatcagcagaaaccaggaaaaggccctagactcctaatctatggtgcgtcccggttgcacagtgtcgtcccaggaacgattcgagcgggcgtggatcgtagggcagatttcactctcaccatcaatcacctgcaggctgaggtatttgactaacttctactgtcagacaggctaacgaggctcgcccccaacgttccggaccgaggggaccacggactcggacgtaacttaaacgaactggtaggctcgcaccactctacg

SEQ ID NO: 420149 - DNA, 533 bp, Homo sapiens
  misc_feature: GZ8MTXP02FZ4F5.9.59.F04.1.454.CMB.2.raw
  modified_base (201)..(201): a, c, t, g, unknown or other
  modified_base (225)..(225): a, c, t, g, unknown or other
  modified_base (310)..(310): a, c, t, g, unknown or other
  modified_base (313)..(313): a, c, t, g, unknown or other
  modified_base (326)..(326): a, c, t, g, unknown or other
  modified_base (335)..(335): a, c, t, g, unknown or other
  modified_base (440)..(440): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtggctgcatctggtggganactcagtcaccatcaattgcgggnagtcaggatggttggcgaccgcttagtctggtatcagcaagaaaccgaggaaaacgcctagactctaatctatggtgcgtccgtncanagtgctcagacgntcgagcggngtgatcgtagggctagtactttcactctacacctatcaaactcacgtgacgaggtctaggaggttatttcgacttaaacttctacgtgtcagacacggctaacgngcctccgacccctacgttcggaccgaggggaccacgtacgtaggaacgtaacgtaaacgacgtggtacgctacggacctacgtacgtcttacg

SEQ ID NO: 420150 - DNA, 493 bp, Homo sapiens
  misc_feature: GZ8MTXP02GUG8R.9.59.F04.1.454.CMB.2.raw
  modified_base (201)..(201): a, c, t, g, unknown or other
  modified_base (428)..(428): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgtcgggcagtcaggatggttggcgacgcttagctggtatcagcaagaaaccaggaaaaggccctagactcctaatctatggtgcgtccggttgcacagtgcgtccaggaagattcagcggcggtggatcgtagggcagattcactctcaccatcaatcacctgcaggctgaggtatttgactaacttactactgtcagcaggctaaacnggctcgacccccaacttcggccaggggacacgactggacattaacgatgtacgctgcacatctcg

SEQ ID NO: 420151 - DNA, 521 bp, Homo sapiens
  misc_feature: GZ8MTXP02ID9HJ.9.59.F04.1.454.CMB.2.raw
  modified_base (377)..(377): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagactcagtcaccatcaattgtcgggcagtcaggatggttggcgaccgcttagtctggtatcagcagaaaccaggaaaagccctagactcctaatctatggtgcgtcccggttgcacagtcgcgtcccaggaacgattcagcggcggtggatcgtagggcagatttcactctcaccancaatcactgcaggctgaggtatttgactaactttacacttgtcagcaggctaacgaggctcgacccccaacgttcggaccaggggaccacgaccgtagggacgaacgtttaaaacgaacgtgtcggcttcgacacctatcttcg

SEQ ID NO: 420152 - DNA, 537 bp, Homo sapiens
  misc_feature: GZ8MTXP02G0NT7.9.59.F04.1.454.CMB.2.raw
  modified_base (201)..(201): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgtcgggcagtcaggatgttggcgaccgcttagtctggtatcagcagaaaccaggaaaagccctagactcctaatctatggtgcgtcccggttgcacagtggcgtcccaggaacgattcagcggcggtggatcgtagggcagatttcactctcaccatcaatcacctgcaggctagaggattttgactaacttactactgtcagcaggctaacgaggcctcggaccccctaaacgttccgggaccaagggggaccacgggaacctgggaacgtaaacgtttaaacgaacgtgtacggctcggaccaacctactctttcg

SEQ ID NO: 420153 - DNA, 556 bp, Homo sapiens
  misc_feature: GZ8MTXP02JDYMA.9.59.F04.1.454.CMB.2.raw
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgacgcttagtctggtatcagcagaaaccaggaaagccctagactctaatctatggtgcgtcccggttgcacagtcggcgtcccgaggaacgattcgagcggcggtggatcgtagggcagatttcgactctcacctatcaatcactgcaggctgagtatttgactaacttacgtactgtcagtcaggactaacgaggctccgacccccgtaaacgttccggacccgaacgggggaccaaccggtaaccgtagggaacgtaaacgtttaaaaccggaacgttaaggtacggcttacggacctacccgatttcttcg

SEQ ID NO: 420154 - DNA, 549 bp, Homo sapiens
  misc_feature: GZ8MTXP02I45XW.9.59.F04.1.454.CMB.2.raw
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtggctgcatctgtgggagacacagtcaccatcaattgtcgggcagtcaggatgttggcgacgcttagtctggtatcagcaagaaaccaggaaagcctagactctaatctatggtgcgtccgttgcacagtggcgtccgaggacgattcagcggcggtggatcgtagggcagtatttcactctcaccatcaatcacctgacaggctgaggtatttgactaaactttactactgtacagacaggactaacgaggtcctaccgacccccaaacgttcggacccgagggggaccaccggaacgttagggaacgtaaacgtttaaaccggaaacgttggtacggtccttacggaccaccctagtccgtttcg

SEQ ID NO: 420155 - DNA, 502 bp, Homo sapiens
  misc_feature: GZ8MTXP02G1ZVF.9.59.F04.1.454.CMB.2.raw
  modified_base (201)..(201): a, c, t, g, unknown or other
  modified_base (429)..(429): a, c, t, g, unknown or other
  modified_base (433)..(433): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgtcgggcagtcaggatgttggcgaccgcttagctggtatcagcaagaaaccaggaaaaggccctagactcctaatctatggtgcgtcccggttgcacagtgcgtccaggaagattcagcggcggtgatctagggcagtattcactctcaccatacaatcacctgcaggctgagtatttgactaaacttactacttgcagcaagctaaacnggcncgaccccctaaactcggaccaggggacacgactaggacgaattaaacgaatgtagctcgcaccatctcg

SEQ ID NO: 420156 - DNA, 528 bp, Homo sapiens
  misc_feature: GZ8MTXP02GYDLX.9.59.F04.1.454.CMB.2.raw
  modified_base (201)..(201): a, c, t, g, unknown or other
  modified_base (299)..(299): a, c, t, g, unknown or other
  modified_base (437)..(437): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgtcggcagtcaggatgttggcgaccgcttagtctggtatcagcagaaaccaggaaagccctagactcctaatctatggtncgtcccggttgcacagtggcgtcccaggaacgattcagcggcggtggatcgtagggcagatttcactctcaccatcaatcaactgacgaggctgaggtattttgactaaactttactactgtccagcaggctaaacgnggcctcgacccccaaccgttcggaccgagggggaccacggacgtggacgtaacgttaaacgacgtcgtagggctaggaccacactccttag

SEQ ID NO: 420157 - DNA, 500 bp, Homo sapiens
  misc_feature: GZ8MTXP02FWRIX.9.59.F04.1.454.CMB.2.raw
  modified_base (201)..(201): a, c, t, g, unknown or other
  modified_base (340)..(340): a, c, t, g, unknown or other
  modified_base (424)..(424): a, c, t, g, unknown or other
  modified_base (428)..(428): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgtcgggcagtcaggatgtggcgaccgcttagtctggtatcagcagaaaccaggaaaagcctagactcctaatctatggtgcgtcccggttgcacagtggctccgaggagattcagcggcgnggatcgtagggcagatttcactctcaccatcaatcacctgcaggctgaggtatttgactaacttatactgtcagcaggctaacnggcncgaccccaacgttcggaccgaggggacacgacgtaggacgtaacttaacgaactgtggctacgcacatctcg

SEQ ID NO: 420158 - DNA, 509 bp, Homo sapiens
  misc_feature: GZ8MTXP02G3ERU.9.59.F04.1.454.CMB.2.raw
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagactcagtcaccatcaattgtcgggcagtcaggatggttggcgaccgcttagtctggtatcagcagaaaccaggaaaggccctagactcctaatctatggtgcgtcccggttgcacagtggcgtcccgaggaacgattcagcggcggtggatcgtagggcagatttcactctcacatcaatcactgcaggctgaggtatttgactaacttacacttgtcagcaggactaacgaggctcgaccccctaacttcggaccgaggggacacgactacggagactaaacgactgacggctagacaccgatctcg

SEQ ID NO: 420159 - DNA, 565 bp, Homo sapiens
  misc_feature: GZ8MTXP02G811J.9.59.F04.1.454.CMB.2.raw
  modified_base (201)..(201): a, c, t, g, unknown or other
  modified_base (376)..(376): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgtcgggcagtcaggatgttggcgaccgcttagtctggtatcagcaagaaaccaggaaaacgccctagactcctaatctatggtgcgtccggttgcacgagtggcgtaccgaggaacgattcgagcggcggtggatcgtagggctagtatttcactcncacctatacatcactgacagctgagtatttgactaacttactactgtcagcaggactaacgaggcctccgaccccctaaacgttccggaccgaacggggaccaacggtacgtacgggaaacgtaaacgttaaaaccggaaacgttcggttacgggaccttacggaccgtacctaactttccgtttaacg

SEQ ID NO: 420160 - DNA, 515 bp, Homo sapiens
  misc_feature: GZ8MTXP02GESVB.9.59.F04.1.454.CMB.2.raw
  modified_base (201)..(201): a, c, t, g, unknown or other
  modified_base (313)..(313): a, c, t, g, unknown or other
  modified_base (430)..(430): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgtcgggcagtcaggatgttggcgaccgcttagtctggtatcagcaagaaaccaggaaaaggccctagactcctaatctatggtgcgtccggttncacagtgcgtcccaggaacatcagcggcggtggatcgtagggcagtatttcactctcacatacaatcactgcagctgagtatttgactaacttactactgtacagcaggactaaacnggtctacggaccccctaacgttccggaccgaggggacacggactagggataacgttaaaccgataaggtgctcgacacatcgttc

SEQ ID NO: 420161 - DNA, 525 bp, Homo sapiens
  misc_feature: GZ8MTXP02GTKKD.9.59.F04.1.454.CMB.2.raw
  modified_base (200)..(200): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatctccgtggctgcatctgtggganacacagtcaccatcaattgtcggcgagtcaggatgttggcgaccgcttagtctggtatcagcagaaaccaggaaaaggcctagactcctaatctatggtgcgtcccggttgcacagtggcgtcccaggaagattcagcggcggtggatcgtagggcagtatttcactctcaccatacaatcactgcacggctagagtattttgactaacttacactgtcagcagctaacgaggctacgacccccaacgttccggacccgaggggaccacggacgtaggacgtaacttaaacggaaactggtacggctacgacctaccactcttcg

SEQ ID NO: 420162 - DNA, 498 bp, Homo sapiens
  misc_feature: GZ8MTXP02JTL5Z.9.59.F04.1.454.CMB.2.raw
  modified_base (202)..(202): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacaatccagatgacccagtctccatcttccgtggctgcatctgtggganacacagtcaccatcaattgtcgggcagtcaggatgttggcgaccgcttagtctggtatcagcagaaaccaggaaagcctagactcctaatctatggtgcgtccggttgcacagtggctccaggaagattcagcggcggtggatcgtagggcagtattcactctcaccatcaatcactgcaggctgaggtatttgactaacttactactgtcagcaggactaacaggcctcgccccctaacttcggaccgagggacacgactggacgataaacgactgtacggctcgcaccatctcg

SEQ ID NO: 420163 - DNA, 518 bp, Homo sapiens
  misc_feature: GZ8MTXP02FUXRV.9.59.F04.1.454.CMB.2.raw
  modified_base (201)..(201): a, c, t, g, unknown or other
  modified_base (248)..(248): a, c, t, g, unknown or other
  modified_base (311)..(311): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgtcgggcgagtcaggatgttggcgaccgnttagtctggtatcagcaagaaaccaggaaaagcctagactctaatctatggtgcgtcccggtncacagtgcgtccaggaacattcagcggcggtggatcgtagggcagtatttcactctacacatcaatcacctgcaggctgagtatttgactaacttactactgtcagcaggctaacgaggctcgacccccaacgttcggaccgaggggaccacgacgtaggaacgtaactaaacgacgtaaggtcggactcggaccactactccgttg

SEQ ID NO: 420164 - DNA, 561 bp, Homo sapiens
  misc_feature: GZ8MTXP02GX5FJ.9.59.F04.1.454.CMB.2.raw
  modified_base (200)..(200): a, c, t, g, unknown or other
  modified_base (315)..(315): a, c, t, g, unknown or other
  modified_base (330)..(330): a, c, t, g, unknown or other
  modified_base (346)..(346): a, c, t, g, unknown or other
tcagtgatacgtctcacgaccggtgctcgatttagtacacacacttagggattgggggcaggagtcagacccagtcaggacacagcatggacatgagggtccccgctcagctgctggggctcctgctgctctggttccccggttgagatgcgacatccagatgacccagtctccatcttccgtggctgcatctgtggganactcagtcaccatcaattgtcgggcagtcaggatgttggcgaccgcttagtctggtatcagcagaaaccaggaaaaggccctagactcctaatctatggtgcgtcccggttgcanagtggcgtccagganatcaggcggcggtggntctaggggcagtatttcactctcaccatcaatcacctgcaggctagagtatttgactaacttactaatgtacagacgaggtactaacgaggcctacgacccccctaaacgttccgggacccgaagggggacccaacggtaaccgtagggtaaaacgtaacgtttaaaaacggaaccgttggtaccgggtaccgtacgtacctaaccgtacttccg

SEQ ID NO: 420165 - DNA, 537 bp, Homo sapiens
  misc_feature: GZ8MTXP02HO2OZ.9.59.F04.1.454.CMB.2.raw
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactctaatctatggtgcgtcccggttgcacagtggcgtccaggaacgattcgagtcggcggtggatcgtagggcagatttcactctcaccatcaatcactgcaggctgaggtatttgactaacttactacttgtacagtacagactaacgaggcctaccgccccctaaacgttccgggaccgacgggggacacggacgtacggaagtaacttaaaacggactggtcgacgtcgaccacctacttccgttcg

SEQ ID NO: 420166 - DNA, 585 bp, Homo sapiens
  misc_feature: GZ8MTXP02H5OKI.9.59.F04.1.454.CMB.2.raw
  modified_base (201)..(201): a, c, t, g, unknown or other
  modified_base (414)..(414): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgcgggcagtcaggatggttggcgaccgcttagtctggtatcagcaagaaaccaggaaaacgccctagactacctaatctatggtcgcgtcccggttgcacgagtggccgtcccgaggaacgattcgagcggcggtgatcgtagggcagtatttcactctcacctatacaaatccaacctgacaggctagaaggtntttcgacttaaacttactacttgacagacaggactaaacgcggctaccgccccctaaacgttccggaccgaagggggaccaacggtaaccgagggaaacgtaaaacgtttaaaacccggaaagtttcggtacggaccgttacggaccctaacccgtaattaccgtttaccg

SEQ ID NO: 420167 - DNA, 540 bp, Homo sapiens
  misc_feature: GZ8MTXP02ICSGG.9.59.F04.1.454.CMB.2.raw
  modified_base (408)..(408): a, c, t, g, unknown or other
  modified_base (441)..(441): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagactcagtcaccatcaattgtcgggcagtcaggatggttggcgaccgcttagtctggtatcagcaagaaaccaggaaaacgccctagactacctaatctatggtcgcgtccggttgcacaggtcggccgtcccgaaggaacgtattcgaggcggcggtggatcgtagggcagtattcactctcaccatacatcactgcgagctgagtntttgactaacttactatgtcagcagactaacgngctacgacccctacgtccggacgacggggaccacggactaggaacgtaaacgttaaacgaacgttcggtacggacctcggacctacccgaattccgtcg

SEQ ID NO: 420168 - DNA, 510 bp, Homo sapiens
  misc_feature: GZ8MTXP02I286R.9.59.F04.1.454.CMB.2.raw
  modified_base (432)..(432): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcgtctgtgggagactcagtcaccatcaattgtcgggcgagtcaggatgttggcgaccgcttagtctggtatcagcagaaaccaggaaaaggccctagactcctaatctatggtgcgtccggttgcacagtggcgtcccaggaagacttcagcggcggtggatctggggcagattcactctcaccatcaatcacctgcaggctgaggtatttgactaaacttctactgtacagtcaggctaacnggctcgcccccaacgttcggccaggggacacgacgtaggacgtacttaaacgactgtaagctacgcacatctagttcc

SEQ ID NO: 420169 - DNA, 552 bp, Homo sapiens
  misc_feature: GZ8MTXP02HH6FA.9.59.F04.1.454.CMB.2.raw
  modified_base (201)..(201): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgtcgggcagtcaggatggttggcgaccgcttagtctggtatcagcaagaaaccaggaaaaggccctagactacctaatctatggtcgcgtccggttgcacagtcggcgtccaggacgattcgagcggcggtggatcgtagggcagtattcactctacaccatacaaactcaactgcaggtctggaggtatttcgactaaactttacgtacttgtcaagccaaggactaaacgacgggcctaccgaccccctaaaccgttcggacccgagggggacctaccggacgtacgggagtaactaaacgaacgtgtacgctacgacacctactcttacg

SEQ ID NO: 420170 - DNA, 520 bp, Homo sapiens
  misc_feature: GZ8MTXP02FN2PT.9.59.F04.1.454.CMB.2.raw
  modified_base (201)..(201): a, c, t, g, unknown or other
  modified_base (430)..(430): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganacacagtcaccatcaaattgtcgggcgagtcaggatggttggcgaccgcttagtctggtatcagcagaaaccaggaaaagcctagactcctaatctatggtgcgtcccggtgcacagtgcgtcccaggaacgattcagcggcggtggatcgtagggcagattcactctcacatcaatcacctgcaggctgaggtatttgactaacttactactgtcagcaggctaacgnggctcgaccccctaacgttcggacgaggggacacgacgtcggacgtaacttaaacgaactgtacggactacgacctacgtactcgttacg

SEQ ID NO: 420171 - DNA, 539 bp, Homo sapiens
  misc_feature: GZ8MTXP02IPO38.9.59.F04.1.454.CMB.2.raw
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaaccatcaattgtcgggcgagtcaggatggttggcgaccgcttagtctggtatcagcagaaacaggaaaacgcctagactctaatctagtggtgcgtccggttgcacgagtcgcgtccgaggaacgattcaggcggcggtgagtcgtagggctagtattcgactctacacctatacaatccacctgcagctaggagtatttcgactaaacttactacgttgtacgagacgaaggactaacgcggccttaccgaccccctaacgtccggaccgacgggactacggacgtaggacgaacgttaacgagtgcggactcgacaccgtatcttcg

SEQ ID NO: 420172 - DNA, 555 bp, Homo sapiens
  misc_feature: GZ8MTXP02HN6MQ.9.59.F04.1.454.CMB.2.raw
  modified_base (325)..(325): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagactcagtcaccatcaattgtcgggcgagtcaggatggttggcgaccgcttagtctggtatcagcaagaaaccaaggaaaaggcccctaagacctcctaatctatggtgcgtcccggttgcacgngtggcgtccgaggacgattcaggcggcggtggatcgtagggctagtattcactctcactatcaatccactgcagcagtagtatttgactaacttactacttgtcagacaggtactaacgcggtccaccgaccccctaacgttccggaccgaacgggggaccaacggaccgtaggaacgtaacgttaaaaccgaacgtggtacggactcggaaccaccgtacgttcgttcg

SEQ ID NO: 420173 - DNA, 529 bp, Homo sapiens
  misc_feature: GZ8MTXP02GAPAG.9.59.F04.1.454.CMB.2.raw
  modified_base (201)..(201): a, c, t, g, unknown or other
  modified_base (334)..(334): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgtcgggcgagtcaggatggttggcgaccgcttagtctggtatcagcaagaaaccaggaaaagccctagactcctaatctatggtgcgtccggttgcacgagtggcgtccaggaanattcaggcggcggtgatcgtagggcagtatttcactctcaccatcaatcacctgcaggctggagtatttgactaactttatacttgtcaggcaaggctaacgacggctccgacccccaacgttccggccgaacggggacacggacgtaggaacgtaacgttaaacgaactggtagcctacgcaaccgatcttacg

SEQ ID NO: 420174 - DNA, 533 bp, Homo sapiens
  misc_feature: GZ8MTXP02JJ9XH.9.59.F04.1.454.CMB.2.raw
  modified_base (201)..(201): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgtcgggcgagtcaggatgttggcgacgcttagtctggtatcagcagaaaccaggaaagccctagactcctaatctatggtgcgtccggttgcacagtcggctcccgaggaacgattcgagcggcggtggatcgtagggcagtatttcactctcaccatacaatcacctgacaggctagagtatttgactaacttactactgtcagacgacgactaacgacggctaccgaccccctaacgtcggaccgaggggaccaacggacgtaggaacgtaacttaaacgaacgtgtacggctacgacctacctagtcttcg

SEQ ID NO: 420175 - DNA, 592 bp, Homo sapiens
  misc_feature: GZ8MTXP02JNXQP.9.59.F04.1.454.CMB.2.raw
  modified_base (201)..(201): a, c, t, g, unknown or other
  modified_base (361)..(361): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgcgggcagtcaggatgttggcgaccgcttagctggtatcagcaagaaaccgaggaaaacgccctagactcctaatctatggtgcgtccggttgcacagtgccgtccaggaacgatcgaggcggcggtgatcgtagggcagtnttcgactctacaccatcaaatcacctgcaggctagaggtatttcgactaaactttacacttgtaccaggtcaggtacctaacgcggtctacccggacccccgtaaaccgttccgggacccgtaaacgggggtaccaaccgggtaacgtacggggtaaacgtaaaacgtttaaaacccgggaacttcggggtacggtaccttacggaccctaaaccgtacgtcgtttaccgg

SEQ ID NO: 420176 - DNA, 523 bp, Homo sapiens
  misc_feature: GZ8MTXP02FXD3F.9.59.F04.1.454.CMB.2.raw
  modified_base (201)..(201): a, c, t, g, unknown or other
  modified_base (433)..(433): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgtcgggcagtcaggatgttggcgaccgcttagtctggtatcagcagaaaccaggaaaaggccctagactcctaatctatggtgcgtcccggttgcacgagtggcgtcccaggaacgattcagcggcggtggatcgtagggcagtattcactctcaccatcaatcacctgcaggctgagtatttgactaacttactactgtcagcaggctaacgnggactcgaccccctaacgttccggaccgacggggacacggactagggacgtaacgtaaaacgacgtgtacggctcgactaccatcttacg

SEQ ID NO: 420177 - DNA, 554 bp, Homo sapiens
  misc_feature: GZ8MTXP02IKPHW.9.59.F04.1.454.CMB.2.raw
  modified_base (201)..(201): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgtcgggcgagtcaggatggttggcgaccgcttagtctggtatcagcagaaaccaggaaaggccctagactcctaatctatggtgcgtcccggttgcacagtcggcgtcccgaggaacgattcgagcggcggtggatcgtagggcagatttcactctcaccatcaatcactgcaggctgagtatttcgactaactttactacttgtacagcaggacctaacgcggcctccgaccccctaacgttccggccgaacggggaccacggtacgtacgggaacgtaacgttaaaacgacgttaaggtcggaccgttacgacctaccgtacgttcgttaccg

SEQ ID NO: 420178 - DNA, 538 bp, Homo sapiens
  misc_feature: GZ8MTXP02FNVV6.9.59.F04.1.454.CMB.2.raw
  modified_base (199)..(199): a, c, t, g, unknown or other
  modified_base (306)..(306): a, c, t, g, unknown or other
  modified_base (383)..(383): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtggctgcatctgtgganactcagtcaccatcaattgtcgggcagtcaggatgttggcgacgtcttagtctggtatcagcaagaaaccaggaaacgcctagactctaatctatggtgcgtccgtncagagtcgcgtccgaggaacgattcgaggcggcggtgatcgtagggctagtattcactctacacatacatcactgcngctagtagtatttcgactaacttactactgtacagcgacggtactaacgacggtcctccgaccccctaacggttcccggacggacggggacaccggtacgtaggaacgtaaacgttaacgaacgtggtacggactacgacctaactctacgttcg

SEQ ID NO: 420179 - DNA, 494 bp, Homo sapiens
  misc_feature: GZ8MTXP02IYK61.9.59.F04.1.454.CMB.2.raw
  modified_base (201)..(201): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgtcggcagtcaggatgttggcgacgcttagtctggtatcagcaagaaaccaggaaaagccctagactcctaatctatggtgcgtccggttgctacagtggcgtccaggaacgatcagcggcggtggatcgtagggcagatttcactctcaccatcaatcaaccgtgcagctgagtatttgacacttacactgtcagcagctaagaggctcgaccccaacgttcgaccgagggacacgatcggacaattaaacgaattgaggctcacaccatcttc

SEQ ID NO: 420180 - DNA, 532 bp, Homo sapiens
  misc_feature: GZ8MTXP02I9EYN.9.59.F04.1.454.CMB.2.raw
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcaagaaaccaggaaaacgccctagactcctaatctatggtgcgtcccggttgcacagtggcgtcccaggaacgattcagcggcggtggatcgtagggcagatttcactctcaccatcaatcacctgcaggctgagtatttgactaaacttactactgtcagtcaggctaacgaggctcgaccccctaacgttcggaccgaggggaccacggacgttaggaacgtaacttaaacgaacgtggtacggctacggaccacctattccttacg

SEQ ID NO: 420181 - DNA, 525 bp, Homo sapiens
  misc_feature: GZ8MTXP02FOHM9.9.59.F04.1.454.CMB.2.raw
  modified_base (200)..(200): a, c, t, g, unknown or other
  modified_base (248)..(248): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtggctgcatctgtggganacacagtcaccatcaattgtcgggcgagtcaggatggttggcgaccgnttagtctggtatcagcaagaaaccaggaaaacgcctagactcctaatctatggtgcgtcccggtgcacgagtggccgtaccgaggaacgtattcaggcgggcggtggatcgtagggcagtatttcactctcacatacaatcactgcagctagagtatttgactaacttactactgtcagcacgctaacacgctcgacccctaacgttccggaccgacgggggacacgaacgtcggaataaacgtaaacgaacgtggtcggactcgacacactcttcg

SEQ ID NO: 420182 - DNA, 546 bp, Homo sapiens
  misc_feature: GZ8MTXP02F86CN.9.59.F04.1.454.CMB.2.raw
  modified_base (202)..(202): a, c, t, g, unknown or other
  modified_base (252)..(252): a, c, t, g, unknown or other
  modified_base (315)..(315): a, c, t, g, unknown or other
  modified_base (383)..(383): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctggtggganacacagtcaccatcaattggtcgggcgagtcaggatggttggcgaccgtnttagtctggtatcagcaagaaaccaggaaacgcctagactctaatctatggtgcgtccggttncacgagtcggcgtcccgaaggaacgagttcgaggcggcggtggactcgtaagggcagtatttcactcncacatacaatcactgcagctgagtatttgactaacttactactgtacagacacggactaaacgcggacctccgaccccctaacgttccggaccgtaacgggggacaacgacgaggaacgtaacgttaaacgaacgtggtacggctacgaccaacctgtctacg

SEQ ID NO: 420183 - DNA, 506 bp, Homo sapiens
  misc_feature: GZ8MTXP02IDKHS.9.59.F04.1.454.CMB.2.raw
  modified_base (201)..(201): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgtcgggcagtcaggatgttggcgaccgcttagctggtatcagcagaaaccaggaaagccctagactcctaatctatggtgcgtcccggttgcacagtgcgtcccaggaacattcagcggcggtggatcgtagggcagatttcactctcaccatcaatcacctgcaggctgaggtatttgctaaacttactactgtcagcaggctaacaggctacgccccaacttcggaccaggggccacggactaggacgaacttaaacggaactggtcggactcgacacctatctg

SEQ ID NO: 420184 - DNA, 563 bp, Homo sapiens
  misc_feature: GZ8MTXP02H7O6O.9.59.F04.1.454.CMB.2.raw
  modified_base (201)..(201): a, c, t, g, unknown or other
  modified_base (383)..(383): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgtcgggcagtcaggatgttggcgaccgcttagctggtatcagcaagaaaccaaggaaaagccctagactacctaatctatggtgcgtcccggttgcacagtcgtcgtcccgaggaacgattcgagcgggcggtggatcgtagggcagtatttcactctcaccanacaatcactgcaggctgaggtattttacgactaaactttactaactgtacagccaggactaaacgcggtactaccgaccccctaaacgttccggaccccgaaagggggaccaacggtaaccgaggaacgtaaacgttaaaacggactggtacggacttacggaccaaccgtacttactcg

SEQ ID NO: 420185 - DNA, 540 bp, Homo sapiens
  misc_feature: GZ8MTXP02IPV04.9.59.F04.1.454.CMB.2.raw
  modified_base (309)..(309): a, c, t, g, unknown or other
  modified_base (312)..(312): a, c, t, g, unknown or other
  modified_base (394)..(394): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcagtcaggatggttggcgaccgcttagtctggtatcagcagaaacaggaaagccctagactctaatctatggtgcgtccggttncanagtgcgtccaggaacgatcgagcggcggtggatcgtagggcagtatttcactctcacctatcaatcactgcaggctagagtntttcgactaacttactactgtacagcaggactaacgaggctccggaccccctaacgttccggaccgacgggggaccaacggacgtaggaacgaactttaaaacggaacgttcggtacggacttacggacctacccgaattcgttcg

SEQ ID NO: 420186 - DNA, 627 bp, Homo sapiens
  misc_feature: GZ8MTXP02IKM41.9.59.F04.1.454.CMB.2.raw
  modified_base (200)..(200): a, c, t, g, unknown or other
  modified_base (233)..(233): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtggctgcatctgtggganactcagtcaccatcaattgtcgggcagtcaggntggttggcgaccgcttagtctggtatcagcaagaaaccaggaaacgccctagactctaatctatggtgcgtccgtgcacgagtcgtcgtaccgaggaacgtattacgaggcgggtcggtggatcggtagggctaggtactttccacttctacactatacctaactcacccttgaccgtacggggtacttagggtaagggttacttttacggaaccttaaacctttactaacgtttcgtacacggtaccgaacgggtactaaacgacggtcctaccgtacccccgtaaaccgttcccgggaccgacgggggtaaaccacggtaacggtacgggaacgtaaaacgtttaaaccgaacgttaaggtacggactacggacctacctagtaccgtttcg

SEQ ID NO: 420187 - DNA, 528 bp, Homo sapiens
  misc_feature: GZ8MTXP02FSMSA.9.59.F04.1.454.CMB.2.raw
  modified_base (201)..(201): a, c, t, g, unknown or other
  modified_base (436)..(436): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganacacagtcaccatcaattgtcgggcgagtcaggatggttggcgaccgcttagtctggtatcagcaagaaaccaggaaaaggccctaagactctaatctatggtgcgtcccggttgcacgagtcgcgtccaggaagattcaggcggcgtggactcgtagggcagtattcactctcaccatcaatcacctgcaggctagagtatttgactaacttactactgtcagcaagactaacnggtctccgaccccctaacgtcgaccgagggaccacgacgtaggaacgaagttaaaccgaacgttgacggactacggaccaacctctacgtcg

SEQ ID NO: 420188 - DNA, 673 bp, Homo sapiens
  misc_feature: GZ8MTXP02HB4AH.9.59.F04.1.454.CMB.2.raw
  modified_base (201)..(201): a, c, t, g, unknown or other
  modified_base (227)..(227): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtggctgcatctggtggganacacagtcaccatcaattggtcgggnagtcaggatgtggcgaccgcttagtctggtatcgagacaagaaaaccgaggaaaacgccctaagacctacctaatctagtggtgtccggttcccggttgcacgaggtcggccgtacccgaaggaacgtattcgaggcggggtcggtggactcggtaggggactaggtactttccgacttctaccgaaccctattaccaaactccaccgtgaccgtacggcttagggtaaaggttacttttacggaaaccttaaacctttaaccgtaacgttggtaccacggtaccgtaaacgggtacctaaacggacggtcccgtacccgtaacccccccgtaaaccgttcccgggaaccggaacgggggtacaaccgggtacgtaggggaactaaacgttaaaaccggtaacgttcggacgtaccgtacgaccctaaccgtacgttccgtttacg

SEQ ID NO: 420189 - DNA, 546 bp, Homo sapiens
  misc_feature: GZ8MTXP02H5DUB.9.59.F04.1.454.CMB.2.raw
  modified_base (201)..(201): a, c, t, g, unknown or other
  modified_base (314)..(314): a, c, t, g, unknown or other
  modified_base (318)..(318): a, c, t, g, unknown or other
  modified_base (403)..(403): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgtcgggcgagtcaggatgttggcgaccgcttagtctggtatcagcagaaaccaggaaaacgccctagactcctaatctatggtgcgtcccggttncagngtgccgtaccaggagatcgagcgggcggtaggatcgtaagggcagtatttcactctcaccatcaatcacctgacaggctgaggtnttttgacttaacttacttactgtacagtacgagactaaacgcggacctaccgacccctaaccgttccgggaccacggggacacggaccgtaggacgtaaacgttaaaccgacgttgacggacctacggaccacctagttctcg

SEQ ID NO: 420190 - DNA, 541 bp, Homo sapiens
  misc_feature: GZ8MTXP02GRI0I.9.59.F04.1.454.CMB.2.raw
  modified_base (201)..(201): a, c, t, g, unknown or other
  modified_base (444)..(444): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattggtcgggcgagtcaggtatggttggcgaccgcttagtctggtatcagcaagaaaccaggaaacgcctagactctaatctatggtgcgtccggtgcacagtcggcgtaccgaggaacatcgaggcgggcggtgatcgtagggcagtatttcactctacaccatacaatcacctgcaggctggtaggtatttgactaaacttactactgtcagcaaggtactaacgnggacctccgacccctaacgttccggaccgacggggaccacggacgtacggaacgtaacttaaacggactggtacggctacgccaccgtacttcgtcg

SEQ ID NO: 420191 - DNA, 537 bp, Homo sapiens
  misc_feature: GZ8MTXP02HW0VV.9.59.F04.1.454.CMB.2.raw
  modified_base (203)..(203): a, c, t, g, unknown or other
  modified_base (318)..(318): a, c, t, g, unknown or other
  modified_base (351)..(351): a, c, t, g, unknown or other
  modified_base (410)..(410): a, c, t, g, unknown or other
  modified_base (443)..(443): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatccttccgtggctgcatcgtgtggganacacagtcaccatcaattggtcgggcagtcaggatggttggcgaccgcttagtctggtatcagcagaaaccaggaaaacgccctagactcctaatctaatggtgcgtcccggttncacagtcggccgtccaggaagattcgaggcggnggtggatcgtaggggcaggactttcacgtctcaccatcaatccactgcagtctagagtntttgactacgttactactgtacagcagactaanacgctcgacccctacgttcggaccgtagggaccacgacgtacggaacgtaacttaaaacggactggtcggtactacgacacctactcgtttacg

SEQ ID NO: 420192 - DNA, 525 bp, Homo sapiens
  misc_feature: GZ8MTXP02GVS2L.9.59.F04.1.454.CMB.2.raw
  modified_base (201)..(201): a, c, t, g, unknown or other
  modified_base (442)..(442): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgtcgggcgagtcaggatgttggcgaccgcttagtctggtatcagcaagaaaccaggaaacgccctagactcctaatctatggtgcgtcccggttgcacgagtgtcgtccaggagtatcagcggcggtggatcgtagggctagtatttcactctcaccatcaatcacctgcagctagagtatttacgactaacttactactgtcagacagactaacgaggtccncgacccctaacgtcggacccgaggggacacggacgtacggaacgaacttaaacgagtaacgtcgactacgacactacgtctcg

SEQ ID NO: 420193 - DNA, 538 bp, Homo sapiens
  misc_feature: GZ8MTXP02GFE67.9.59.F04.1.454.CMB.2.raw
  modified_base (201)..(201): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganacacagtcaccatcaattggcggcgagtcaggatggttggcgaccgcttagtctggtatcagcaagaaaccaggaaaacgcctagactcctaatctatggtgcgtccggtgcacagtcgcgtccgaggaacgattcgagcggcggtgatcgtagggcagtcttcactctcaccataccaatcaccgtgacaggctaggagtactttgacctaacttactactgtacaggcaaggctaacgacggctaccgaccccctaacgttccggaccgacgggggaacctacggactacgggataaacgtaaacgagtaacgcggactagacccactatcctcg

SEQ ID NO: 420194 - DNA, 548 bp, Homo sapiens
  misc_feature: GZ8MTXP02GUABB.9.59.F04.1.454.CMB.2.raw
  modified_base (316)..(316): a, c, t, g, unknown or other
  modified_base (347)..(347): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctggtgggagactcagtcaccatcaattgtcgtgcgagtcaggatgttggcgaccgcttagtctggtatcagcaagaaaccaggaaaagcctagactcctaatctatggtgcgtcccggtgcanagtgcgtccaggagattcgagcggcggtggntcgtagggcagatttcactctcaccatcaaatcaacctgcaggctagagtattttgactaaacttactatgtcagcaggactaacaggctacgaccccctaaacgttccggaccaagggggaccaacggaccgtaggggaaacgtaaacgtttaaaaaccggaaacgttcggtacggtcctaggaccaacccgtatttccg

SEQ ID NO: 420195 - DNA, 523 bp, Homo sapiens
  misc_feature: GZ8MTXP02IPL8R.9.59.F04.1.454.CMB.2.raw
  modified_base (183)..(183): a, c, t, g, unknown or other
  modified_base (233)..(233): a, c, t, g, unknown or other
  modified_base (312)..(312): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgnggctgcatctggtgggagactcagtcaccatcaattgcgggcagtcaggntggtggcgacgcttagtctggtatcagcaagaaacaggaaagccctagacctcctaatctatggtcgcggtcccggttncacaggtcggccgtacccgaggaacgattcaggcggcggtgatcggtagggcagtatttcactctcaccatcaatcactgcaggctagagtatttgactaacttacattgacagcaggactaacgcggctccgccccctaacgtccggaccgaggggacctacgacgtaggacgtaactaaacgacgtgtaggctacgacacctattcgtc

SEQ ID NO: 420196 - DNA, 543 bp, Homo sapiens
  misc_feature: GZ8MTXP02HJZTY.9.59.F04.1.454.CMB.2.raw
  modified_base (201)..(201): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgtcgggcgagtcaggatggttggcgaccgcttagtctggtatcagcaagaaaccaaggaaaaggccctagactacctaatctatggtgcgtccggttgcacagtgtcgtcccaggaagattcgagcggcggtggatcgtagggcagtatttcactctcaccatacaatcacctgcagctgaggtatttgactaattactactgtacagcaggactaaacgacggcctaccgacccccgtaaacgttccggacccgagggggaccaacggaccgtaggaacgtaacttaaaacgaacgttggacgcgtacgcaacctatccgtcg

SEQ ID NO: 420197 - DNA, 542 bp, Homo sapiens
  misc_feature: GZ8MTXP02I5BBA.9.59.F04.1.454.CMB.2.raw
  modified_base (201)..(201): a, c, t, g, unknown or other
  modified_base (437)..(437): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgtcgggcagtcaggatgttggcgaccgcttagtctggtatcagcaagaaaccaggaaaagccctagactctaatctatggtgcgtccgttgcacagtggcgtacccgaggaacgattcgagcggcggtggatcgtagggcagtattcactctcaccatacaatcacctgcacgctgagtatttgactaacgttactactgtaccagcacggactaacngcctcgacccccaaccgttccgggacccgaaggggaccaacggacctaggaacgtaaattaaaaccggaaacttgacggtacctacggacctaacctactcttcg

SEQ ID NO: 420198 - DNA, 541 bp, Homo sapiens
  misc_feature: GZ8MTXP02HXLHB.9.59.F04.1.454.CMB.2.raw
tcagtgatacgtctcacgaccggtgctcgatttagtacacacacttagggattggggcaggagtcagacccagtcaggacacagcatggacatgagggtccccgctcagctcctggggctcctgctgctctggttccccggttcgagatgcgacatccagatgacccagtctccatcttccgtggctgcatctgtgggagactcagtcaccatcaattgtcgggcgagtcaggatgttggcgaccgcttagtctggtatcagcagaaaccaggaaaaggccctagactcctaatctatggtgcgtcccggttgcacagtggcgtcccaggacgattcagcggcggtggatcgtagggcagatttcactctcaccatcaatcacctgcaggctgaggtatttgactaacttactactgtccagcacggctaaacgaggcctacgcccccctaaacgttcccgggcccagggggaccacgaccgttagggaacgaacttaaacggaaccgtgtacgggcttcggcccaaccgacttacgttcg

SEQ ID NO: 420199 - DNA, 518 bp, Homo sapiens
  misc_feature: GZ8MTXP02JB8B6.9.59.F04.1.454.CMB.2.raw
  modified_base (248)..(248): a, c, t, g, unknown or other
  modified_base (340)..(340): a, c, t, g, unknown or other
  modified_base (373)..(373): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagactcagtcaccatcaattgtcgggcgagtcaggatgttggcgaccgnttagtctggtatcagcagaaaccaggaaagccctagactcctaatctatggtgcgtcccggttgcacagtgtcgtccaggacatcgagcggnggtgatcgtagggcagtatttcactctctaccntcaatcactgcaggctagagtatttgactaacttactactgtacagccaggctaaacgcggctccgaccccctaacgttccggaccgacggggacacgacgtagacgaacttaaacgacgtgcggactcgaccactattcctttc

SEQ ID NO: 420200 - DNA, 506 bp, Homo sapiens
  misc_feature: GZ8MTXP02H48F8.9.59.F04.1.454.CMB.2.raw
  modified_base (428)..(428): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagactcagtcaccatcaattgtcgggcagtcaggatgttggcgaccgcttagtctggtatcagcagaaaccaggaaagccctagactctaatctatggtgcgtcccggttgcacagtggcgtcccaggaacgattcagcggcggtggatcgtagggcagtatttcactctcaccatcaatcactgcaggctgagtatttgactaacttactactgtcagcaggctaacnggctcgacccccacgttccggaccaggggacacggactcggacgaacgttaacgaactgtgactcgacaccgatctcg

SEQ ID NO: 420201 - DNA, 666 bp, Homo sapiens
  misc_feature: GZ8MTXP02GKP78.9.59.F04.1.454.CMB.2.raw
  modified_base (202)..(202): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctggtggganactcagtcaccatcaattggtcgggcgagtcaggatggttggcgaccgcttagtctggtatcagacaagaaaccgaaggaaaacgcccctaagacctacctaatctaagtggtcgtaccggttcccggttgccgaacgtacggttcggggcccgttaccccggaagggtaaacgtacgttccgagggccggggtcgggtaggagttccgggtaagggggctaaggttactttaccgaacctttctaccctaacctactaccaaactccaccttcgacgaggtctagggtagttattttacggaaccttaaacttactacgttgtaccaaggtcaacggacctaacggcggtacctacccgaccccctaaaccgttcgggacccggtaagggggacctaaccggacgtaaggtaacgtaacgttaaaacgaacgtggtcggactacggactaaccgcttctaccg

SEQ ID NO: 420202 - DNA, 540 bp, Homo sapiens
  misc_feature: GZ8MTXP02JHHVP.9.59.F04.1.454.CMB.2.raw
  modified_base (312)..(312): a, c, t, g, unknown or other
  modified_base (333)..(333): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagactcagtcaccatcaattgtcgggcgagtcaggatgttggcgaccgcttagtctggtatcagcagaaaccaggaaacggccctagactctaatctatggtgcgtccggttncacagtggcgtccaggaactntcagcggcggtggatcgtagggctagtactttcactctacacctatacaactcacctgcaggctaggagtatttgactaacttactactgtacagcaggactaacgcggcctccgaccccctaacgttccgggaccgacgggggaccacggacgtagggaactaaacgtaaacgaacgtggtacggactcgaccacctagttcttcg

SEQ ID NO: 420203 - DNA, 539 bp, Homo sapiens
  misc_feature: GZ8MTXP02IUDCK.9.59.F04.1.454.CMB.2.raw
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagactcagtcaccatcaattgtcgggcgagtcaggatgttggcgaccgcttagtctggtatcagcaagaaaccaggaaagccctagactcctaatctatggtgcgtcccggttgcacaggtgccgtcccgaggaacgattcaggcggcggtggatcgtagggcagtatttcactctcacatcaatcactgcaggctggaggtatttgacctaaactttactacttgtacagtcaaggcctaaacgcggcctaccgacccccgtaaccgttccgggaccgacgggggacacggacgtaggacgaacttaaacgaacgtgtaggctacgacacacttcgtcg

SEQ ID NO: 420204 - DNA, 594 bp, Homo sapiens
  misc_feature: GZ8MTXP02JC9AX.9.59.F04.1.454.CMB.2.raw
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctggtgggagactcagtcaccatcaattgtcgggcgagtcaggatggttggcgaccgcgttagtcgtggtatcagacaagaaaccgaagggaaaacggtccttagactacctaatctagtggtcgcggtcccggttgcacgaggtcggccgtaccgaggaacgtactcgaggcggcggtggatcgtaggggctaggtacttcactctacaccataccaatcaccgtgcaggtactggtaggtacttttcgacttaaaccttctaccttgtaccagtaccgaggtacctaaagccggtcctacccgggacccccctaacgttcccggaccggaagggaccctaacgggacctagggactaaacgtaaacgacgtgtacgcgtacgaccgtaactcgtctttcg

SEQ ID NO: 420205 - DNA, 518 bp, Homo sapiens
  misc_feature: GZ8MTXP02H7R4W.9.59.F04.1.454.CMB.2.raw
  modified_base (247)..(247): a, c, t, g, unknown or other
  modified_base (372)..(372): a, c, t, g, unknown or other
  modified_base (431)..(431): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagactcagtcaccatcaattgtcgggcagtcaggatgttggcgaccgnttagtctggtatcagcagaaaccaggaaaaggccctagactcctaatctatggtgcgtcccggttgcacagtgtcgtcccaggaacgattcagcggcggtggatcgtagggcagtatttcactcncaccatcaatcacctgcagctgaggtatttgacaacttactactgtcagcagctaacgnggctcgaccccaacttccggaccgtaggggacacgacgtcggaacgacttaaacgaacgtgtacggcgtacgacaccgtatccgttg

SEQ ID NO: 420206 - DNA, 533 bp, Homo sapiens
  misc_feature: GZ8MTXP02GFYY7.9.59.F04.1.454.CMB.2.raw
  modified_base (330)..(330): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagactcagtcaccatcaattgtcgggcgagtcaggatgttggcgacgcttagctggtatcagcagaaaccaggaaaacgccctagaccctctaatctatggtgcgtccggtgcacagtggcgtccaggaanattcagcggcggtggatcgagggcagattcactctcacatcaatcactgcaggctgaggatttgactaacttactactgtacagcaaggcctaaagacggctaccgaccccctaaacgttccgggaccgagggggaaccacgaacgtacgggaagtaaacgttaaaacggaactaaggtcggacctcggacacctatctttcg

SEQ ID NO: 420207 - DNA, 544 bp, Homo sapiens
  misc_feature: GZ8MTXP02GPWVI.9.59.F04.1.454.CMB.2.raw
  modified_base (200)..(200): a, c, t, g, unknown or other
  modified_base (325)..(325): a, c, t, g, unknown or other
  modified_base (346)..(346): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtggctgcatctgtggganactcagtcaccatcaattgtcgggcagtcaggatgttggcgaccgcttagctggtatcagcagaaaccaggaaacggccctagactcctaatctatggtgcgtccgtgcagagtgcgtccaggantcagcggcggtgatcgagggnagtattcactctcaccataccaatcactgacaggctgagtatttgactaacttacactgtacaggtcaggtacctaacgacggtcctccggaccccctaacgttcccggaccgacggggaaccaccggtagtacggaaacgtaaacgttaaaccggaacgttggacggtacctcggtacccgaacctattccgtttcg

SEQ ID NO: 420208 - DNA, 606 bp, Homo sapiens
  misc_feature: GZ8MTXP02IWDG8.9.59.F04.1.454.CMB.2.raw
  modified_base (441)..(441): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctcggttccccggttcgagatgcgacatccagatcgacccagtctccatccttccgtggctgcatctggtgggagactcagtcaccatctaattggtcgggcgagtcgaggtatggttggcgacgtcttagtctggtatcgagacaagaaaccgaggaaaacgccctagacctactaatctagtggtgtccgttccggtgcacgaggtcgccgtaccgaaggaacgtattcgaggcggtcggtggatcggagggactagtacttcactctaccaactactacaactccactgacgcggctaggtaacgttntttacgaccttaaactttactaacgttgtacaggacgtacggacctaaacgcgggacccttacccgaccccctaccggtccggaccgtacggggaccacggtacgtaacggacgtaaaacgttaaacggaactcgggcgtacgacgacctaactcttcgtttccg

SEQ ID NO: 420209 - DNA, 714 bp, Homo sapiens
  misc_feature: GZ8MTXP02IZLHA.9.59.F04.1.454.CMB.2.raw
  modified_base (225)..(225): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggagactcagtcaccatcaattgtcgggnagtcaggatgttggcgaccgcttagtctggtatcagcaagaaaccaggaaaacgcccctaagacctctaatctatggtgccgttcccggttgcacgaggtcggccgtaccccgagggaaacgtacttccgaaggtccggggtacgggttacgggacgttccggttaacgggggcctaaagggttactttttacccgaccgtttaccttacccaaaccctattaccctaaaacttccctaaaccccgttggacctaacggggtccttaggggtaacgggttatttttacggaacccttaaaaccgttttaaccttaaccgttgttaccgaacggtaccgaacgggtaccttaaacggcgggtaccctcccggaaccccccgtaaacggtttcccgggaaccggtagggggacccacgggtacgtacggaacgtaaaacgtttaaaccggaaacgttggtcggtactacggacctaccctagttcctttcg

SEQ ID NO: 420210 - DNA, 709 bp, Homo sapiens
  misc_feature: GZ8MTXP02GPYFU.9.59.F04.1.454.CMB.2.raw
  modified_base (317)..(317): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggagactcagtcaccatcaattgtcgggcgagtcaggatggttggcgaccgtcttagtctggtatcagcaagaaaccgaggaaacgccctagactactaatctagtggtgccgtccggttncacgtagtcggccgtacccgaggaacgtacttcgaggccgggtcgggtggaactcggtacgggacgtaggttactttaccacttaccttaccaaccctacttaaccgaaacttcccacccgttagacccgtaaggggttccttaagggtaacgggttactttttacgaccttaaaaccgtttaccttacgttacgttacgaacgtccgaaacgggtaccctaaacggacgggtaccccttaccccgaaccccccgttaacggttaccgggacccggtaaaacgggggacctaaaccggggaaccgtaaggggtaaacgtaaaaccgtttaaaaccggaaaccgttgggtaccggtaacgttccgaaccgtacctaactttcggtttaacccg

SEQ ID NO: 420211 - DNA, 518 bp, Homo sapiens
  misc_feature: GZ8MTXP02GZ2RR.9.59.F04.1.454.CMB.2.raw
  modified_base (201)..(201): a, c, t, g, unknown or other
  modified_base (245)..(245): a, c, t, g, unknown or other
  modified_base (307)..(307): a, c, t, g, unknown or other
  modified_base (320)..(320): a, c, t, g, unknown or other
  modified_base (328)..(328): a, c, t, g, unknown or other
  modified_base (359)..(359): a, c, t, g, unknown or other
  modified_base (366)..(366): a, c, t, g, unknown or other
  modified_base (372)..(372): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgtcgggcagtcaggatgtggcgacgnttagctggtatcagcagaaaccaggaaacgcctagactctatctatggtgcgtccggtgcanagtgctccaggantcaggcgnggtgatcgtaggcagtatttcactctcaccntacatcncctgcngctgagtatttcgactaacttacttactgcctagacgacgtacaacgacggtctcccgacccccgtaaccgttccggaccgacgggggaccaacggaccgtagggacgtaaaacttaacgacgtggtagcgtgactaccatcttcg

SEQ ID NO: 420212 - DNA, 578 bp, Homo sapiens
  misc_feature: GZ8MTXP02G30AO.9.59.F04.1.454.CMB.2.raw
  modified_base (202)..(202): a, c, t, g, unknown or other
  modified_base (253)..(253): a, c, t, g, unknown or other
  modified_base (323)..(323): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctggtggganacacagtcaccatcaagttggtcgggcagtcaggtattggtggcgaccgtnttagtctggtatcagcaagaaaccgaggaaaacgccctaagacctactaatctagtggtcgcgtccggtncacgtaggtcggcgtccaggacgtatcgaggcggcggtaggatcgtagggctagtactttccactctacacatacaatccactgcgaggctaggagttatttcgacttaacttacgtactgtcagcacgactaacgcggcctaccgtacccccgtaacggttccggaccggaacggggacctacggtacgtacggaaacgtaaacgttaaaaccgacgtggtacggtacgtacgacctaaccgtcttacgtttcg

SEQ ID NO: 420213 - DNA, 554 bp, Homo sapiens
  misc_feature: GZ8MTXP02I4JX3.9.59.F04.1.454.CMB.2.raw
  modified_base (201)..(201): a, c, t, g, unknown or other
  modified_base (205)..(205): a, c, t, g, unknown or other
  modified_base (420)..(420): a, c, t, g, unknown or other
tcagtgatacgtctcacgaccggtgctcgatttagtacacacacttagggattgggggcaggagtcagacccagtcaggacacagcatggacatgagggttcccgctcagctcctggggctcctgctgctctggttccccggttgagatgcgacatccagatgacccagtctccatcttccgtggctgcatctggtggganactnagtcaccatcaattgcgggcagtcaggatggttggcgaccgtcttagtctggtatcagacaagaaaccaggaaaacgcctaagactactaatctatggtgcgtccggtgcacgaggtcgccgtaccgaaggaacgtattcgaggtcggcggtaggactcggtagggctaagtactttcacttctacacctatcaactcacctgacagctagagtntttgactaacttctactgtacaggacacggtactaacgcgtcctaccacccccgtaacgtccgggaccgacggggtaaccacggacgtagggactaaacgttaaacgatggtacgctacgactacctagtctcg

SEQ ID NO: 420214 - DNA, 682 bp, Homo sapiens
  misc_feature: GZ8MTXP02G8O4O.9.59.F04.1.454.CMB.2.raw
  modified_base (202)..(202): a, c, t, g, unknown or other
  modified_base (252)..(252): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctggtggganactcagtcaccatcaattggtcgggcagtcaggatggttcggcgaccgtnttagtctggtatcagcaagaaaccgaggaaacgcctaagacctacctaatctagtggtcgcgtccggtgcacgaggtcggccgtaccgaggaacgtattccgaggcgggcggtaggactcggagggactagtacttccgactctaccacctataccaaacttccacgtgacgacggtcgtaggtaaggtttactttacgaaaccttaaaccttttaaacgtccgtttacggtacctaacggaccgtaaacggtaccgttaaaaccggcgggtaccccttaccccggaaccccccgttaaacggttccccggggaacccggtaaacgggggtaccacccgggttaaagtacggggtaaaccgttaaaacgttaaaccggtaaccgttggtaaccggtccgtacggaaccctaccgtaacgtttctttccgg

SEQ ID NO: 420215 - DNA, 538 bp, Homo sapiens
  misc_feature: GZ8MTXP02FOHQJ.9.59.F04.1.454.CMB.2.raw
  modified_base (201)..(201): a, c, t, g, unknown or other
  modified_base (382)..(382): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganacacagtcaccatcaattgtcgggcgagtcaggatgttggcgacgcttagctggtatcagcagaaaccaggaaaagccctagactcctaatctatggtgcgtcccggttgcacgagtggcgtccaggaacgattcagcggcggtgatcgtagggcagatttcactctcacatcaatcactncagctgagtatttgactaaacttactactgtcagcaggctaaacgaggtcctcgaccccctaacgttccgggaccacgggggaaccacggacgttacgggaagtaaacttaaaacggaaacttgggtcggaccttaggccctaaccgtatctttcg

SEQ ID NO: 420216 - DNA, 541 bp, Homo sapiens
  misc_feature: GZ8MTXP02H6K3K.9.59.F04.1.454.CMB.2.raw
  modified_base (201)..(201): a, c, t, g, unknown or other
  modified_base (315)..(315): a, c, t, g, unknown or other
tcagtgatacgtctcacgaccggtgctcgatttagtacacacacttagggattggggcaggagtcagacccagtcaggacacagcatggacatgagggtccccgctcagctcctggggctcctgctgctctggttccccggttgagatgcgacatccagatgacccagtctccattcttccgtggctgcatctggtggganacacagtcaccatcaattgcgggcagtcaggatggttggcgaccgcttagtctggtatcagcaagaaacaggaaaacgccctagactctaatctatggtcgcgtccggtgcacngcgcgtccgaggacgatcgagcggcggtgatcgagggcagtatttcactctcaccatcaactcacctgacaggctagagtatttcgacttaaacttactaacgttgtacagcgaggtactaacgcggtcctccgacccctaccgttccgggacgaacggggacacggacgacggaacgtaacgttaaacgaacgtggtacggactacggaccaccgtacttctacg

SEQ ID NO: 420217 - DNA, 579 bp, Homo sapiens
  misc_feature: GZ8MTXP02FRZGI.9.59.F04.1.454.CMB.2.raw
  modified_base (323)..(323): a, c, t, g, unknown or other
  modified_base (328)..(328): a, c, t, g, unknown or other
  modified_base (380)..(380): a, c, t, g, unknown or other
  modified_base (402)..(402): a, c, t, g, unknown or other
tcagtgatacgtctcacgaccggtgctcgatttagtacacacacttagggattgggggcaggagtcagacccagtcaggacacagcatggacatgagggtcccccgctcagctcctggggctcctgctgctctggttccccggttcgagatgcgacatccagatgacccagtctccatcttccgtggctgcatctggtgggagactcagtccaccatcaattggtcgggcgagtcaggtattggttggcgtaccgcttagtctggtatcagacaagaaaccaaggaaacggcctagactactaatctagtgtcgcgtccggtncacgnggtcgcgtaccgaggaacgtctcgaggcgggtcggtggatcgtagggcagtnttcactcacacatcaatcaccngcaggctagtaggttatttcgacttaaaccgttactacgtgtacagtacaacgggtacctaaacggcggtacctcccgacccccgtaacggtccggacccggtagggaccacgtaacggtaggaacgtaaacgtaaacggaactgggtacgcgtacaccctaaccgtctcgtttacg

SEQ ID NO: 420218 - DNA, 624 bp, Homo sapiens
  misc_feature: GZ8MTXP02GTIFD.9.59.F04.1.454.CMB.2.raw
tcagtgatacgtctcacgaccggtgctcgatttagtacacacacttagggattgggggcaggagtcagacccagtcaggacacagcatggacatgagggtcccccgctcagctcctggggctcctgctgctctggttccccggttcgagatgcgacatccagatgacccagtctccatcttccgtgctgcatctgtgggagactcagtcaccatcaattggtcgggcgagtcaggatggttggcgaccgcttagtctggtatcagacaagaaaccgaaggaaaacgccctaagactacctaatctaatggtcgccggtcccggttgcacgtaggtcggccgtacccgaaggaacgtattacgaggcggggtcgggtggagtcggtaggggcagtatttccactctaccactatactaactcactgcaggtctggtaggtatttcgactaaactttactattcgtacagtcgaaggtacctaacgacgggtcccttacccgacccccgtaaaccggttcccgggaccgaacgggggacctaaccgggacgtacgggtaaacgtaaacgttaaaacccggaacgttcgggacggtactacggacctaaccgttactacggtttccg

SEQ ID NO: 420219 - DNA, 557 bp, Homo sapiens
  misc_feature: GZ8MTXP02FOIWV.9.59.F04.1.454.CMB.2.raw
  modified_base (200)..(200): a, c, t, g, unknown or other
  modified_base (247)..(247): a, c, t, g, unknown or other
  modified_base (311)..(311): a, c, t, g, unknown or other
  modified_base (371)..(371): a, c, t, g, unknown or other
  modified_base (387)..(387): a, c, t, g, unknown or other
  modified_base (389)..(389): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtggctgcatctgtggganacacagtcaccatcaattgtcgggcagtcaggatggttggcgaccgnttagctggtatcagcaagaaaccaggaaaacgccctagactcctaatctatggtgcgtccggtncacagtgcgtaccaggaacgattcgaggcggtcggtgatcgtagggcagtatttcactcncacatcaatcactgcngntgagtatttgactaacttactactgtcagcacggactaacgcggtactccgacccccgtaaccgttccggaccgtacgggggaccacggtacgtacgggtaacgtaacgttaaaaccgtaacgtaaggttacggaccgttacggaccctaaccgtacgttcgtttccg

SEQ ID NO: 420220 - DNA, 657 bp, Homo sapiens
  misc_feature: GZ8MTXP02HEE1P.9.59.F04.1.454.CMB.2.raw
  modified_base (203)..(203): a, c, t, g, unknown or other
  modified_base (255)..(255): a, c, t, g, unknown or other
  modified_base (327)..(327): a, c, t, g, unknown or other
  modified_base (366)..(366): a, c, t, g, unknown or other
  modified_base (426)..(426): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatcgtggtggganacacagtccaccatcaattggtcgggctagtcaggattggttggcgtaccgnttagtctggtatcagacaagaaaccgaggaaacggccctagacctactaatcgtatggtcgccgtccggttncagaggtcggaccgtaccgaaggaacgcttcgaggcggnggtaggactcggtagggctaggtactttccgactctaccacctatacaatccactgacgnggacttaggtaacgggtattttacgaccttaaactttacctacgttgtaccgaaggccgtaacggtacctaaacgggcggtaccccgtaccccgtaaccccccgtaaacggttcccggggaaaacccgagggggtaaacccacgggtaaaccgttagggggaaaccttaaaacgttaaaccgggtactgggtacggtaccttacggaccctaacccgtgttaccgtttacg

SEQ ID NO: 420221 - DNA, 546 bp, Homo sapiens
  misc_feature: GZ8MTXP02FJ31R.9.59.F04.1.454.CMB.2.raw
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagactcagtcaccatcaattgtcgggcagtcaggatgttggcgacgcttagtctggtatcagcagaaaccaggaaaaggcctagactcctaatctatggtgcgtccggttgcacagtcgcgtccaggacgattcagcggcggtggatcgtagggcagtattcatctcaccatcaatcactgcaggctgagtatttgactaacttactactgtcaggcaggactaacaggctccgccccctaaacgttccggaccgacgggggaccacggtaaccgtacggaagtaaaacgttaaaccggtaaacgtggtacggttaccgtcggtaccacccggtattcccggtttcg

SEQ ID NO: 420222 - DNA, 617 bp, Homo sapiens
  misc_feature: GZ8MTXP02I0VNP.9.59.F04.1.454.CMB.2.raw
  modified_base (429)..(429): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctggtgggagactcagtcaccatctaattggcgggcgagtcgaggatggttggcgaccgcttagtctggtatcgagacaagaaaaccgaggaaaacggcccctaagacctcctaaatctagtggtcgtccgtccggttgcacgacggtcgccgtaccgaaggaacgacttcgaggcgggtggtggatcggtagggcagtatttaccactctacaactatacaaactccacctgacgnggtctagggtaacgttatttacgaaccttaactttactacgttgtacaggtacgacgtactaaaggcggtcctacccgacccccgtaaaccgttccgggaaccggtaacggggaccaacgggtacgtaacggggtaaactaaacgttaaaacgacgtggtacggcgtacgacctactcgttacttacg

SEQ ID NO: 420223 - DNA, 628 bp, Homo sapiens
  misc_feature: GZ8MTXP02GCGNZ.9.59.F04.1.454.CMB.2.raw
  modified_base (199)..(199): a, c, t, g, unknown or other
  modified_base (224)..(224): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttcgtggctgcatctgtggganacacagtcaccatcaattgtcgggnagtcaggatggttggcgaccgtcttagtctggtatcagcaagaaaccaaggaaaacgccctagactactaatctagtggtcgcgttcccggttgcacgtaggtcggccgtacccgaaggtaacgtattccgaggccggggacggtggacgtcgtaggggctaagtactttccgacttcctaccaacctataccaaactccaaccgttgaccgagggtctaggtaggtacttttcgaacctaaactttaactacgttcgtaccgaagtacgaacggactaaacgacggtcctaccgaccccccgtaacgttccggaaccggacggggtaccacggtaccgtagggaacgtaaacgttaaaacgacgtcgtacgggtaccacggtacctaaaccgtacttacgtcg

SEQ ID NO: 420224 - DNA, 530 bp, Homo sapiens
  misc_feature: GZ8MTXP02F6OI3.9.59.F04.1.454.CMB.2.raw
  modified_base (201)..(201): a, c, t, g, unknown or other
  modified_base (301)..(301): a, c, t, g, unknown or other
  modified_base (311)..(311): a, c, t, g, unknown or other
  modified_base (374)..(374): a, c, t, g, unknown or other
  modified_base (414)..(414): a, c, t, g, unknown or other
  modified_base (434)..(434): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgtcgggcagtcaggatgttggcgaccgcttagtctggtatcagcagaaaccaggaaacgccctagactcctaatctatggtncttcccggtncacgagtcggctccgaggaacgatcgaggcggcggtgatcgtagggcagtattcactctcacntcaatcactgcaggctgagtatttgactaactttagactntacagtcaacggactaacgnggtacctcgaccccctacgttcggaccgacggggacaacgacgtaggaactaacgttaaacgacgtcgtcggactacggaccaaccgtctcgtacg

SEQ ID NO: 420225 - DNA, 579 bp, Homo sapiens
  misc_feature: GZ8MTXP02FOV6B.9.59.F04.1.454.CMB.2.raw
  modified_base (254)..(254): a, c, t, g, unknown or other
  modified_base (319)..(319): a, c, t, g, unknown or other
  modified_base (416)..(416): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtcctccatcttccgtggctgcatctgtgggagactcagtccaccatcaattggtcgggcgagtcgaggatggttggcgaccgtnttagtctggtatcagcaagaaaccgaggaaaacgcctagactctaatctatggtcgcgtccggtncacaggtcgcgtaccgaggactagtcgaggcggtcgggtggagtcgtagggctagtactttacgacttctaccacctatacaactccacctgaccgnggtcgtaggtagttatttcgaacttaacgttactactgtaccagacgaggactaacggcgtccaccggacccctaacgttcccggacgacggggtacacggtacacgggtaacgtaaactaacggtacgtgttcgggaactcggacaccgtaacgtctttccg

SEQ ID NO: 420226 - DNA, 614 bp, Homo sapiens
  misc_feature: GZ8MTXP02FSPSH.9.59.F04.1.454.CMB.2.raw
  modified_base (202)..(202): a, c, t, g, unknown or other
  modified_base (300)..(300): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctggtggganactcagtcaccatcaattgtcgggcagtcaggatgttggcgacgcttagtctggatcagcaagaaaccaggaaaacggccagactactaatctatggngtccgtccgtgcacgagtcgacgtccgaaggaacgtatcgagcgggtcggagatcggtaaggggctaaggtactttcaacttcaccaacctatacaactaccaccctgacgaggtctaggtaggtattttgaactaaacttactaacgttgtacaggactacggtacaacgtagggtcctaccgtacccccgtaaaaccgttcgggaacccggaacgggggtaaacccaacggggtaaacccgtagggggtaaaactaaaacgttaaaacggtacgtaaggttacggacttcgaacgtaccctattcgtttccg

SEQ ID NO: 420227 - DNA, 521 bp, Homo sapiens
  misc_feature: GZ8MTXP02JL2BZ.9.59.F04.1.454.CMB.2.raw
  modified_base (200)..(200): a, c, t, g, unknown or other
  modified_base (224)..(224): a, c, t, g, unknown or other
  modified_base (367)..(367): a, c, t, g, unknown or other
  modified_base (411)..(411): a, c, t, g, unknown or other
  modified_base (429)..(429): a, c, t, g, unknown or other
  modified_base (438)..(438): a, c, t, g, unknown or other
  modified_base (511)..(511): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtggctgcatctgtggganacacagtcaccatcaattgtcggnagtcaggatggttgcgacgcttagtctggtatcagcagaaaccaggaaagccctagactcctaatctatggtgacgtccggttgcacgagtggcgtcccaggaacattcagcggcggtgatcgtagggcagactttcacttcncaccattacaacgtcacctgcaggctgaggatttgctaacttanactgtcaggcaggctaanaggctaccnccccgtaaacttcggaccgtaggggacaacggttacaggtacgaaacgttaaacgacgtggtacgctggaccnctatcttacg

SEQ ID NO: 420228 - DNA, 625 bp, Homo sapiens
  misc_feature: GZ8MTXP02G16OM.9.59.F04.1.454.CMB.2.raw
  modified_base (202)..(202): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctggtggganactcagtcaccatctaattggcgggcgagtcgaggtatggttcggcgaccgtcttagtctggtatcagacaagaaaaccaggaaaacgccctaagacctactaatctatggtcgccggttccggtgccagtgtcggccgtaccgaaggaaccgtatcgacggcggaggtggatcggtagggctaggtacttccgactcctacaacctataccaaacttccgactacgacgtacggtctaggtaagtttattacgtaaccttaaaccgtttactacgttgtacagaccgagtactaaacgcgtaccgtccgaccccctaaacggtccgaccgggaaacgggtaccacggtaaacgtaggaacgttaaaacgtaaacggacgttaaggacgggtacctcgacctaccgttaccgtcgtttaaccg

SEQ ID NO: 420229 - DNA, 563 bp, Homo sapiens
  misc_feature: GZ8MTXP02I58F6.9.59.F04.1.454.CMB.2.raw
  modified_base (201)..(201): a, c, t, g, unknown or other
  modified_base (234)..(234): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtggganactcagtcaccatcaattgtcggcgagtcaggntggttggcgaccgcttagtctggtatcagcagaaaccaggaaaacgccctagactctaatctaatggtgcgtccggttgcacgagtggccgtccgaggtaacgattcgaggcggcgtggactcgtagggcagtatttcgactcctcactatcaacttccaccgtgaccgagtcgtagtagtatttgacttaacttactactttgactaggacacggacttaacgacggtcctacggaccccctaaacgttcccggacggaacggggacctacggaacgtaggacgtaaacgtaaaccgaagttggcgtacgtacgacctactcttcgtc

SEQ ID NO: 420230 - DNA, 654 bp, Homo sapiens
  misc_feature: GZ8MTXP02IOFJG.9.59.F04.1.454.CMB.2.raw
  modified_base (225)..(225): a, c, t, g, unknown or other
  modified_base (233)..(233): a, c, t, g, unknown or other
  modified_base (244)..(244): a, c, t, g, unknown or other
  modified_base (310)..(310): a, c, t, g, unknown or other
  modified_base (314)..(314): a, c, t, g, unknown or other
  modified_base (413)..(413): a, c, t, g, unknown or other
  modified_base (644)..(644): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtggctgcatcgtggtggagactcagtcaccatcaattgtcggnagtcaggntgtgcgacgtnttagctggtatcagacaagaaaccgaggaaacgccctagactctaatctagtgtcgtcgtccggtncagnggtcgcctaccgaaggatcgtcgacggcggcggtagacgtcgggtagggactaacggtacttttccacgtttacctaccgtaacctataaccctaaacnccgtaacccgttgacgacggtcgtacgggtaagttagttttccgaaacttaaaccgtttacgtaccgttaggtaccgaacggactaaccgggtacttaaaacggcgtaccccgtccgtaacccccgtaacgtcccgggacggaacgggggaccaacgggtaactacgggggtaaaacttaaaccggtaaacggtaccgttgggtaacggtccttacgaatttcgttaaccncgtttaaccg

SEQ ID NO: 420231 - DNA, 587 bp, Homo sapiens
  misc_feature: GZ8MTXP02GQCF1.9.59.F04.1.454.CMB.2.raw
  modified_base (183)..(183): a, c, t, g, unknown or other
  modified_base (201)..(201): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgnggctgcatctggtggganctcagtcaccatcaattggcgggcagtcagggatgttcggcgaccgtcttagtctggtatcagcaagaaaccaggaaaaggccctagactctaatctatggtgcgtcccgttgcacgtagtcggccgtcccaagggaacgtagttcgacggcgggacgggtggtatcgtaggggcaggtatttcgaactcgtcaaccctataccaaatccgacctgcaggctagaggttatttgactaaacttactactagtcaggacaacgggtactaaacgcggtaccgtaccgtacccccgtaaaccgttaccggacccgaacgggggacctaaacggacgtaagggacgtaacggtaaaacgtacgtgtacgcgtacgccaactagtctacg

SEQ ID NO: 420232 - DNA, 587 bp, Homo sapiens
  misc_feature: GZ8MTXP02FIS55.9.59.F04.1.454.CMB.2.raw
  modified_base (201)..(201): a, c, t, g, unknown or other
  modified_base (267)..(267): a, c, t, g, unknown or other
  modified_base (304)..(304): a, c, t, g, unknown or other
  modified_base (391)..(391): a, c, t, g, unknown or other
  modified_base (457)..(457): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtggctgcatctggtggganactcagtccacatcaattggtcgggcgagtcaggatggttggcgaccgtcttagtctggtatcagnaagaaaccaggaaaacgcctagactctaatctatggngcgtccggtgcagagtcgtcgtccgaggaacgtattcaggcggcggtggatcgtagggcaagtacttcactctacacctataccaancctaactgcaggtcgtaggaggttatttacgactaacttactactgtcaggctaacggacgaaacncgggtcctacccggtacccccaccggttacccggacccgaacgggggaaaccacggtaacgtacgggaacgtaaaccgtttaaaacgaccgtgggtccgtacgtacgaccctaccgtacgtccctttacg

SEQ ID NO: 420233 - DNA, 642 bp, Homo sapiens
  misc_feature: GZ8MTXP02FI5FI.9.59.F04.1.454.CMB.2.raw
  modified_base (250)..(250): a, c, t, g, unknown or other
tcagtgatacgtctcacgaccggtgctcgatttagtacacacacttagggattgggggcaggagtcagacccagtcaggacacagcatggacatgagggtcccccgctcagctcctggggctcctgctgctctggttccccggttcgagatgcgacatccagatgacccagtctcatcttccgtggctgcatctgtgggagactcagtcaccatcaagttgcgggcgagtcaggatggttggcgaccgtnttagtctggtatcgagacaacgaaaaccgaaggaaaacgcctaagactactaatctagtggtcgccggttccggtgcacgtaggtcggccgtacccgaggaacgtagttcgaggcggggtcgggtggaacttcggtagggctaggtactttcaactctacaacctataccaatccaaccgtgacgaggtcgtagtacggttatttcgaacttaaacttactactgtacgagacgaaggtactaaacgacgtcccgtacccgaccccccgtaacgttcccgggacccgtaaacgggggaccctaaaccgggacgttaacgggaaacgttaaaacgttaaaaccggtaaacgtcggtacggtactacggaccaaccgttaacttccgtttaccg

SEQ ID NO: 420234 - DNA, 579 bp, Homo sapiens
  misc_feature: GZ8MTXP02FXJSJ.9.59.F04.1.454.CMB.2.raw
  modified_base (200)..(200): a, c, t, g, unknown or other
  modified_base (254)..(254): a, c, t, g, unknown or other
  modified_base (579)..(579): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtggctgcatctgtggganacacagtccaccatcaagttggtcgggcgagtcgaggtatggttggcgaccgtnttagtctggtatcagcaagaaaccaggaaaacgccctagacctactaatctagtggtcgtccggtcccggtgcacgaggtcggaccgtaccaaggaatacttcgaggccggtaggtagacgtcggtagggctaagtacttcactctacacatcatccactgacagctaggtagttactttcgaacttaaactttacgtacgtgtacacggtacgaacggtacctaaacgcggtacccgtaccgaaccccctacggtcccgggacgtacggggaccacggacgtagaacgtaactaaacgactggtcgactcgaccactgtacctn

SEQ ID NO: 420235 - DNA, 642 bp, Homo sapiens
  misc_feature: GZ8MTXP02G9XU3.9.59.F04.1.454.CMB.2.raw
  modified_base (200)..(200): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtggctgcatctgtggganactcagtcaccatcaattgtcggcagtcaggtatgttggcgacgtcttagtctggtatcagcaagaaaccgaggaaaacgcccctagacctacctaatccgtagtggtcgtccgttccccggttagctaacgacggtcggtacccgtacccgaaggaacgtaacttccgagggcgggcggtaggatccggaggggctaagtactttcgacttctaccacgtatacaatcctaacctgacgacgggtactaggtaaggttacttttgaaaccttaaacttaaccttaaccgttacgtaccgagaccgtacggacctaacggacgtacccgtacccgacccccgtaacgttcccgggaaccggacgggtaaccaccggtaacgtacggtaaacgtaaacgttaacgaacgttggacgtccgtacaccgtactaccgttacgtcg

SEQ ID NO: 420236 - DNA, 606 bp, Homo sapiens
  misc_feature: GZ8MTXP02JEZX8.9.59.F04.1.454.CMB.2.raw
  modified_base (201)..(201): a, c, t, g, unknown or other
  modified_base (324)..(324): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtggctgcatctggtggganactcagtccaccatcaattcggtcgggcgagtcaggatggttggcgaccgtcttagtctggtatcagacaacgaaaccgaaggaaacgccctagactacctaatctatggtgcgtcccggttncacgagtcggccgtaccgaggaacgattcgagcgggcggtggactcggagggactaggtacttcacttcaccacctatacactccactgacaggctaggtacggtatttcgacttaactttactacgttcgtacgagccaagggtacctaaacgcgggtccctaacccggtaccccccgtaacgttccggggaccgacgggggtaaccaaaccgggacgttacgggaaacgtaaaccgtttaaacgaacgtggtcggacctcggaccacctagttaccttcg

SEQ ID NO: 420237 - DNA, 666 bp, Homo sapiens
  misc_feature: GZ8MTXP02GIM8O.9.59.F04.1.454.CMB.2.raw
  modified_base (201)..(201): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtggctgcatctggtggganacacagtcaccatctaagttggtcgggcgagtcgaggtagttggttacgggcgaccgtcttaggtctggtatcagcaagaaaccgaggaaaacgccctaagactaccttaatctatggtcgtccggttcccggttgctacgaggttcggccgtacccgaaggaacgacttcgaggtcggggcggtggatcggtagggctagttacttccgactccgtcctaaccctattaccaactccgaccttgaccgtagggcttagggtaagttacgttttagaacccttaaatttacctaccgttgtcgaacgtcgaacgggtactaacgcggtaccctacccggtaccccctaccggttacggaccggaacgggggttaaccacggtaacggtaaggaaccggttaaaacgttaaacccgaaacgtttgggacggttaacccgtcggaaccctacgttacgtttacttcg

SEQ ID NO: 420238 - DNA, 552 bp, Homo sapiens
  misc_feature: GZ8MTXP02GUP87.9.59.F04.1.454.CMB.2.raw
  modified_base (200)..(200): a, c, t, g, unknown or other
  modified_base (261)..(261): a, c, t, g, unknown or other
  modified_base (313)..(313): a, c, t, g, unknown or other
  modified_base (465)..(465): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtggctgcatctgtggganactcagtcaccatcaattggtcgggcagtcaggatggttggcgacgtcttagtctggtatnagcaagaaaccaggaaacgccctagactcctaatctatggtcgcgtccggtncacgaggtcggccgtccaggaacgtacttcgaggcgggtcggtggaagtcgtaggggctaggtactttccgacttctaccacctatacaatccacctgcgaggctaggagtatttcgactaacgtttactacttgtacagcaggactaacgngcctccgaccccctaacgtccggaccgaggggaccacgacgtggaacgtaactaaacgacgtgtcgactcgaccacctactcttacg

SEQ ID NO: 420239 - DNA, 779 bp, Homo sapiens
  misc_feature: GZ8MTXP02F8T5Q.9.59.F04.1.454.CMB.2.raw
  modified_base (200)..(200): a, c, t, g, unknown or other
tcagtgatacgtctcacgaccggtgctcgatttagtacacacacttagggattgggggcaggagtcagacccagtcaggacacagcatggacatgagggtccccgctcagctcctggggctcctgctgctctggttccccggttgagatgcgacatccagatgacccagtctccatcttccgtggctgcatctgtggganacacagtccaccatcaattggtcgggcagtcaggtatggttggcgaccgtcttagtctggtatcagcaagaaaccaggaaacgcctagacctctaatctagtggtcgtccgtccggttgcacgtaggtcggccgtacccgaaggaacgtacgttcgacggcgggtcgggtaggacttcggtagggactaggtactttacgaacctttcgtaccaaccctagtaccctaaactcccgtaccgttgaccgtaacgggtcgttagggtaaacgggtttacgtttttacggaaacctttaaaaccttttaaccgttacccgttacggttacccgaacggtaccgtaaacgggtacccgtttaaaaaccggccgggtaaccccgttaccccccgggtaaaccccccccgttaaaaccgggtttacccccgggggaaaacccgggtaaaccggggggttaaaccccaaaaccggggttaaaccgggttaacgggtaaaaccggttaaaaccgtttaaaaccgggaacgttcggggtaaacggtcccgttacgggaacccctaaacccgttaggttcctttacccg

SEQ ID NO: 420240 - DNA, 731 bp, Homo sapiens
  misc_feature: GZ8MTXP02JIWCC.9.59.F04.1.454.CMB.2.raw
  modified_base (202)..(202): a, c, t, g, unknown or other
  modified_base (508)..(508): a, c, t, g, unknown or other
tcagtgatacgtctcacgaccggtgctcgatttagtacacacacttagggattgggggcaggagtcagacccagtcaggacacagcatggacatgagggtcccccgctcagctcctggggctcctgctgctctggttccccggttcgagatgcgacatccagatgacccagtctccatcttccgtggctgcatctgtggganactcagtccaccatactaagttggtcgggcgtaagtcgaggtagttggttcggacggtaccgtcgttacgttcgtggtactcagaccgaaacgaaaaccgaacgggaaaacggccctaagacctctaaatcgtagtcggtacgtccggtcccggttagcctacgtaggtcggccgtacccgaagggtaacgtacgttacgacggtcgggtcgggtaggtacgttcggtaggggaccgtaaggttactttcctaaccttcctacctaaaccctaagttacccaaaactccctacccgtgggaacccncggggtacgtaaggggttaagtactttttacggaaacccttaaaccttttacgtaacgttcggactaacgggccgtaacgggtactaaaccggtccgggtacctcccccggtaaccccctaaaccgggttcccggaaccgggacgggggaacctaccggacgttaggaacgtaaaaccgttaacgaacgttggtacgtcaacggtccaaacttcgtctttacg

SEQ ID NO: 420241 - DNA, 728 bp, Homo sapiens
  misc_feature: GZ8MTXP02HUUZU.9.59.F04.1.454.CMB.2.raw
tcagtgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatcgacccagtctccatcttccgtggctgcatcgtggtgggacactcacgtccaccaatctaagttggcgggcgtagtcgaggatggttcggcgaccgtcttagtcgtggtatcagacaagaaaccgaaggaaacggcctagacctacctaatctagtcggtcgtccggttcccggttgcgacgtacggtcgtccgtaccgaaggtaacgtacgtttcgacggtcggggtcggttaggtacgttcgggtaacgggacgtaagttactttacaccttactaccaacctacttaccgaaacttccgaactggacgaggtctaaggtacggttatttacggacctttaacctttaacgtcttacggacgtaacggaccgaaacgggtaccttaaacggaccggtacccgttaccccgtaaccccccgttaaacgggttccccgggtaccggaaaaccgggggtacctaaacccgggtagttaaacggggtaaacgttaaacggttaaaaccgtacggttaacgggcggtacccgtacgaacccttaaaccgtacgtttaccggtttaccg

SEQ ID NO: 420242 - DNA, 522 bp, Homo sapiens
  misc_feature: GZ8MTXP01EMAQW.13.73.G07.1.454.CMB.2.raw
  modified_base (407)..(407): a, c, t, g, unknown or other
  modified_base (417)..(417): a, c, t, g, unknown or other
tcagtcacgtactacacgaccggtgctcgatttagctctacgctcaggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtcggcagaggccaggccaatctccaaaggcgacctaatttataaggtgtctgacaggactcgggtccagacagacttcagcgcagtgggtcaaggcactgatttcacactagaaaatcagcagggtggagctgaggatgttatggctntagttattgnatgcaagacaacacactacggccgtacgtaactttacggttccgacggggaccgaaacggacgttaggaggagtaacaataacgaacgtagttggcgttgaaccg

SEQ ID NO: 420243 - DNA, 509 bp, Homo sapiens
  misc_feature: GZ8MTXP01DSN8N.13.73.G07.1.454.CMB.2.raw
  modified_base (356)..(356): a, c, t, g, unknown or other
  modified_base (408)..(408): a, c, t, g, unknown or other
  modified_base (478)..(478): a, c, t, g, unknown or other
tcagtcacgtactacacgaccggtgctcgatttagctctacgctcaggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcggcagaggccaggccaatctccaaaggcgcctaatttataaggtgtctgacagggactccgggggtcccagacagattcagcggcagtgggtcnggcactgatttcacactgaaaatcagcagggtgaggctgaggatgtatgggntctagttattgcatgcagacaacacactagccgtactaactttcggttcgacgggaccgaacgacttggngagtcaataacgaactgttggtcgttgtccg

SEQ ID NO: 420244 - DNA, 541 bp, Homo sapiens
  misc_feature: GZ8MTXP01ATGOW.13.73.G07.1.454.CMB.2.raw
tcagtcacgtactacacgaccggtgctcgatttagctctacgctcaggggatcaggactcctcagttcaccttctcacaatgaggctccctgctcagctcctggggctgctaatgctctgggtcccaggatttagaggggatgctgtaatgactcagtctccactctccctgcccgtcacccttggacagcccggcctccatctcctgcagttctagtcaaagcctcgtacatcatgatgggcacacctacttgaattggtcgcagaggccaggccaatctccgaaaggcgacctaatttataaggtgtctgacgagggactccggggtcccagacagacttcagcggcaggtgggtcaaggcacgtgatttcaacactagaaatcagcgagggtggaggcgtaggaggagtgttagtgggtctgtattagttgcatgcaagacaaacactaacgtcggtccgttaactaacgttttcgggccgtaacggggaccgaagtcgttaggagttactaacaatcgaacgtggttgcgttgaacc

SEQ ID NO: 420245 - DNA, 545 bp, Homo sapiens
  misc_feature: GZ8MTXP01AUOIW.13.73.G07.1.454.CMB.2.raw
  modified_base (356)..(356): a, c, t, g, unknown or other
tcagtcacgtactacacgaccggtgctcgatttagctctacgctcaggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcggcagaggccaggccaatctccaaaggcgcctaatttataaggtgtctgacagggactccgggggtcccagacagattcagcggcagtgggtcnggcactgatttcacactagaaatcagcgagggtggaggcgtgaggagtgttattgggctcgtattattgcagtgcaagcaaacactacgtggaccgtcaacgttttggacccgtagggggacccaaaggccgttagggaacggacttaaccgaatccggaaacgttggttacggccgttcgggaacccg

SEQ ID NO: 420246 - DNA, 498 bp, Homo sapiens
  misc_feature: GZ8MTXP01DE3JP.13.73.G07.1.454.CMB.2.raw
  modified_base (380)..(380): a, c, t, g, unknown or other
  modified_base (386)..(386): a, c, t, g, unknown or other
  modified_base (408)..(408): a, c, t, g, unknown or other
  modified_base (417)..(417): a, c, t, g, unknown or other
  modified_base (420)..(421): a, c, t, g, unknown or other
  modified_base (423)..(423): a, c, t, g, unknown or other
  modified_base (425)..(425): a, c, t, g, unknown or other
  modified_base (479)..(479): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtccaggatttagaggggatgctgtaatgactcagtctccactctccctgcccgtcacccttggacagccgcctccatctcctgcagttctagtcaaagcctcgtacatcatgatgggcacactactgaattggtcgcagagcagcaatctcaagcgactaaattataaggtgtctcacaggacctccggggtcccagacagacttcagcggtcaggtgggtcaaggcactgactttacaacaactagaaaatcgagngagggngaggctgagtatgttatggctntagtattgntannananacaacacacgtacgtcgtactaacgttcggacgacggacgaagagagagataanataacgagtgttgtcgcgc

SEQ ID NO: 420247 - DNA, 558 bp, Homo sapiens
  misc_feature: GZ8MTXP01C7A83.13.73.G07.1.454.CMB.2.raw
  modified_base (266)..(266): a, c, t, g, unknown or other
  modified_base (354)..(354): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcggnagaggccaggccaatctccaaaggcgacctaattataaggtgtctgacagggacgtccgggtccagacagacttcagcgcagtgggcnggcactgatttcacactagaaatcgagcgagggtggaggctggagagtgttagtgggctctagttattgcatgacaagacaacgactacgtcggaccgtacgtaacgttttcgggaccgtaacggggacccgggaaagaccgttagggagttaacgttaacccgaaagttccgtaaaccgtggttcggtcgttcggtaaccccg

SEQ ID NO: 420248 - DNA, 597 bp, Homo sapiens
  misc_feature: GZ8MTXP01BPUDY.13.73.G07.1.454.CMB.2.raw
  modified_base (301)..(301): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcggcagaggccaggccaatctccaaggcgcctaatttanaaggtgtctgacagggactccggggtccagacagacttcagcgcagtgggtcaaggcactgatttcgacactagaaaatcagcgagggtggaggcgtaggaggtagttaggttaagttggggtacttcgttaatttagtttggtactagttggccaaagcaaaccactaaccgttaggcccgttaacgtaacgttttcgggacccggtaaggggaccccgaaaggccgttagggacgttacgttaaccgaaagttaacccggtaaaccgttagggttacgggccgttcggaacccg

SEQ ID NO: 420249 - DNA, 518 bp, Homo sapiens
  misc_feature: GZ8MTXP01ETTAU.13.73.G07.1.454.CMB.2.raw
  modified_base (352)..(352): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcggcagaggccaggccaatctcaaggcacctaattataagtgtctgacagggactccggggtccagacagacttcagcggcagtgggtcnggcactgatttcacatagaaaatcagcgagggtggaggcgtgaggatgttatgggtctcgtattattgcatgcaagcaaacactactcggccctaactaacttttcggccgagggggaacccaaggcgttaggaggattcaatcgaactgttcggtcgttgaaccc

SEQ ID NO: 420250 - DNA, 584 bp, Homo sapiens
  misc_feature: GZ8MTXP01BYNK0.13.73.G07.1.454.CMB.2.raw
  modified_base (366)..(366): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcggcagaggccaggccaatctccgaaaggcgtacctaatttataaggttgtactgacgacgggactccggggtcccagacagacttcagcggcaggtcgggtcngggcaactgatttcacactagaaatcgagcgagggtggaggcgtaggaggtagttggttagttgggtacttacgttatttaagtttgacgtagtgaccgaaggcaaacacgtacgtcgggtacccgttacgtaacgttttcgggaccggtacggggacccgaaaggccgttaggcgacgtaacaacgtcgtaacgtcggttcggtccgttcgaacccg

SEQ ID NO: 420251 - DNA, 571 bp, Homo sapiens
  misc_feature: GZ8MTXP01EMIPQ.13.73.G07.1.454.CMB.2.raw
  modified_base (420)..(420): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcggcagaggccaggccaatctccaaaggcgacctaatttataaggtgtctgacagggactccggggtccagacagacttcagcggcaggtgggtcaaggcactgatttcacactagaaaatcagcgagggtggaggctggaggtatgttagtgggctntagttattgcagtgacaagacaaaccactaacgtggacccgttaacgtaacgttttgggacccgtaagggggaccctaaaggccgttagggacgttaagttaacgaaaacgttccggtaaaaccgtgggttacggggtccttggaaccccg

SEQ ID NO: 420252 - DNA, 521 bp, Homo sapiens
  misc_feature: GZ8MTXP01AM033.13.73.G07.1.454.CMB.2.raw
  modified_base (357)..(357): a, c, t, g, unknown or other
  modified_base (402)..(402): a, c, t, g, unknown or other
  modified_base (414)..(414): a, c, t, g, unknown or other
tcagtcacgtactacacgaccggtgctcgatttagctctacgctcagggggatcaggactcctcagttcaccttctcacaatgaggctccctgctcagctcctggggctgctaatgctctggttcccaggatttagaggggatgctgtaatgactcagtctccactctccctgcccgtcacccttggacagccggcctccatctcctgcagttctagtcaaagcctcgtacatcatgatgggcacacctacttgaattggttcggcagaggccaggccaatctccaaggcgcctaatttataaggtgtctgacagggactccgggggtcccagacagacttcagcggcagtgggtcnggcactgatttcacactagaaaatcagcaggggtgaggctggagntgttagttgggntcgtattattgcatgacaagcaaacactacgtcggccgtactaacgttttggaccgtaggggacccaaggcttggagatcgaatcgaactggttacggtcttgaacc

SEQ ID NO: 420253 - DNA, 564 bp, Homo sapiens
  misc_feature: GZ8MTXP01B4DCN.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcggcagaggccaggccaatctccaaaggcgcctaatttataaggtgtctgacgagggacctccggggtccaggacagacttcgagcggcaggtgggtcaaggcactgatttcacactagaaatcgagcgaggggtggaggcgtggaggtagttggttagttggggtacttacgttatttaagtttggactagttgacgaaagacaaaccactaaccgtggcccgtactaacgttttcgggaccgtagggggaccaaaggtcttagggagactaacaagtccgaagtggttggtcgttgaacc

SEQ ID NO: 420254 - DNA, 516 bp, Homo sapiens
  misc_feature: GZ8MTXP01CJWTR.13.73.G07.1.454.CMB.2.raw
  modified_base (486)..(486): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcgcagaggccaggccaatctccaaggcgcctaatttataaggtgtctgacagggactccggggtcccagacagacttcagcggcagtgggtcaaggcactgattcacactagaaatcagcgagggtggaggctgaggtatgttatgggctcgtattattgcatgcaagcaaacacactggccgtactaacgttttcggccgacgggggaccaaaggcttagggngataacaattcgaactggttgcgttgaacc

SEQ ID NO: 420255 - DNA, 552 bp, Homo sapiens
  misc_feature: GZ8MTXP01ARSA0.13.73.G07.1.454.CMB.2.raw
tcagtcacgtactacacgaccggtgctcgatttagctctacgctcaggggatcaggactcctcagttcaccttctcacaatgaggctccctgctcagctcctggggctgctaatgctctgggtcccaggatttagagggatgctgtaatgactcagtctccactctccctgcccgtcacccttggacagccggcctccatctcctgcagttctagtcaaagcctcgtacatcatgatgggcacacctacttgaattggtcgcagaggccaggccaatctaccaaggcgtacctaatttataaggtgtctgacagggtactccggggtccagacagacttcgagcggcagtgggtcaaggcactgattcacactagaaatcaagcgagggtggaggctgagattgttatgggacttcgtagttattgctagtgacaagcaaactacacgtcggaccgtaagtaacgtttcgggacccgaagggggacccaaggtaccttggggagacttaaccgaaattaaccggaacgtggttacgggcccttgggaacccc

SEQ ID NO: 420256 - DNA, 551 bp, Homo sapiens
  misc_feature: GZ8MTXP01B30ZD.13.73.G07.1.454.CMB.2.raw
  modified_base (357)..(357): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcggcagaggccaggccaatctaccaaggcgacctaatttataaggtgtctgacagggactccggggtccagacagacttcagcggcagtgggtcnggcactgatttcacactagaaatcaggcgagggtggaggctaggaggtattggttagttgggcttacgttagtttattggcagtgacaaggcaaacacgtacgtcggccgtactaacgttttcggaccgtaacgggggaccctaaaggcgttagggacgataacaagtcgaacgtggttagggtcttggaaccc

SEQ ID NO: 420257 - DNA, 598 bp, Homo sapiens
  misc_feature: GZ8MTXP01DNG3Y.13.73.G07.1.454.CMB.2.raw
  modified_base (360)..(360): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcgcagaggccaggccaatctccaaggcgacctaatttataaggtgtctgacgagggacgtccgggtcccagacagtacttcgagcggcaggtgggtcnggcacgtgatttcacactagaaaatcgaaggcgaggggtggaggtctaggaggtagttggttagttgggcttacgttatttaattggactagtgacaagacaaacactacgtggtacccgttaacgtaaccgttttcgggacccgtaacgggggaacccaaagggtcccgttagggagttaacgtaacccgtaaaagtcccggtaaacgttgggttcgggtaaccttcggtaaccccg

SEQ ID NO: 420258 - DNA, 568 bp, Homo sapiens
  misc_feature: GZ8MTXP01EZ0JR.13.73.G07.1.454.CMB.2.raw
  modified_base (301)..(301): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtcgcagagcaggccaatctcaagcgactaatttataaggtntctgacgagggactccggggtcccagacagacttcgagcggcaggtcgggtcaaggcaacgtgactttacacacgtagaaaatcgagtcgagggtggaggacgtaggaggtagttgttagttgggtcttacgttagtttaattggctagtgacaagacaaacactacgtcggtacccgtaacgtaacgttttcgggaccgaacgggggaccgaaaggcgttagggacgttataacgaagtcgtaacgtggttcggtcgttggaaccc

SEQ ID NO: 420259 - DNA, 603 bp, Homo sapiens
  misc_feature: GZ8MTXP01BDYYG.13.73.G07.1.454.CMB.2.raw
  modified_base (309)..(309): a, c, t, g, unknown or other
  modified_base (356)..(356): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtcggcagaggccaggccaatctccgaaaggcgacctaatttataaggtntctgacagggactccggggcccagacagattcagcggcagtgggtcnggcatgatttcaacactagaaatacagacgaggggtaggaggacgtggaaggtagtaggttagttggggtacttacgttaagtttaagtttggactaagttagacgaaacggaaccaaaccacgtaaaccgtcgggtacccggttaactaacgttttcgggaccggtaacgggggaacctaaacggcgttagggggagttaactaaccgtaaagtaaccggaaacgtggttacgggcttcgggaacc

SEQ ID NO: 420260 - DNA, 506 bp, Homo sapiens
  misc_feature: GZ8MTXP01CHZA7.13.73.G07.1.454.CMB.2.raw
  modified_base (345)..(345): a, c, t, g, unknown or other
  modified_base (376)..(376): a, c, t, g, unknown or other
  modified_base (414)..(414): a, c, t, g, unknown or other
  modified_base (477)..(477): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcgcagaggccaggccaatctccaaggcgcctaatttataaggtgtctgacagggactccgggggtccagacagacttcagcgnagtgggtcaaggcaactgtattcaacactanaaaatcagcgagggtgaggctgaggatgttattggctntattattgcatgcaagcaacactactggcctagtctttggccgtaggggccaaagcgttgganagtcaagtccgaatggcggtcttgaaccc

SEQ ID NO: 420261 - DNA, 558 bp, Homo sapiens
  misc_feature: GZ8MTXP01D8Z4K.13.73.G07.1.454.CMB.2.raw
  modified_base (305)..(305): a, c, t, g, unknown or other
  modified_base (347)..(347): a, c, t, g, unknown or other
  modified_base (357)..(357): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttacaggggatgctgtaatgactcagtctccactctccctgcccgtcacccttggacagccggcctccatctcctgcagttctagtcaaagcctcgtacatcatgatgggcacacctacttgaattggttcggcagaggccaggccaatctcaaggcgctaatttataaggtntctgacgagggacctccggggtcccagacagacttcagcggnaggtgggtcnggcactgatttcacactagaaatcagcgagggtggaggctggagagtgttagttgggcttacttagttatttggactagtcgacaagacaaacactacgtcggcctactaacgtttcggaccgtacggggaacccgaaggacgttaggagttacgttaaccgaaagttccggaaacgtggttacggtcgttcggtaacccg

SEQ ID NO: 420262 - DNA, 534 bp, Homo sapiens
  misc_feature: GZ8MTXP01C7UVH.13.73.G07.1.454.CMB.2.raw
  modified_base (358)..(358): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcggcagaggccaggccaatctccaaggcgacctaatttataaggtgtctgacagggactccgggggtcccagacagacttcagcggcagtgggtcnggcactgattcacactagaaaatcagcgagggtggaggctgaggtatgttagtgggcttctagttatgcagtgacaagcaaacactacgttaggccgttaactaacgttttcgggaccgaaggggacccaaaggcgttagggcgataacaagtccgaatggttaggtccttgaacc

SEQ ID NO: 420263 - DNA, 519 bp, Homo sapiens
  misc_feature: GZ8MTXP01AK5IB.13.73.G07.1.454.CMB.2.raw
  modified_base (355)..(355): a, c, t, g, unknown or other
  modified_base (414)..(414): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcggcagaggccaggccaatctccaaggcgcctaatttataaggtgtctgacagggactccggggtccagacagacttcagcggcagtgggtcnggcactgatttcacactagaaatcagcgagggtggaggctgaggatgttagtgggcttntattattgcatgcagcaacacgtactggcctactaacgttttcgggccgagggggaccaaaggtcgttgggagagtcaagtcgtaacgtggttcggcttggaacc

SEQ ID NO: 420264 - DNA, 532 bp, Homo sapiens
  misc_feature: GZ8MTXP01C1C0C.13.73.G07.1.454.CMB.2.raw
  modified_base (361)..(361): a, c, t, g, unknown or other
  modified_base (425)..(425): a, c, t, g, unknown or other
  modified_base (439)..(439): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcggcagaggccaggccaatctccaaaggcgacctaatttataaggtgtctgacagggacctccgggggtcccagacagacttcagcggcaggtgggtcnggcactggatttcacactagaaatcagcgagggtgaggctgagatgttatggactgtattatgnatgacaagcaaacnctaactcggaccgttataacgttttcggaccgtaggggacccaaaggcgttagggagttactaacgaaacgtcgaacgtggttgcgttgaacc

SEQ ID NO: 420265 - DNA, 561 bp, Homo sapiens
  misc_feature: GZ8MTXP01B5BMM.13.73.G07.1.454.CMB.2.raw
  modified_base (362)..(362): a, c, t, g, unknown or other
  modified_base (416)..(416): a, c, t, g, unknown or other
  modified_base (418)..(418): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcggcagaggccaggccaatctaccaaggcgacctaatttataaggtgtctgacgagggacctccgggggtcccagacagacttcagcggcaggtgggtcnggcactgatttcacactagaaatcagcgagggtgaggctggagatgttagtggntntagttattgctagtgacaagctaaacacgtacgtacggcccgttaacttaaccgttttcgggcccgtaaacgggggacccctaaagggtccgttagggagaacgttaacaagtcggtaacgtggttacggtcgttcggaaccc

SEQ ID NO: 420266 - DNA, 541 bp, Homo sapiens
  misc_feature: GZ8MTXP01DHOYK.13.73.G07.1.454.CMB.2.raw
  modified_base (357)..(357): a, c, t, g, unknown or other
  modified_base (420)..(420): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcggcagaggccaggccaatctccaaggcgcctaattataaggtgtctgacagggactccgggggtcccagacagacttcagcggcaggtgggtcngggcactgatttcacactagaaatcagcagggtggaggctgaggatgttatgggctcgtattnttgctatgactaagcaaacgactacgtacggcccgttaactaacgttttcgggcccgtaacgggggacccgaaaggccttagggagaatcgaaatcggaaactggttaggtcttggaaccc

SEQ ID NO: 420267 - DNA, 552 bp, Homo sapiens
  misc_feature: GZ8MTXP01CDWJM.13.73.G07.1.454.CMB.2.raw
  modified_base (298)..(298): a, c, t, g, unknown or other
  modified_base (335)..(335): a, c, t, g, unknown or other
  modified_base (346)..(346): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagcccggcctccatctcctgctagttctagtacaaagcctcgtacatcatgatggcacacctattgaattggtcgcagagcaggcaatcacaggctactaattatagtntctagacgaggcgtcgggaccagacagactcgagcgnaggtgggtacnggctacgtgtactttacaactactaagaaatcgaaggtcgaggggtggaggcgtaggaggtagtgttagtggtacttagttattagttgactagtcgacaagacaacgactacgtcggtacctacgtaaccgtttcggaccgtaacggggacgtaaggcgttagggattacgtaaccaaagtcgtaacgtgttacggcttgaaccc

SEQ ID NO: 420268 - DNA, 549 bp, Homo sapiens
  misc_feature: GZ8MTXP01D01BO.13.73.G07.1.454.CMB.2.raw
  modified_base (309)..(309): a, c, t, g, unknown or other
  modified_base (361)..(361): a, c, t, g, unknown or other
  modified_base (437)..(437): a, c, t, g, unknown or other
  modified_base (523)..(523): a, c, t, g, unknown or other
  modified_base (536)..(536): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctcgcccgtcacccttggacagccggcctccatctcctgcagttctagtcaaagcctcgtacatcatgatgggcacacctacttgaattggttcggcagaggccaggccaatctcaaggcgaccttaatttataaggtntctgacagggaccgtccggggtcccagacagacttcagcggcaggtgggtcngggcactgtactttcactactagaaaatcgagcgaggggtggaaggcgtaggaggtagttgttagttgggtacttnttatttaagttggactaagtgacaagacaaacactaacgtggtaccgtactaacgttttcggaccgaggggaccaaagcgttaggngatcaatcgaacngttgtcttgaacc

SEQ ID NO: 420269 - DNA, 635 bp, Homo sapiens
  misc_feature: GZ8MTXP01CRMIX.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacactacttgaattggtcgcagagccaggccaatctccgaaggcgaccttaaatttataaaggtgtctgacagggaccgtccggggtaccccagacagacttcgaggcggcgaggtcgggtcaagggcctaacgtgtactttcaactactaagaaaatcgaaggacgaggggtaggagggcgtagggaaggtagttaggttaagttggggtacttacgttagtttaagttcgacgtagtagacaaggacaaaccgtactaccgtacggacccgttaccgtaaccggttttacggaccggtaacggggacccgtaaacggtcgttaccgggagttacgttaacgaaacgttccggtaaaacgttcgggttacggtccgttaacggtaaccccg

SEQ ID NO: 420270 - DNA, 532 bp, Homo sapiens
  misc_feature: GZ8MTXP01AO7O0.13.73.G07.1.454.CMB.2.raw
  modified_base (356)..(356): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcggcagaggccaggccaatctccaaaggcgcctaattataaggtgtctgacaggactccgggggtcccagacagacttcagcggcagtgggtcnggcacgtgatttcgacactagaaaatcagcagggtgaggctgaggatgttatgggctctagttatgcatgcaagcaaacactactcggccgtacaacgttttcggaccgtacgggggaaccaaggcgttgggaggattaaccgaaagtccgaaacgttggttgtccgttggaaccc

SEQ ID NO: 420271 - DNA, 574 bp, Homo sapiens
  misc_feature: GZ8MTXP01EF6D9.13.73.G07.1.454.CMB.2.raw
  modified_base (352)..(352): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcgcagaggccaggccaatctccaaggcgacctaatttataaggtgtctgacgaggactccgggtccagacagactcagcgcagtgggtcnggcactgatttcacactagaaaatcagcgagggtgagcgtagagtatggttagttgggacttcgttaatttagtggtatagtgacaaagacaaactcaacgtcggtaccgttacctaaacgttttcgggacccggtaaacggggaacgaacggtcgttagggagttaactaaccggtaaattaaccggaaaccgttggttacgggccttaacggtaaccccg

SEQ ID NO: 420272 - DNA, 587 bp, Homo sapiens
  misc_feature: GZ8MTXP01AEDVE.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtcggcagagccaggccaatctccaaaggcgacctaatttataagtgtctgacagggactccggggtccagacagacttcgagcggcaggtcgggtcaaggcactgtactttacacacgtagaaatcagtcgaggggtcggaggcgtaggaggtagttggttagttgggtaccttagttatttagtttggctagttgacaaggacaaaccacgtacgtacggtcccgttaacgtaaccgttttagggacccggtaagggggaccctaaaggccgttaggacggttaacttaaccgaagtcccgtaaagtggttcggaacttgaacccg

SEQ ID NO: 420273 - DNA, 569 bp, Homo sapiens
  misc_feature: GZ8MTXP01A5AWY.13.73.G07.1.454.CMB.2.raw
  modified_base (361)..(361): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtcgcagagccaggccaatctaccaaaggcgtacctaatttagtaaggtgtctgacgagggacctccggggtccagacagacttcgagcggcaggtgggtcnggcacgtgactttcgacactagaaatcgagcgagggtggaggcgtggaggtagtgttagttgggtcttacgttagtttagttgctagtgacaagacaaacactacgtcggtacccgttacgtaacgttttcgggacccgtaagggggacccaaaggtcgttagggacgagttaacaagttaaccgaacgtggttcgggcttcggaacc

SEQ ID NO: 420274 - DNA, 577 bp, Homo sapiens
  misc_feature: GZ8MTXP01AS4P8.13.73.G07.1.454.CMB.2.raw
  modified_base (384)..(384): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcgcagaggccaggccaatctccaaaggcgcctaatttataaggtgtctgacagggacctccgggggtcccagacagacttcagcggcaggtgggtcaaggcactgatttcacactagaaatnagcgaggggtggaggacgtggaggtagttggttagttcggggacttacttagttattggctagtgaccgaagaccaaacacgtacgtacggtaccgtactaaccgttttcggaccgacggggaacccgaaaggccgttaggacggttacttaacgaaacgttcggaaaccgtgggttacggcgttcggaaccc

SEQ ID NO: 420275 - DNA, 534 bp, Homo sapiens
  misc_feature: GZ8MTXP01AU179.13.73.G07.1.454.CMB.2.raw
  modified_base (358)..(358): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtcggcagaggccaggccaatctaccaaggcgacctaatttataaggtgtctgacagggactccggggtccagacagacttcgagcggcaggtgggtcnggcactgatttcaacactagaaatcgagcgagggtggaggcgtggaggagttgttagttgggtacttattagtttattgctatgacaagacaaacactacgtcggaccgtactaacgtttggccgtacggggaccgaggcgttggagataacaatcgaactggttgtcgttgaacc

SEQ ID NO: 420276 - DNA, 543 bp, Homo sapiens
  misc_feature: GZ8MTXP01AIPTT.13.73.G07.1.454.CMB.2.raw
  modified_base (265)..(265): a, c, t, g, unknown or other
  modified_base (364)..(364): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcgnagaggccaggccaatctccaaaggcgtacctaatttataaggtgtctgacaggggacctccgggggtacccagacagacttcagcggcaggtcgggtcnggcactgtactttcaactactagaaatcgagcgagggtggaggcgtaggagtattgttagttggcttcgtattactgctatgcaagtcaaacactacgtggccctacgtaacgtttcggaccgtacggggaccaaaggcgttagggattagaacaagtcgaactggagtcttggaaccc

SEQ ID NO: 420277 - DNA, 554 bp, Homo sapiens
  misc_feature: GZ8MTXP01CS0JE.13.73.G07.1.454.CMB.2.raw
  modified_base (262)..(262): a, c, t, g, unknown or other
  modified_base (274)..(274): a, c, t, g, unknown or other
  modified_base (279)..(279): a, c, t, g, unknown or other
  modified_base (287)..(287): a, c, t, g, unknown or other
  modified_base (292)..(292): a, c, t, g, unknown or other
  modified_base (295)..(295): a, c, t, g, unknown or other
  modified_base (339)..(339): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctatgaattggtcgnagagcagcatcncagcnctaattanaagtntcngacaggctccgggccagacagacttcgagcggcaggtcgggtcnggcacctagtactttcacactagaaatcgagacgaggggtgaggctaggaggtatgttagtgggcttatagttatgacagtagacaagcaaacactacgtcggtacccttagtaacgtttacgggaccggtaacgggggacccaaaggcgttaaggggttattaacgttaacgtaaagttcccggtaagtcggttacgggtaaccttcggaaccc

SEQ ID NO: 420278 - DNA, 525 bp, Homo sapiens
  misc_feature: GZ8MTXP01CMXRZ.13.73.G07.1.454.CMB.2.raw
  modified_base (365)..(365): a, c, t, g, unknown or other
  modified_base (387)..(387): a, c, t, g, unknown or other
  modified_base (390)..(390): a, c, t, g, unknown or other
  modified_base (399)..(399): a, c, t, g, unknown or other
  modified_base (403)..(403): a, c, t, g, unknown or other
  modified_base (426)..(426): a, c, t, g, unknown or other
  modified_base (429)..(429): a, c, t, g, unknown or other
  modified_base (500)..(500): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagagggatgctgtaatgactcagtctccactctccctgcccgtcaccttggacagccggcctccatctcctgcagttctagtcaaagcctgtacatcatgatgggcacacctactgaattggtcgcagaggccaggccaagtcctaccgaaaggccgtaccttaaatttataaaggtgtactgacgagggacctccgggggtacccagacagacttcagcgcagtgggtcnggcatgattcacactagaaatnagngtaaggggngagnagagatgtagtgactattagttntgnagagacgaacgacaacactacgtacgtaccgtacgtaacgttacggacggacggacgacgagagagataanagtaacgacgtgttcgtcgcgaacg

SEQ ID NO: 420279 - DNA, 543 bp, Homo sapiens
  misc_feature: GZ8MTXP01EP549.13.73.G07.1.454.CMB.2.raw
  modified_base (355)..(355): a, c, t, g, unknown or other
  modified_base (509)..(509): a, c, t, g, unknown or other
  modified_base (516)..(516): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtcggcagaggccaggccaatctccaaaggcacctaatttataaggtgtctgacgagggactccgggtccagacagactcgagcgcaggtgggtcnggcactgatttcacactagaaatcgagcgagggtggaggactggaggtattggttaagttgggcttgtattagttgacatgacaagacaaacactactcggacccgttacgtaacgttttcgggacgtaacggggacccgaaaggcgttagganacgtaanaatcgaacgtggttacggtcttgaacc

SEQ ID NO: 420280 - DNA, 570 bp, Homo sapiens
  misc_feature: GZ8MTXP01AMZ6V.13.73.G07.1.454.CMB.2.raw
  modified_base (447)..(447): a, c, t, g, unknown or other
  modified_base (453)..(453): a, c, t, g, unknown or other
  modified_base (531)..(531): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatcctcctgcagttctagtcaaagcctcgtacatcatgatgggcacacctacttgattggtcgcagaggccaggccaatcctaccgaaggcgaccttaaatttactaaggtgtctagacgacgggaccgtccgggggtccagacagacttcgagcggcaggtgggcaaggcacgtgatttcacactagaaaatcgaggcgaggggtggaggcgtaggaggtatggttagttggggccttagtaattnttaggntaagtgacaagaccaaacacacgtacggtaccgtactaacgtttcgggaccgacggggaacccaaaggtgttaggganacgttaacaagtccgtaagtggttcggaacgttcgaacc

SEQ ID NO: 420281 - DNA, 557 bp, Homo sapiens
  misc_feature: GZ8MTXP01EOJ6N.13.73.G07.1.454.CMB.2.raw
  modified_base (364)..(364): a, c, t, g, unknown or other
  modified_base (428)..(428): a, c, t, g, unknown or other
  modified_base (433)..(433): a, c, t, g, unknown or other
  modified_base (452)..(452): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcggcagaggccaggccaatctccaaggccgtacctaatttataaggtgtctagacgagggacgtccggggtccagacagtactcagcggcgaggtcgggtcnggcacgtgtactttcacactagaaaatcagcgagggtggaggctggaggtatgttatgggactntattnttgcagtgacaagcaaacncgtacgtggtccgtaactcgttttgggaccgtaacggggacgaaacggtcgttaggagttaactaacgtaactaacggtaaacgtgggttcggcttcggtaaccc

SEQ ID NO: 420282 - DNA, 539 bp, Homo sapiens
  misc_feature: GZ8MTXP01BZB1R.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagcccggcctccatctcctgcagttctagtcaaagcctcgtacatcatgatgggcacacctacttgaattggttcggcagaggccaggccaatctccaaggcgacctaatttataaggtgtctgacgagggactccggggtcccagacagacttcagcgcagtgggtcaaggcactgatttcacactagaaatcagcgagggtggaggctaggaggtataggttattggggcttacgtatttattgtcatagacaagacaaacactacgtcggccgttactaacgttttcggccgtaaggggaccgaaaggcttaggagataacaagtcgaactgttacggtcttgaacc

SEQ ID NO: 420283 - DNA, 656 bp, Homo sapiens
  misc_feature: GZ8MTXP01DQGWO.13.73.G07.1.454.CMB.2.raw
  modified_base (393)..(393): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctcgcccgtcacccttggacagcccggcctccatctcctgctagttctagtcaaagcctcgtacatcatgatgggacacacctacttgaattggtcgcagacggccaggccaatctaccgaaaggccgtaccttaaatttagtaaggttgtacgtaggacgaacggggaccgtcccgggggtcccaagacagtaccttcgaggccggactagggtcgggtacnggggcctacgtagtactttcaactaactagaaaatcgaaggcgaggggtggaggtacgtagggaaggtagttaggtttaagttcggggtacttacggtttaatttacgttaggtacctaagttacgacgaaacggacaaaaccgtactaaccggtacggtacccgttacgtaacggttttcggaccgggtaacgggaacccgtaaagtcggttaggagttactaacaacgtccgtaacgttggttacggtcgttccgaacccg

SEQ ID NO: 420284 - DNA, 567 bp, Homo sapiens
  misc_feature: GZ8MTXP01CS9FO.13.73.G07.1.454.CMB.2.raw
  modified_base (260)..(260): a, c, t, g, unknown or other
  modified_base (271)..(271): a, c, t, g, unknown or other
  modified_base (278)..(278): a, c, t, g, unknown or other
  modified_base (286)..(286): a, c, t, g, unknown or other
  modified_base (292)..(292): a, c, t, g, unknown or other
  modified_base (324)..(324): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagcccggcctccatctcctgcagttctagtcaaagcctgtacatcatgatgggcacactactgattgtcgnagagcagcaanctcagcnctaattanaaggtntctgacaggctccggggccagacagactcagnggcaggtgggcaaggcactgatttcaacactagaaaatcaggcgagggtggaaggcgtaggagtattggttatgggcttattagttatttggactatagacaaagacaaacaacctacgtacggcccgttaacgtccgttttacgggcccggtaaacgggggaaccctaaagggccgttacgggggaaagttaacgtaacgtaaacgtaacgtaacggttggttacggtaaccgttcgaaccg

SEQ ID NO: 420285 - DNA, 562 bp, Homo sapiens
  misc_feature: GZ8MTXP01D1O9M.13.73.G07.1.454.CMB.2.raw
  modified_base (352)..(352): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagcccggcctccatctcctgcagttctagtcaaagcctcgtacatcatgatgggcacacctacttgaattggtcgcagaggccaggccaatctacaaggcacctaatttataaggtgtctgacgaggacctccgggtccagacagactcagcgcaggtgggcnggcacgtgtacttcacacgtagaaatcgagcgagggtaggaggtacgtagaggtagtaggttagttgggtacttagttattagttgactagtgacaagacaaacactacgtacggtaccgtactaacgtttcggaccgtacggggaaccaaggtacgttagggagttagtaacgaaactccgtaacgtcggttaggtcgttcgtaacccg

SEQ ID NO: 420286 - DNA, 551 bp, Homo sapiens
  misc_feature: GZ8MTXP01CPEGH.13.73.G07.1.454.CMB.2.raw
  modified_base (266)..(266): a, c, t, g, unknown or other
  modified_base (279)..(279): a, c, t, g, unknown or other
  modified_base (292)..(292): a, c, t, g, unknown or other
  modified_base (296)..(296): a, c, t, g, unknown or other
  modified_base (339)..(339): a, c, t, g, unknown or other
  modified_base (388)..(388): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgctagttctagtacaaagcctacgtacatcatgatgggcacacctattgaattggtcgnagagcagccatcncagcactaattanagtnctgacgaggcctcgggccagacagactcagcgcaggtgggtcnggctagtagtacttcaactactaagaaaatcgaaggcgagggtggaggngtaggaggtagttgtagttgggtacttagttaagtttattggactagtacgacaaacgacaaacgactacgtaccggtaccgttacgtaacgtttcggacggaacgggaccaaaggcgttaggagaactaacgaagtcgtaacgtgttacgtcgttcgtaacc

SEQ ID NO: 420287 - DNA, 549 bp, Homo sapiens
  misc_feature: GZ8MTXP01BTZSL.13.73.G07.1.454.CMB.2.raw
  modified_base (360)..(360): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctattgaattggtcggcagaggccaggccaatctccaaaggcgacctaatttataaggtgtctgacgagggcgtccggggtccagacagacttcaggcggcaggtcgggtacnggcacgtgtactttacactactagaaaatcaggcgagggtggaggcgtggaggtatgttagttgggacttgttatttagttgctatgacaagacaacactacgtcggccgtactaacgtttcggaccggaggggaccaaggcgttagggagactaagaactcgtaactggttacggaacgttcgaaccc

SEQ ID NO: 420288 - DNA, 535 bp, Homo sapiens
  misc_feature: GZ8MTXP01BX22Z.13.73.G07.1.454.CMB.2.raw
  modified_base (387)..(387): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagagggatgctgtaatgactcagtctccactctccctgcccgtcacctgacagccgcctccatctctgcagttctagtcaaagcctcgtacatcatgatggcacactatgaattgtcgcagagcagcaatctcaagcactaattataaggtgtctgacagggactccgggtccagacagacttcgagcggcaggtgggtcaaggctaaccgtgtactttcgaactaactagaaaatcgagcggagggtagagngtagagtgtgttagtggtacttagttattgtgatagtagacaagacaaacacgtacgtcggtacctagtaacgtttcgggacgacgggactaacgtgttagacgttataacgtaacgtaaccgtaagtggttacgcgttcgtaacccg

SEQ ID NO: 420289 - DNA, 568 bp, Homo sapiens
  misc_feature: GZ8MTXP01BW5RL.13.73.G07.1.454.CMB.2.raw
  modified_base (360)..(360): a, c, t, g, unknown or other
  modified_base (408)..(408): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactcctccctgcccgtcacccttggacagccggcctccatctcctgcagttctagtcaaagcctcgtacatcatgatgggcacacctacttgaattggttcggcagaggccaggccaatctccgaaggcgacctaatttataaggtgtctgacagggacgtccggggtccagacagacttcagcggcaggtgggtcnggcactgactttcgacactagaaatcaggcgagggtgaggctgaggtnttgttagttagggcttacgtattaatttggactatggactaaggactaaacactacgtcggtaccgtaacgtaacgttttcgggcccggtaagggggacccaaagggtcgttagggacgataaccgaaatcccggtaagtcggttagggccttggaaccc

SEQ ID NO: 420290 - DNA, 731 bp, Homo sapiens
  misc_feature: GZ8MTXP01BPHFV.13.73.G07.1.454.CMB.2.raw
  modified_base (260)..(260): a, c, t, g, unknown or other
  modified_base (688)..(688): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccgcctccatctcctgctagttctagtcaaagcctcgtacatcatgatggcacactactgattggtcgnagaggccaggccaatctacgaaaggtcgaccttaattataaaggtgtctggaaccaggggaccgtccgggggtacccagacgacgtaacttccgaggcggacgtaaggtcggggtaccaagggacctaacgttcggtaaacttttacccgaaacgttaaccgtaaagggtaaaaaacttcccggtaaaggtaccgggaaggggggtttacgggaaaggggttccgggttaacgggtaaaggggggttaactttaggggtttaaaccggtttgggggtacctttacggtttaaagttttagttttacgggacctaaagttacgacccgtaaaggaaccgttaaaaccacgtaaaccggttcgggtacccgttaccgttaaacggttttcgggaccggaaacgggggttaacccgaaagtccggttaggngttacgttaaccgaattaacgaacgtgttacggcttccggaac

SEQ ID NO: 420291 - DNA, 587 bp, Homo sapiens
  misc_feature: GZ8MTXP01EYO5B.13.73.G07.1.454.CMB.2.raw
  modified_base (306)..(306): a, c, t, g, unknown or other
  modified_base (362)..(362): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagcccggcctccatcctcctgctagttctagtcaaagcctcgtacatcatgatgggcacacctacttgaattggttcggcagaggccaggccaatctaccaaggcgacctaatttanaggtgtctgacaggggactccgggggtccagacagacttcagcggcaggtgggtcngggcactgatttcaacactagaaatcgagcgagggtggaggtagtaggaggtagttaggttagttggggtacttacttaagtttaatttggactagtacggacaaacgacaaacacgtactacggtacccgtaactaacgttttcgggaccggtaacggggttaacccgaaggtccgttaggacggattaacataacgaacgtggttacgggtaacttggaaccc

SEQ ID NO: 420292 - DNA, 544 bp, Homo sapiens
  misc_feature: GZ8MTXP01BJEFD.13.73.G07.1.454.CMB.2.raw
  modified_base (452)..(452): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctgtacatcatgatgggcacacctacttgaattggtcggcagaggccaggccaatctaccaaggcgaccttaatttactaaggtgtactgaccgagggaccgtccgggggtccagacagacttcgagcgcaggtgggtcaaggcactgtatttcacactagaaatcaggcgagggtggaggctagaggtatgttatgggactgtattatgacagtgacaagacaaacncgtacctggtacccgtactaacgttttcgggacgacgggggaccaaaggcgttaggagctaacagtaacgaacgtggttcggcttcgaaccc

SEQ ID NO: 420293 - DNA, 583 bp, Homo sapiens
  misc_feature: GZ8MTXP01AZO42.13.73.G07.1.454.CMB.2.raw
  modified_base (363)..(363): a, c, t, g, unknown or other
  modified_base (386)..(386): a, c, t, g, unknown or other
  modified_base (466)..(466): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacacgccggcctccatctcctgcagttctagtcaaagcctcgtacatcatgatggcacacctacttgaattggttcggcaggaggccaggccaatcctccgaaggcgtaccttaatttagtaaggtgtctgacgagggaccgtccggggtcccagacagatcaggcgcagtgggcnggcagtgtattcacatagaaatnagcgagggtgaggcgtaggaggtattggttagttcgggtacttcgttaagtttgtggactagttggacaaggaccaaacnccgtaacgttcggacccgttaacgttaacgttttcgggaccgtaaacgggggttaccaaaggtcgttggaagacgttaacgaagttcgaaacgtggttacggtccttaaggtaaccc

SEQ ID NO: 420294 - DNA, 595 bp, Homo sapiens
  misc_feature: GZ8MTXP01BFZT2.13.73.G07.1.454.CMB.2.raw
  modified_base (375)..(375): a, c, t, g, unknown or other
  modified_base (473)..(473): a, c, t, g, unknown or other
  modified_base (557)..(557): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatcctcctgcagttctagtcaaagcctcgtacatcatgatgggcacacctacttgaattggtcggcaggaggccaggccaatcctaccgaaggccgtaccttaaattagtaaggtgtctagacgagggaccgtccggggtcccaagacagtacttcgaggcggacaggtgggtcngggctacgtgtaacttccgaactaactagaaatcgaagcggagggtggacggtgtaggaggtattcggttaagttgggtacttagttaagttattganagtagaccaaagaccaaacgacgtacgtacggtaccgttaacttaacggtttcggaccggaagggacccgaaagtcgttagggnttacaacgtaagtcgtaacgtggttacggcttcgaacc

SEQ ID NO: 420295 - DNA, 615 bp, Homo sapiens
  misc_feature: GZ8MTXP01AYTD8.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccgcctccatctcctgcagttctagtacaaacgcctcgtacatcatgatgggcacacctacttgtaattggttcggcagaggccaggccaatctaccaaggcgtacctaatttataaggtgtctgacgagggacgtccggggtcccagacagtacttcagcggcgtaggtgggtcaaggcaccgtaggtactttcaacacgtagaaaactcgaagtcgaggggtagggaggcgtagaggtagtagttagttacgggtcttacgttagtttagttgtcgtagttagaccgaagaccgaaactaaccgtacgtaccgggtacccgttacgtaaccgttttcgggacccgtaacgggggaccgtaaaggccgttagggaagttagtaacgaacgtaacgtaaacgtggttacggcgttcgtaacccg

SEQ ID NO: 420296 - DNA, 549 bp, Homo sapiens
  misc_feature: GZ8MTXP01C3ISN.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtcccaggatttagagggatgctgtaatgactcagtctccactctccctgcccgtcacccttggacagccggctccatctcctgcagttctagtacaaagcctcgtacatcatgatgggcacactactgattggtcgcagagccaggccaatctaccgaaggcgacctaatttagtaaggtgtctgacgagggaccgtccggggtaccagacagtacttcgagcggcaggtgggcaaggcactgtattcaacactagaaatcgagacgagggtggagacgtaggagtagtagttacgttgggtacttagtttattaagtttggacctagtagacaagacaactacacgtgtaccgtataacgtttcggccgaacgggaccgtaagcgttagggacagtaacagtaacgacgtggttacgtcgcgaac

SEQ ID NO: 420297 - DNA, 585 bp, Homo sapiens
  misc_feature: GZ8MTXP01C9ZFW.13.73.G07.1.454.CMB.2.raw
  modified_base (364)..(364): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtcgcagaggccaggccaatctccgaaaggcgtaccttaatttataaggtgtctgacgagggacctccggggtacccagacagacttcgagcggcaggtgggtcnggctagtcgtattcgacactagaaatcgagtcgagggtggaggacgtaggaggtagttggttagtgggtacttacgttatttagttggacctaagtcgaaccgaagaccaaacgaccgtacgtcggtacccgtaacttaaccgtttgggacccgaagggggaccctaaaggtcgttagggagataaccgaaagtcggtaaactgggttcgtcgttgaaccc

SEQ ID NO: 420298 - DNA, 611 bp, Homo sapiens
  misc_feature: GZ8MTXP01BNIKT.13.73.G07.1.454.CMB.2.raw
tcagtcacgtactaccacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtcggcagaggcaggccaatctccgaaggcgacctaatttataaggtgtctgacgacggggtaccgtccgggggtacccaggacaggtacttcgaggtcggcgtaggtggggtccaaggcaacgttgatttcacactagaaaatcgagtcgaggggtggaggtacgtggaggtagttaggttaagttcggggtacctttacggttaagtttaagtttggacctagttacggactaaacggacaaaccgactacgtacggtaccgttaacgtaaccgttttcggggaccgtagggggaccgaaaggcgttagggagataacgaagtcgtaacgtggttcgtcgttcggaacc

SEQ ID NO: 420299 - DNA, 627 bp, Homo sapiens
  misc_feature: GZ8MTXP01EC4SK.13.73.G07.1.454.CMB.2.raw
  modified_base (368)..(368): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtcggcagaggccaggccaatctaccgaaggccgtaccttaatttactaaggtgtctgacgagggaccgtccggggtaccagacagacttcgagcggcaggtgggtacngggcacgtgacttttcgaactacgtaagaaatcgaggcggaggggtgggaggtacgtaggtaggtagttaggttagttgggtctttacttagtttagtttggactagtcgacgaagactaaaccgacgtaccgtacggtacccgttaacgttaaccggttttcgggacccggtaaacggggttacccgtaaagggccgttagggagttaacgtaacgtaaagtccggtaaacgtcggttgggtccttaacggtaacccg

SEQ ID NO: 420300 - DNA, 613 bp, Homo sapiens
  misc_feature: GZ8MTXP01DHDEZ.13.73.G07.1.454.CMB.2.raw
  modified_base (267)..(267): a, c, t, g, unknown or other
  modified_base (310)..(310): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctcgcccgtcaccctggacagcccggcctccatctcctgcagttctagtacaaacgcctcgtacatcatgatggacacactacttgtaattggtcgnagaggccaggaccatctcgaaggctacttaattataaggtgtntgacgagggaccgtccgggtacccagacagtactcgagcggcaggtcgggtcaagggctaacgtgtactttaccaactacgtaaagaaatcgaaggacggaggggtagggaggtagtagggtaagggtagttaggtttagttgggtactttacgtttaaggtttagttaggtactagtagacgaaacgaccaaacgtactacgtcggtaccttacgttaaccgtttacggccggtaacgggaccgaaaggtcgttaggacgttaagtaactaaagtcgtaacgtggttcgtcgttcgtaaccg

SEQ ID NO: 420301 - DNA, 539 bp, Homo sapiens
  misc_feature: GZ8MTXP01B3N4Z.13.73.G07.1.454.CMB.2.raw
  modified_base (309)..(309): a, c, t, g, unknown or other
  modified_base (418)..(418): a, c, t, g, unknown or other
  modified_base (445)..(445): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcggcagaggccaggccaatctccaaaggcgacctaatttataaggtntctgacagggactccggggtccagacagacttcagcggcagtgggcaaggcaactgatttcacactagaaatcgaagcgagggtggaggcgtggagatgttacgtgggntactagttattgcatgccaagcaaacncacgtgccgtactaacgtttcggccgtacgggacccgaaaggccttaggggagacttcgaaacgtccgtaaaccgtggttcgggcttggtcccc

SEQ ID NO: 420302 - DNA, 557 bp, Homo sapiens
  misc_feature: GZ8MTXP01D6CEG.13.73.G07.1.454.CMB.2.raw
  modified_base (264)..(264): a, c, t, g, unknown or other
  modified_base (436)..(436): a, c, t, g, unknown or other
  modified_base (521)..(521): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagcccggcctccatctcctgctagttctagtcaaagcctcgtacatcatgatggcacacctattgaattggtcgnagagccaggccaatctacaaaggctacttaatttataaggtgtctgacgacgggaccgtccggggtacccagacagtacttcgaggcggcaggtgggtcaagggctaacgtgtactttccaactactagaaatcgagcgagggtggaggctaggagtatgttagtggacttntagttattgcagtcgacaagacaaacctacacgtcggtaccgtacgtaacgtttcggaccgaggggaccaaaggccgttaggganactaacgaagtcgtaacgtggttcgtcgttcgaacc

SEQ ID NO: 420303 - DNA, 604 bp, Homo sapiens
  misc_feature: GZ8MTXP01AI0VC.13.73.G07.1.454.CMB.2.raw
  modified_base (207)..(207): a, c, t, g, unknown or other
  modified_base (397)..(397): a, c, t, g, unknown or other
  modified_base (442)..(442): a, c, t, g, unknown or other
  modified_base (466)..(466): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccgcctccatctcctncagttctagtcaaagcctacgtacatcatgatgggcactaccttacttgtaatttgggttcggacaggacggccaggcccaatcctacccgaaggtccgtacctttaaagtttagtaaggttgtacgtaggacgacgggggtaccgtcccgggggtacccagacagtactcgaggcggcaggtgggtacnggcacgtgtactttcaactactagaaactcgagcgagggtgaggngtagagtagttgttagtggacttntagttattgctagtagacaagacaaacactacgtcggtaccgttacgtaacgtttcggaccgacggggaaccgaaaggtcgttaggagttacgtaacgtaacgtaacggtaacgtggttcggtaaccttcggaacccc

SEQ ID NO: 420304 - DNA, 575 bp, Homo sapiens
  misc_feature: GZ8MTXP01AMCBN.13.73.G07.1.454.CMB.2.raw
  modified_base (375)..(375): a, c, t, g, unknown or other
  modified_base (411)..(411): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacacgcccggcctccatctcctgcagttctagtcaaagcctcgtacatcatgatgggcacacctacttgaattggttcgcagaggccaggccaatctccaaaggccgtaccttaaatttacgtaaggtcgtacgtgacgaggggaccgtccgggggtcccagacagacttcagcggcaggtcgggtcnggcactgtatttcacactagaaactcgagcgagggnggaggactggagagttaggttagttgggtccttagttattagtttgctagtgacaacgacaaacacgtacgtcggtacctaacgtaacgtttcgggccgtaacggggaccgaaggcgttaggacgttagtccgaagtccggtaactggttacgcgttggaaccc

SEQ ID NO: 420305 - DNA, 598 bp, Homo sapiens
  misc_feature: GZ8MTXP01BD2TL.13.73.G07.1.454.CMB.2.raw
  modified_base (365)..(365): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtcgcagaggtcaggccaatctaccgaaggcgtaccttaatttagtaaggtgtctagacgagggccgtccgggggtacccagacagacttcagcgcgagtgggtcngggcacgtgtactttacactactaagaaaatcgagcgaggggtgaggtcgtaggagtatgttaacgtgggtacttattagttattggcaagtgacaaagcaaacgctacgtcggtaccgttaacgtaacgttttaggacccggaaaggggaccccgaaaacggtgttaccggggaattaacggttaacgaaacttcccgggtaaacttgggttacgggcctttcgggaacccc

SEQ ID NO: 420306 - DNA, 537 bp, Homo sapiens
  misc_feature: GZ8MTXP01AHAJO.13.73.G07.1.454.CMB.2.raw
  modified_base (408)..(408): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtcggcagaggccaggccaatctaccaaggcgtacctaatttataaggtgtctgacgagggacctccggggtccagacagacttcgagcggcagtgggtcaaggcacgtgtatttcacactagaaatcagcgagggtgagcgtagagtntgttagtggctgtagttatgcagtgacagacaacactacgtcggcccgttacgtaacgtttcggaccgaaggggaaccctaaggcgttaggagactaacaacgtcgaactggttacgtcgttcgaaccc

SEQ ID NO: 420307 - DNA, 518 bp, Homo sapiens
  misc_feature: GZ8MTXP01C19XL.13.73.G07.1.454.CMB.2.raw
  modified_base (353)..(353): a, c, t, g, unknown or other
  modified_base (445)..(445): a, c, t, g, unknown or other
  modified_base (459)..(459): a, c, t, g, unknown or other
  modified_base (491)..(491): a, c, t, g, unknown or other
  modified_base (504)..(504): a, c, t, g, unknown or other
tcagtcacgtactacacgaccggtgctcgatttagctctacgctcaggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcgcagaggccaggccaatctccaaaggcgcctaatttataaggtgtctgacagggactccggggtcccagacagattcagcgcagtgggtcngggcactgatttcacactagaaatcagcgagggtggaggctggaggatgttagttggggcttcgttagttattggctaatgacaagcaaacncaactggccgtacncgttttggccgtaggggaccaaagcgttaggnatcaagtccgaanggttggcttgaacc

SEQ ID NO: 420308 - DNA, 570 bp, Homo sapiens
  misc_feature: GZ8MTXP01AOCVO.13.73.G07.1.454.CMB.2.raw
  modified_base (262)..(262): a, c, t, g, unknown or other
  modified_base (265)..(265): a, c, t, g, unknown or other
  modified_base (280)..(280): a, c, t, g, unknown or other
  modified_base (291)..(291): a, c, t, g, unknown or other
  modified_base (293)..(293): a, c, t, g, unknown or other
  modified_base (326)..(326): a, c, t, g, unknown or other
  modified_base (334)..(334): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagcccggcctccatctcctgcagttctagtcaaagcctcgtacatcatgatgggcacactactgattggtcgnagngcagcaatctcagcnctaattatagntngacaggctccgggtccagacagactcagcggcnggtgggcnggctactgtacttcaacactacgaaatcgaaggcgaaggggtggaggcgtaggaggtagtggttagttgggcttacgtagtttagtgtacagtgacaacgacaaacgtactaaccgtggacccgttaacgtaaccggttttcgggacccgtaaagggggacccgtaaaggtcccgttaagggacgaacgttaaccaaagttaacggtaaaccgtgggttcgggcttaacggaaccg

SEQ ID NO: 420309 - DNA, 543 bp, Homo sapiens
  misc_feature: GZ8MTXP01B8EU0.13.73.G07.1.454.CMB.2.raw
  modified_base (265)..(265): a, c, t, g, unknown or other
  modified_base (268)..(268): a, c, t, g, unknown or other
  modified_base (341)..(341): a, c, t, g, unknown or other
  modified_base (353)..(353): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagcccggcctccatctcctgcagttctagtcaaagcctcgtacatcatgatgggcacacctactgtaattggtcgnagngccagcatctccaagcgactaattataaggtgtctgacgagggactccggggtcccagacagactcgagcggnaggtgggtaccnggctacgtgtatttacactaactagtaaaatcgaaggcgaggggtggaggacgtagggagtattgttagttgggtacttacgtttattattgcagtcgacaagacaacacgtacgtggccctactaacgtttcggacgacgggaccgaagtcgttaggagactaacaagtcgaacgtggagtcttgaacc

SEQ ID NO: 420310 - DNA, 574 bp, Homo sapiens
  misc_feature: GZ8MTXP01CU32S.13.73.G07.1.454.CMB.2.raw
  modified_base (207)..(207): a, c, t, g, unknown or other
  modified_base (261)..(261): a, c, t, g, unknown or other
  modified_base (264)..(264): a, c, t, g, unknown or other
  modified_base (273)..(273): a, c, t, g, unknown or other
  modified_base (286)..(286): a, c, t, g, unknown or other
  modified_base (290)..(290): a, c, t, g, unknown or other
  modified_base (297)..(297): a, c, t, g, unknown or other
  modified_base (344)..(344): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctccngcagttctagtcaaagcctcgtacatcatgatgggcacactatgaattggtcgnagngcagcatcncagcactaattanagtnctgacgnggacgtccgggtaccagacagacttcgaggcggacaggtcgggtacnggcacgtgtaactttcaactactaagaaatcgagcgagggtggaggacgtaggaggtagttagttagtgggtacttcgttaatttagttgacagtacggacaaacgacaaacgactacgtacggacccgttaactaacgtttcgggaccgtaaggggaccgtaaaggtcgttaaggacgaagtaacgtaaacgtccgtaacgttcggttacggtccgttaacggtaaccc

SEQ ID NO: 420311 - DNA, 576 bp, Homo sapiens
  misc_feature: GZ8MTXP01BCVNW.13.73.G07.1.454.CMB.2.raw
  modified_base (259)..(259): a, c, t, g, unknown or other
  modified_base (273)..(273): a, c, t, g, unknown or other
  modified_base (288)..(288): a, c, t, g, unknown or other
  modified_base (294)..(294): a, c, t, g, unknown or other
  modified_base (344)..(344): a, c, t, g, unknown or other
  modified_base (373)..(373): a, c, t, g, unknown or other
  modified_base (459)..(459): a, c, t, g, unknown or other
  modified_base (470)..(470): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatggcacactatgattggtcgnagagccagcaatcncaagctactaattanaaggtntctgacgaggtccgtccgggtacagacagtactcgagcgcaggtcggacnggctacgtgtactttcgaactacgtaaanaaatcgaggaggaggggtaggaggtacgtagggtaaggtagtttgttaggttagggtactttagttagttagttcgatagtcgaanaacgacaaacncgtacggtacgtaccgttaacttcggtttacgggacggaacggggaccaaggtcgttaggacttagtaactaagtaacgtaacgttggacggtcttaacggaaccc

SEQ ID NO: 420312 - DNA, 661 bp, Homo sapiens
  misc_feature: GZ8MTXP01EU3IX.13.73.G07.1.454.CMB.2.raw
  modified_base (393)..(393): a, c, t, g, unknown or other
  modified_base (435)..(435): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacacgccggcctccatcctcctgctagttctagtacaaagcctacgtacatcatgagtgggacactacctacttgtaagtttggtcgcaggacggccaggccaatcacgaaaggcgtaccttaaagtttagtaaggtgtactggaccgagggggacccgttccggggaccaagacagtacgttcgacggcgagtaggtacgggacngggtctagtgtactttacgaactacgtaagaaactcgaaggnggtaggggtcggaggtagtggtaaggtagttaggtttagttacgggtacctttagttaagtttcgttaggaccttaagtcgaacgtaaagccaaaaccgctaaaccggtccggtaccgtttaactaacgggttttacggaacccgggtaacggggaaccgaaggtcggttagggttacacttaaccgaagttaaccgaacgttggttccggctttaacgggaaccc

SEQ ID NO: 420313 - DNA, 550 bp, Homo sapiens
  misc_feature: GZ8MTXP01B21BG.13.73.G07.1.454.CMB.2.raw
  modified_base (264)..(264): a, c, t, g, unknown or other
  modified_base (267)..(267): a, c, t, g, unknown or other
  modified_base (350)..(350): a, c, t, g, unknown or other
  modified_base (451)..(451): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagcccggcctccatctcctgcagttctagtcaaagcctcgtacatcatgatgggcacacctacttgattggtcgnagngcagcatctcaagcactaattataaggtgtctgacgagggacctccggggtcccagacagacttcgagcggcaggtgggtacnggcacgtgtactttcactactagaaatcgaggcgaggggtgaggcgtagaggtagtgttagtggtacttagttagttattgctagtgacaacgactaaacnctacgtcggaccttacgtaacgtttcggacccggtaaggggaccaaaggtcttagggacgattaaccagtaacgtaagtcggttggaacgttcgaaccc

SEQ ID NO: 420314 - DNA, 673 bp, Homo sapiens
  misc_feature: GZ8MTXP01CEHX1.13.73.G07.1.454.CMB.2.raw
  modified_base (300)..(300): a, c, t, g, unknown or other
  modified_base (303)..(303): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtccaggatttagaggggatgctgtaatgactcagtctccactctccctgcccgtcaccttggacagccggcctccatctcctgctagttctagtacaaagcctacgtacatcatgatggacacactactgattggtcgcagagcagccaatctacaagcgtactaattagtaaggtntcngacgagggaccgtccgggtaccagacagtactcaggcggacaggtcgggtacaaggtccaagttgtaactttaccaacgtaactaaggaaaacttccgaaggcgggtaaggggtagggacgggtagtagggtaaggtagttagggtttaagttcggggtactttacggttaaatttacgtttaggcctaacgttagaaccgtaaacgaccaaaaccgtaccgtaaccggttaccgggtaccccgttaaacggttaacccggttttaacggggaccccgggtaaacggggaacccgaaaggtacccggttaggggaaacttacgttaacgaacgtaacgtaaaccgtgggttccgtaacgttcgtaacccg

SEQ ID NO: 420315 - DNA, 636 bp, Homo sapiens
  misc_feature: GZ8MTXP01AOA2F.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagcccggcctccatcctcctgcagttctagtcaaagcctcgtacatcatgatgggcactacctacttgaattggtcgcagacgccaggccaatctacaaggcgtactaattataaggtgtactgacgagggccgtccggggtaccagacagtactacgacggtcggacgtaggtcggggtcaacgggctaacgtcggtatttaccaacgtactagaaaactcgaggtcgaggggtaggaggacgtaggaggtagttggttagtgggtcttagttagttagttgacgtagtacgaacgaacgaccaaacctaccgtaccgtaccggtaaccccgttaccggttaaccggttttcgggaacccggtaacgggggaaccgaaacggtccggttaggggaacttacgtaacgtaacgttaaccgaacggttggttcgggcttcggtaaccc

SEQ ID NO: 420316 - DNA, 670 bp, Homo sapiens
  misc_feature: GZ8MTXP01DIUI1.13.73.G07.1.454.CMB.2.raw
  modified_base (373)..(373): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtccaggatttagaggggatgctgtaatgactcagtctccactctccctcgcccgtcacccttggacacgccggcctccatctcctgcagttctagtacaaacgcctacgtacatcatgatcgggaccactacctacttgtaagtttggtcgcaggacggccaggtacaatctaccgaaaggcgtaccttaattagtaaggtgtactaggacgagggtaccgtccggggtaccagacagtactcaggcggngaggtgggtaccaagggctacgttagtactttaccaactacgtaagtaaaactcgaggacggaaggggtcggaggtacgtagggtaggttagttaggttagttgggtacgttactttaaggtttagttggtactaagttagaaccgtaaacgaacgtaaacctacgttacccgttacggtaacccctttacgttaaccggttttacgggacccgggtaacgggggaaacctaacggtacggttacggttagaacgttaacctaaacgtcgtaacgtgggttacggtcttcgaacccg

SEQ ID NO: 420317 - DNA, 632 bp, Homo sapiens
  misc_feature: GZ8MTXP01BHFGN.13.73.G07.1.454.CMB.2.raw
  modified_base (266)..(266): a, c, t, g, unknown or other
  modified_base (483)..(483): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagcccggcctccatctcctgcagttctagtacaaagcctcgtacatcatgatgggcacactacttgaattggtcggnagaggccaggccaatcctcgaaggctacctaatttataaggtgtcagacgagggacctccgggggtacccagacagtacttcaggcggacaggtgggtacaagggcacgtgtactttacaacactaagaaatcgaagtcgaggggtgaaggtcgaggtaggtagttggttaagttgggacttacggttagtttatttaggactaagttcgaacgaanaaccgaaacgacctacggttacgggtacccgttaacgttaaccggttttccggggacccggtaacgggggttaaaccccgaagggtccgttagggattaacgtaacgtaaacgtccgtaaaccgtggttacgggtccgttcggaacccg

SEQ ID NO: 420318 - DNA, 715 bp, Homo sapiens
  misc_feature: GZ8MTXP01CD1A9.13.73.G07.1.454.CMB.2.raw
  modified_base (262)..(262): a, c, t, g, unknown or other
  modified_base (308)..(308): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagagggatgctgtaatgactcagtctccactctccctgcccgtcaccccttggacagccggcctccatctcctgcagttctagtcaaagcctcgtacatcatgatggcacacctattgaattggtcgnagaggccaggccaatctccgaaggcgtaccttaatttagtaaggtntcgtaggaccgaggggacctcccgggggtcccaagaccagacttcgaggcggtacgaggtcgggtcaagggtctaacgttgtactttacccaacgtaccgtaagtaaaacttccgaaaggacgtaagggggttagggaacgggtacgtagggtaagggtagtttagggtttaagtttcggggtactttacgtttaaggtttaagtttggtaccgttaagtcggttaaccgaaacggtaaccaaaccgtaaccgtaaccgttacggtacccggttaacccgttaaccggtttttacgggacccggttaaacgggggacccgtaaacgggtccgttaagggttacgttaacgttaaccgaaacgttaacccgtaacgttacggttcggtaaccgttaacggtaaccccg

SEQ ID NO: 420319 - DNA, 563 bp, Homo sapiens
  misc_feature: GZ8MTXP01AXI8A.13.73.G07.1.454.CMB.2.raw
  modified_base (358)..(358): a, c, t, g, unknown or other
  modified_base (367)..(367): a, c, t, g, unknown or other
  modified_base (412)..(412): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtcgcagaggcaggccaatctccaaggcgacctaatttacgtaggtgtctgacgagggactccggggtccagacagacttcgagcggcgaggtgggtcngggcacgtnacgtttcactactagaaatcgaagcgagggtggaggtcaggagtntgttatgggcttactagttatgcagtgacaagactaacactacgtcggtaccgttaacgtcgtttacggccgtaacgggggacccaaaggtccgttaggacgttacgtaacgtaacgtccggaaactgggttacgaaccgttcgtaacccg

SEQ ID NO: 420320 - DNA, 614 bp, Homo sapiens
  misc_feature: GZ8MTXP01B9808.13.73.G07.1.454.CMB.2.raw
  modified_base (369)..(369): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagagggatgctgtaatgactcagtctccactctccctgcccgtcacccttggacacgcccggcctccatctcctgctagttctagtacaaagcctcgtacatcatgatggcacacctattgtaattggtcggcagacggccaggaccaatctacaaggcgtacttaatttagtaaggtgtctagacgagggacgtcccggggtaccagacagtacttcgagcggcaggtgggtcngggcacgtgtatttcaactactagaaatcgaggtcggagggtggagacgtagaggtagttgttagttggacttatttaagtttagttcgatagtcgacgaacgactaaaccgactaccgtacgtacccggttaaccttaacgggttttccgggaccggtaacgggggaacctaaacgggtccggttacgggagttaacttaacgtaaactcggtaaaccgttggttacgggtccgttcgaacccg

SEQ ID NO: 420321 - DNA, 582 bp, Homo sapiens
  misc_feature: GZ8MTXP01CE5PI.13.73.G07.1.454.CMB.2.raw
  modified_base (353)..(353): a, c, t, g, unknown or other
  modified_base (364)..(364): a, c, t, g, unknown or other
  modified_base (418)..(418): a, c, t, g, unknown or other
  modified_base (465)..(465): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagagggatgctgtaatgactcagtctcaactctccctgcccgtcacccttggacagccggcctccatctcctgcagttctagtacaaagcctgtacatcatgatgggcacacctattgaattggtcgcagacggccaggccaatcctaccgaaggcgtacttaatttagtaaggtgtctgacgagggccgtccggggtccagacagtactcgagcgganaggtgggtacnggctacgtgtatttcaacactaagaaatcgaggcgagggtggagcgtaggagtnttgttagtggcttgttagttagtgctagtcgacgaacgtacaaaccncgaacgttcggtacccgttaacgtaaccggtttgggaccggtaacgggggacaaacgggcgttacgggagttacgtaactaacgtcgtaaaggttgttacggtaaccgttgaacccg

SEQ ID NO: 420322 - DNA, 608 bp, Homo sapiens
  misc_feature: GZ8MTXP01BC52J.13.73.G07.1.454.CMB.2.raw
  modified_base (265)..(265): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccgcctccatcctcctgcagttctagtcaaacgcctacgtacatcatgatcgggcacacctatgaattggtcgnagacggccaggccaatctaccgaaggccgaccttaagtttataaggtgtctaggaaccgaggggtaccgtccgggggtacccagacagtacttcgagcggcaggtgggtcaagggctactgtactttcaacgactagaaactcgagacggaggggtaggaggtacgtaggaggtagttgttagtagggtcttagttattagtcggatagtagacgaacgacaaaccgacgtacgtacggtaccgtagtaaccggtttcgggaccggtaacggggaccgaaacggtccgttagggacttagtaacctaagtcccgtaagtcggttacggtcgttaacgtaaccc

SEQ ID NO: 420323 - DNA, 622 bp, Homo sapiens
  misc_feature: GZ8MTXP01DHBMA.13.73.G07.1.454.CMB.2.raw
  modified_base (498)..(498): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactcctccctcgcccgtcacccttggacacgcccggcctccatctcctgctagttctagtcaaagcctacgtacatcatgagtgggacacaccttacttgtaattggttcgcaggagccaggccaatctaccgaaaggcgtaccttaaatttagtaaggttgtactgaacgagggaccgtccgggggtaccaagacagtacttcgagcggacaggtcgggtcaacgggctacgtcgtaatttaccaactaacgttaagaaaacttcgaggacggtaggggagggtaggagtaggaggtagttagttaagttgggtaccttagttatttagtgtanaagtgagacgacaaacactacgtcgacctacgtaacgtttcggccgtaagggacccgtaaaggtcgagggagttactaacgtaaacgtcccgtaacggtggttacggtccttaaggtaaccccg

SEQ ID NO: 420324 - DNA, 635 bp, Homo sapiens
  misc_feature: GZ8MTXP01CE5R1.13.73.G07.1.454.CMB.2.raw
  modified_base (358)..(358): a, c, t, g, unknown or other
  modified_base (386)..(386): a, c, t, g, unknown or other
  modified_base (412)..(412): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacacgcccggcctccatctcctgctagttctagtcaaagcctacgtacatcatgagtgggcactacccttagttgtaagttggttcggacaggacggccaggaccaactcctacgaacggcctaccttaaatttagtaaggtgtctagacgaggtccgtcccgggtcaganagtactcgagcggacgaggtcgggtacnggctacgttgtacttcgaacagtaanaaatcgaaggtcggaggggtaggtacggagtaggtaggtagttaggttaggttcggtacttagtttaaggttagttggtatagtcgaccgaaacgacaaaccgacgtaaccgtcggtacccggttaactaaccggtttcgggacggtaaccggggacgaaacggtcgttaaggggacttacgtaatacgtaacggtaccgtgggttaccggtcttcggaaccc

SEQ ID NO: 420325 - DNA, 532 bp, Homo sapiens
  misc_feature: GZ8MTXP01BOGTG.13.73.G07.1.454.CMB.2.raw
  modified_base (266)..(266): a, c, t, g, unknown or other
  modified_base (358)..(358): a, c, t, g, unknown or other
  modified_base (379)..(379): a, c, t, g, unknown or other
  modified_base (384)..(384): a, c, t, g, unknown or other
  modified_base (404)..(404): a, c, t, g, unknown or other
  modified_base (416)..(416): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcggnagaggccaggccaatctcaaaggcgcctaatttataacggtgtctgacgagggactccgggggtccagacagacttcagcggcagtgggtcngggcactgatttcgacactanaaatnagtcgagggtgaggctgagngtgttatagggnttacgtattattgacatagcaagcaaacgacactggccgttacaacgttttcggacgacggggaccgaaaggcttagggagactaacgaatcgaaacgtgttagggcttcgaaccg

SEQ ID NO: 420326 - DNA, 669 bp, Homo sapiens
  misc_feature: GZ8MTXP01ADALF.13.73.G07.1.454.CMB.2.raw
  modified_base (264)..(264): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagcccggcctccatcctcctgctagttctagtcaaagcctcgtacatcatgatggcacactactgaattggtcgnagagcagccatctcagcactattatagtgtctgacagggtaccgtccggggtaccaggtacagtactcgaggtcggacaggtcgggtcaagggcacgttagtacttttacccaacgtaacctaagtaaaaacgttacgaacggaccggtaagggggttacggggaggtacggttagggtaagggtaagtttacggtttagtttaggggtacctttacggttaagtttaagtttaggtcctaagttacgtaaccgaaacggacccgaaacaaccgtaaccgtccggaacccgttacggtaaccgttttcgggacccggtaacggggaaccgaacggtacgttacggttagttaacgtaacgtaaacgtccggttaaaccgtgggttacggcgttaacggaaccccg

SEQ ID NO: 420327 - DNA, 600 bp, Homo sapiens
  misc_feature: GZ8MTXP01CLVT2.13.73.G07.1.454.CMB.2.raw
  modified_base (310)..(310): a, c, t, g, unknown or other
  modified_base (452)..(452): a, c, t, g, unknown or other
  modified_base (474)..(474): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtccaggatttagaggggatgctgtaatgactcagtctccactctccctgcccgtcacccttggacagcccggcctccatctcctgctagttctagtacaaagcctacgtacatcatgatggcactactacttgaattggtcgcagaggccaggccaatctaccgaaggctactaatttagtaaggtntctggacgagggaccgtccgggccagacagtacttcgagcggcgaggtagggtcaaggctaacgtgtacttacgaactaacgtagaaaatcgaaggacggagggtggaggcgttaggagtagttgtagtggcttagttattnttgctagtgacaagacaaaccncgtaacgtcggtaccgtaacgttccggtttacgggacccggtaacggggaacccaaaggtccgttagggaacttaacgttaacgaaagtcccggtaaacgtggttaacggtccttaacggtaaccc

SEQ ID NO: 420328 - DNA, 591 bp, Homo sapiens
  misc_feature: GZ8MTXP01A8ICG.13.73.G07.1.454.CMB.2.raw
  modified_base (452)..(452): a, c, t, g, unknown or other
  modified_base (585)..(585): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactcctccctgcccgtcacccttggacagccggcctccatcctcctgcagttctagtcaaagccctcgtacatcatgatgggcactactacttgattggtcgcagacggccaggcccaagtctaccgaaaggtccgtacctttaaagttttagtaaggttgtcgtaggaccgagggggtaccgtcccgggggtacccaaggacaggacttccgaggccggcgtagggtacgggtcaagggactacgttgtatttaccacaactagaaactcgaggcgaggggtggaggngtaggagtagtgttagtgggtacttacgttagtttagtgactagtagacaagacaacactacgtcggtccgtactaacgtttcggacgtaacgggacaaggcgttggagactaacagtcgacgtgcggtaacngtaacc

SEQ ID NO: 420329 - DNA, 600 bp, Homo sapiens
  misc_feature: GZ8MTXP01B60TG.13.73.G07.1.454.CMB.2.raw
  modified_base (360)..(360): a, c, t, g, unknown or other
  modified_base (442)..(442): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacaccttacttgaattggttcggcagaggccaggccaatctccaaggcgacctaatttataggtgtctgacgagggaccgtccggggtccagacagacttcgagcggcagtgggtcnggcacgtgtatttcacaactagaaatcaagcgaggggtggagggctaggaggtagttggttagtgggtacttcgttaatttnttcggctagtgacaaggacctaaacgactacgtacggtcccgttaaccgtaacgttttcgggacccggtaacggggaacccgtaaaggtccgttaagggttagttaacgtaaccgtaacgtaaccggtaaacgtcgggttcggtccgttcgtaacccg

SEQ ID NO: 420330 - DNA, 801 bp, Homo sapiens
  misc_feature: GZ8MTXP01DVBWJ.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctcgcccgtcacccttggacacgccggcctccatcctcctgctagttctagtcaaagcctgtacatcatgatcgggacactactacttgaatttggttcggcaggacggacccgaggaccctaaagttcctaccgtaaaaggcccgtaacctttaaagttttaacgttaaaggggttcttaccgttaggaacccggtaacgggggtaacccggtcccccggggggttaaccccaaggtaaccacggtactttaccggaacggtccgggacgtaacgggtcggggtaccaacggggcctaaaccgttacggtaacgttttaccaaccgtaaacgttaaggtaaaaacttccgtaagggtacgggaaggggggttagggaacgggtacgttagggtaaagggttaccggtttaggtttaacggtttggggtacctttaccgtttaagggttttacgttagggtacctaagttacggaacgaaacgacctaaaaccgtaccgtaacggtacggtacccgtttaacgtaaccggtttttcgggacccggacgggggttaaaccctaaggaccgttacgggaagttaacttcgaaaacgttcccggtaaagtcgggttacgccgttcggtaacccc

SEQ ID NO: 420331 - DNA, 692 bp, Homo sapiens
  misc_feature: GZ8MTXP01EC1QA.13.73.G07.1.454.CMB.2.raw
  modified_base (275)..(275): a, c, t, g, unknown or other
  modified_base (380)..(380): a, c, t, g, unknown or other
  modified_base (390)..(390): a, c, t, g, unknown or other
  modified_base (526)..(526): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactcctccctcgccccgtcacccttggacacgccggcctccatctcctgctagttctagtacaaacgcctcgtacatcatgagtcggacacacctacttgtaagttggtcgnaggacggccaggcccaatcctaccgaaaggccgtaccttaaatttagtaaggttgtacgtagacgacgggtaccgtcccggggtaccagacagtactcgagcggnaggtcgggcnggcagttgtatttacacgtactaagtaaactcgtaaggcggagggtgggagggtacgtaggaagggtagttggttaagttcgggtactttacgtttagtttagtttcggactagtacggcaaacgtacctaaaacnccggtaccgttaccgggtaacccgtttaccgttaaccggtttttaccggggaccgggtaaacgggggttaaccccgtaaagggtaccggttagggttacgttaacgtaaccggtaaacgttaacgggtaacgttcggggttacggtaacccggttcggtaaccccg

SEQ ID NO: 420332 - DNA, 687 bp, Homo sapiens
  misc_feature: GZ8MTXP01D9ZP1.13.73.G07.1.454.CMB.2.raw
  modified_base (271)..(271): a, c, t, g, unknown or other
  modified_base (409)..(409): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagagggatgctgtaatgactcagtctccactctccctgcccgtcacccttggacagcccgctccatctcctgcagttctagtacaaagcctacgtacatcatgatcgggacactaccttacttgtaatttggtcggnagacggccaggccaatcctaccgaaggcgtacttaatttagtaggttgtctaggacgagggggtaccgtccgggggtcccagaccgagtacttccgaggccggctagggtcgggtcaagggctacgtgtactttcaanactaagtaaactcaaggacggtaggggtacggaggtacgtaggtaaggttagttgggtttaacgtgggtactttaccggtttaatttagttacgtacgtacgtacggaaacctaacggaacctaaaccgtaccgtaaccggtaccgggtacccgtttaaacggttaaccggtttttacggggacccgggaaacgggggttaaaccccaagggttcgttaagggcttaaacgtctaaaacgttcggtaaacgttgggacggtccgttaacggtaacccc

SEQ ID NO: 420333 - DNA, 694 bp, Homo sapiens
  misc_feature: GZ8MTXP01DQNDV.13.73.G07.1.454.CMB.2.raw
  modified_base (568)..(568): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagagggatgctgtaatgactcagtctccactctccctgcccgtcacccttggacagcccggcctccatctcctgcagttctagtcaaagcctcgtacatcatgatgggcactacctacttgaattggtcgcagaggccaggccaatctaccgaaaggcgtaccttaaagtttacgtaaggtgtactggaaccgtaaggggaccgtcccgggggtaccccaaggaccgtaaggtaactttccgaaggccgggcgtaacgggttcgggggttacaacgggggcctaacccgttagggtaccttttaccaacgtaacgttaagaaaacttcgaaggaccgtagggggtaggaagggtacgtagggtaaggtagttcgggttaagttggggtacttacgttaaggtttatttggacctagtcgacgaacgacaaaccncgtaacgtcggtaccgtacgtaacgttttcgggaccggtaacgggggaaccctaaagggccgttagggttaaacttaacgtaacgtaaagttaaccggtaacggtcggttacggtcgttcgtaacc

SEQ ID NO: 420334 - DNA, 560 bp, Homo sapiens
  misc_feature: GZ8MTXP01B8WEI.13.73.G07.1.454.CMB.2.raw
  modified_base (264)..(264): a, c, t, g, unknown or other
  modified_base (301)..(301): a, c, t, g, unknown or other
  modified_base (359)..(359): a, c, t, g, unknown or other
  modified_base (399)..(399): a, c, t, g, unknown or other
  modified_base (535)..(535): a, c, t, g, unknown or other
  modified_base (541)..(541): a, c, t, g, unknown or other
  modified_base (549)..(549): a, c, t, g, unknown or other
  modified_base (551)..(551): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagagggatgctgtaatgactcagtctccactctccctgcccgtcaccttgacagccgcctccatctcctgcagttctagtcaaagcctacgtacatcatgagtggacactacctacttgtattggtcganagaggccaggccaatcacgaagcgtaccttaatttanaaggtgtcgtagacgaggaccgtccggaccagacagtactcagcggcaggtgggtacnggactacgttgatttacactaaagtagaaaactgaacggngagggtaggaggtacgtaggaagttagttggttaagttgggtacttacgtttaggtttaacgttggacctagtacgacaagaccaaacacgtacgtcggtacttactaacgtttggaccggagggacagcttaggnactaanacgtgagngngcttcgaac

SEQ ID NO: 420335 - DNA, 653 bp, Homo sapiens
  misc_feature: GZ8MTXP01C9YYW.13.73.G07.1.454.CMB.2.raw
  modified_base (268)..(268): a, c, t, g, unknown or other
  modified_base (375)..(375): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagagggatgctgtaatgactcagtctccactcctcctcgcccgtcaccttgacacgccgcctccatctcctgctagttctagtacaaacgccgtatacatcatgatcggacactacctattgtaattggtcganagacgccagccaatctacaaggctacttaattagtaaggtcgtactagacgtacgggaccgtccgggtaccagtacaggtacctcgaggcggactaggtcgggtacngggacctacggttactaactttaccaaacgtacgtaaagtaaaacctcggaacggtagggtagggtaggaacggtaggtaggtaacgttgttagttacgtaggttactttagtttaaggtttacgtacgtacgtagtacgaaacctaacgaacgtaaccgaccggttccggttaccggtaaccgttacgttaaccgggttaccggacggtaaacggacgtaggtacggttaagacttaacgtaagtaacgtcggtacgtcggttactaacgcgtaacc

SEQ ID NO: 420336 - DNA, 570 bp, Homo sapiens
  misc_feature: GZ8MTXP01BVXLG.13.73.G07.1.454.CMB.2.raw
  modified_base (268)..(268): a, c, t, g, unknown or other
  modified_base (271)..(271): a, c, t, g, unknown or other
  modified_base (303)..(303): a, c, t, g, unknown or other
  modified_base (428)..(428): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgctagttctagtcaaacgtcctcgtacatcatgatgggacacacctacttgaattggtcgnagngcagcaatctacagcgacttaattataaggtntctagacgagggaccgtccggggtaccagacagtacttcgaggcggcaggtgggtcaaggctacgtgtactttacacactagaaaatcgaggcgaggggtgaggcgtagaggtatgttagtgggnttacgttatttagtgacagtacgacgaagacaacgactacggtcgtaaccgttctaacgtttcgggaccggtacgggaacctaaggtccgttaggacgacgtaactaacggtaacgtaacgtcggttacgtcgttcgaaccc

SEQ ID NO: 420337 - DNA, 556 bp, Homo sapiens
  misc_feature: GZ8MTXP01AILIB.13.73.G07.1.454.CMB.2.raw
  modified_base (356)..(356): a, c, t, g, unknown or other
  modified_base (447)..(447): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtcggcagaggccaggccaatctaccaaggcacctaatttataaggtgtctgacagggactccggggtccagacagacttcagcggcaggtgggtcnggcacgtgatttcacactagaaatcagcgagggtgaggctgaggtatggttagtgggtctcgttagttagttgctagtgacaagcaaaccnctacgtcggtacccgttacgtaacgtttcggaccggtacggggacccgaaaggtccgttaggacgttactaacgaaagtccgtaacgtcggttacgggtcttgaacccc

SEQ ID NO: 420338 - DNA, 564 bp, Homo sapiens
  misc_feature: GZ8MTXP01A0711.13.73.G07.1.454.CMB.2.raw
  modified_base (258)..(258): a, c, t, g, unknown or other
  modified_base (261)..(261): a, c, t, g, unknown or other
  modified_base (270)..(270): a, c, t, g, unknown or other
  modified_base (275)..(275): a, c, t, g, unknown or other
  modified_base (281)..(281): a, c, t, g, unknown or other
  modified_base (285)..(286): a, c, t, g, unknown or other
  modified_base (333)..(333): a, c, t, g, unknown or other
  modified_base (526)..(526): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacacgccggcctccatcctctgcagttcagtcaaagcctcgtacatcatgatggcacactatgattgtcgnagngcagcatcncagcnctattnagtnntgacaggctccgggtccagacagacttcgagtcggcaggtcgggtcngggctacgtgtatttacgactaacgtagaaaactcgaacggcgaggggtcggagtacgtaggtaggtagttggttagttgggcctttagttaagtttgttaggctagtacgcgaaggcaaacgactaccgtacggtacccgttaactaaccgttttacggaccgtaacggggaccgaaacggcttagggttanacgtaacaacgttcgaacgtgaccggtcttcggaaccc

SEQ ID NO: 420339 - DNA, 690 bp, Homo sapiens
  misc_feature: GZ8MTXP01B6KRS.13.73.G07.1.454.CMB.2.raw
  modified_base (264)..(264): a, c, t, g, unknown or other
  modified_base (267)..(267): a, c, t, g, unknown or other
  modified_base (278)..(278): a, c, t, g, unknown or other
  modified_base (366)..(366): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagccctgtacatcatgatgggcacacctacttgaattggtcgnagngcaggccatcnccaaggcaccttaatttataaggtgtctgacgagggaccgtcccgggggtaccagacagtacttcgaggtcggcgtaggtcgggtacncggggctacgtggtactttaccgaactaacgtaaggaaaacttcgaaagggcggaagggggttggaaggggacgttaggggaagggttagtttaggtttaaggttcggggtactttaccgtttaggtttaacgtttgggtacccttaagttacggaacctaaacggccaaaaccgtaccgtaaccggttaccgggtaaccccgtttaaccggttaaccggtttttcggggaacccggaacgggggttaacccgaaacgggtcgttagggacgttaacgtaacctaagtaacccggtaagtcggttacgggtcttcggtaacccg

SEQ ID NO: 420340 - DNA, 675 bp, Homo sapiens
  misc_feature: GZ8MTXP01A595X.13.73.G07.1.454.CMB.2.raw
  modified_base (402)..(402): a, c, t, g, unknown or other
  modified_base (414)..(414): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttaggaggggatgctgtaatgactcagtctccactcctccctcgcccgtcacccttggacacgcccggcctccatcctcctgctagttctagtacaaacgcctacgtacatcatgagtcgggacactaccttacttagtaagttcgggtcggacgaggacggaccacggacctaactcctaccgaaacggcctaacctttaaagtttagtaagggttgtcgtaggaccgacggggtaccgtccggggtaccagacagtactcgaggcggngaggtacgggcnggctagtcgtacttacgaactacgtaagtaaaatcggtaagggtggggtaggaggtcgtaggaggttagttggttaacgtggtacttagttagttacgtggactagtacgaacaacgaccaaacgaccgtagtcccgggttaccgttaaccgttacgggttccgggaacccggaaagggggtaacccaaggtccggtaagggttaacttcgttaaacgtaacgtaccgggtaagtgggtaccgactcggttaacctaaccg

SEQ ID NO: 420341 - DNA, 598 bp, Homo sapiens
  misc_feature: GZ8MTXP01AWMZC.13.73.G07.1.454.CMB.2.raw
  modified_base (70)..(70): a, c, t, g, unknown or other
  modified_base (260)..(260): a, c, t, g, unknown or other
  modified_base (263)..(263): a, c, t, g, unknown or other
  modified_base (300)..(300): a, c, t, g, unknown or other
  modified_base (566)..(566): a, c, t, g, unknown or other
tcagtcacgtactacacgaccggtgctcgatttagctctacgctcagggggatcaggactcctcagttcnccttctcacaatgaggctccctgctcagctcctggggctgctaatgctctgggtcccaggatttagaggggatgctgtaatgactcagtctccactctccctgcccgtcacccttggacagccgcctccatctcctgcagttctagtcaaagcctacgtacatcatgatggcacactactgattggtcgnagngccagcaatctacaaggtctacttaatttataaggtntacgtagacgacgggtaccgtcccgggtaccagaccaggtacttccggaggtcggacgtaggtcgggtcaaggtctaacgttgtaactttacaactaacgtaagtaaaacgtcgaaggcggaaggggtaggagggtacgtgggtaaggtgttaggttacgttagggtcttattaaggttattggactagtcgacaagactaaacacgtacgtcggtaccttacgtaacggtttcggaccggtaacgggaccgtaagcgagggttanacgtaacgtaagtcgtagtggttatccgcgtc

SEQ ID NO: 420342 - DNA, 604 bp, Homo sapiens
  misc_feature: GZ8MTXP01EOZQE.13.73.G07.1.454.CMB.2.raw
  modified_base (327)..(327): a, c, t, g, unknown or other
  modified_base (373)..(373): a, c, t, g, unknown or other
  modified_base (386)..(386): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactcctccctcgcccgtcacccttggacacgcccggcctccatctcctgctagttctagtcaaacgcctcgtacatcatgagtcgggacactaccttacttagtaagtttgggtcgcgagacggccaggaccaatccacgaaggctacttaatttagtaaggtntactaggacgacgggtaccgtccgggaccagacagtactcgagcgntaggtcgggtacnggctactgtactttacaactactaagaaatcgaggcggaggggtggaggtacgtaggtagtagttggttagttggtacttattagtttagttgactagtacgacgtaacgacaaaccgtacgtaccggtcggtacccgttacgttaacggtttacgggacccggtaagggaaccgaggcgttaggacgataacgatcggacgttgacgtcttcgaacc

SEQ ID NO: 420343 - DNA, 557 bp, Homo sapiens
  misc_feature: GZ8MTXP01CJVKX.13.73.G07.1.454.CMB.2.raw
  modified_base (302)..(302): a, c, t, g, unknown or other
  modified_base (305)..(305): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagcccgcctccatctcctgcagttctagtcaaagcctcgtacatcatgatgggcacactactgtaattggtcgcagagccagccaatcctcgaagcgacctaattataaggtntcngacaggcgtccgggccagacagactgagcgcaggtagggcaaggcagtgactttacacgaactagaaatcaaggacgagggtaggaggagtaggagtagttgttagttggctagttagttagttgatagtagccgaagacaaacactacgtacgtaccgttaactaacgtttcggaccggtacgggttaacaacgtcgttaggacgttactaaggtaaataacggtaacgtggttacgtccgttcgaacccg

SEQ ID NO: 420344 - DNA, 693 bp, Homo sapiens
  misc_feature: GZ8MTXP01EM1VQ.13.73.G07.1.454.CMB.2.raw
  modified_base (267)..(267): a, c, t, g, unknown or other
  modified_base (281)..(281): a, c, t, g, unknown or other
  modified_base (302)..(302): a, c, t, g, unknown or other
  modified_base (341)..(341): a, c, t, g, unknown or other
  modified_base (349)..(349): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtccaggatttagaggggatgctgtaatgactcagtctccactcctccctgcccgtcacccttggacagccggcctccatcctcctgctagttctagtacaaagcctacgtacatcatgatgggcacacctattgaattggtcgnagagccagcaatcncaaggcactaattataaggtntctgacgaggacgtccgggtccagacagtactcgagcgnaggtgggnaaggctaacgtgtaactttaccgaaactaactaaagtaaaaactcgaaggacggtaaaggggggtagggaacgggtacgtaagggtaaaggttagttaggtttaacgttacgggtactttaacgtttaagtttaagttacgtacgtaagtacgaacgaaacgaaaccgtaaaccgtaaaccgtaaccggttaccggttaacccggttaaaccgtttaaccggttttaacgggttaaaccggggtaaaccggggttaaaccggtaaacggtaacggttaacgggttaacgttaaacgtaacgtaaacgtaacgtaacggtacggttacggtcgttaacgtaaccg

SEQ ID NO: 420345 - DNA, 247 bp, Homo sapiens
  misc_feature: GZ8MTXP01ELUPQ.13.73.G07.1.454.CMB.2.raw
  modified_base (244)..(247): a, c, t, g, unknown or other
tcagtcacgtactacacgaccggtgctcgatttagctctacgctcagggtcttcgtggctcacgtccaccaccacgcatgtgacctcaggggtccgggagatcatgagggtgtccttgggtttggggggaagaggaagactgacggtcccccaggagttcaggtgctgggcacagcggccctgggctgcctggtcaaggactacttcctagtacgtgactgagcgggctggcaaggcgcatagnnnn

SEQ ID NO: 420346 - DNA, 693 bp, Homo sapiens
  misc_feature: GZ8MTXP01BQJSV.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactcctccctgcccgtcacccttggacagcccggcctccatcctcctgctagttctagtacaaagtccctacgtacatcatgagtgggacactaccttagttagtaagttggtcgactaggacggaccaggaccaactcctaccgaaacgggtccgtaacctttaaagttttagtaagggtgttaccgtaggaacgacgggggtaccgtcccgggggtaccaggactagtaaccttccgaggccggacgtaggtagggtcaagggctaacgttgtactttaccaactaacgtaagaaaacgtcgaaggtcgggaggggtaggaggtacgtaggtaaggtacgttggttaacgtgggtactttacgttaagttagtttggactaagtacgaccgaaacgaccaaacgtcgtaaccgtacggtacccgttagttaaccgtttcggaaccgggtaacgggacctaaacgggtcgttagggacgttacgtaacgaaagttcccggtaagtgggttcgtaaccttaagaaccccg

SEQ ID NO: 420347 - DNA, 680 bp, Homo sapiens
  misc_feature: GZ8MTXP01EH6N9.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactcctccctcgcccgtcacccttggacacgcccggcctccatcctcctgctagttctagtacaaagcctacgtacatcatgatcggcactactacttgtaattggtcgcaggacgccaggaccaatccgtaccgaaggcgtacctttaaatttaagtaaggtcgtactaggaacgaacgggggtaccgtccgggggtacccaagaccgtagtaccttcgacggtcggacgtagggtcgggtaccaagggcctaaaccgttggtaacttttaccaaccgtaataaagaaaactcgaaggacggaggggttggacgggtagtaggaaggtagttaggttacgttgggtacttattaaggttattacggtacaagtacgaacaaacgacaaacgaccgtacgttaccggacccgtttacgttaacggttttaccggaccggtaaacggggaaccctaaaggcgttacgggaattacgtaacgaacgttaacggtaacgtggttccggtcttcgtaaccc

SEQ ID NO: 420348 - DNA, 631 bp, Homo sapiens
  misc_feature: GZ8MTXP01CHXSK.13.73.G07.1.454.CMB.2.raw
  modified_base (270)..(270): a, c, t, g, unknown or other
  modified_base (352)..(352): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacacgcccggcctccatctcctgctagttctagtcaaagcctacgtacatcatgatgggacactacctattgtaattggtcgnagaggccaggccaatcaccgaaggctacctaattataaggtgtctgacgagggacgtccgggtacagacagtactgagcggnaggtacgggtcaaggctacgtgtactttacactagtagtaaatcgagacggtaggggtggacggtagtaggtaaggtagttagggtttagttaggggttacttacgtttaaggtttagtttacggtacctagttacggaactaacggacaaaaccgtaccgtaccggttacggtaccgttaaccgtaacgttttcgggaccggtaacggggaaccgtaaacggtcgttaggagttacgtaacgtaacgtccggtaagtcggttaggtcttcgtaacccg

SEQ ID NO: 420349 - DNA, 642 bp, Homo sapiens
  misc_feature: GZ8MTXP01ATBUN.13.73.G07.1.454.CMB.2.raw
  modified_base (263)..(263): a, c, t, g, unknown or other
  modified_base (349)..(349): a, c, t, g, unknown or other
  modified_base (377)..(377): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatcctcctgcagttctagtcaaagcctgtacatcatgatggcacacctacttgaattggtcgnagagccagccaatctccaaggctacctaatttagtaaggtgtctgacgaggggaccgtccggggtaccagacagacttcgagcggnaggtcgggcaaggcacgttgactttcanactaagaaatcgaggacgaggggtggaggcgtaggaggtagttaggtttagttggggtacctttagttaaagtttagttagggtacctaagttacgaaccgaaaggaccaaaccgtaccgtaccggtacgggtacccgttaacgttaaccggttttacgggacccgggtaaacggggaacccgtaacgggtaccgttagggaacgttacgttaaccgaaagttcccggtaaacggttcggttacggggaaccttcggtaaccccg

SEQ ID NO: 420350 - DNA, 614 bp, Homo sapiens
  misc_feature: GZ8MTXP01AL9KR.13.73.G07.1.454.CMB.2.raw
  modified_base (258)..(258): a, c, t, g, unknown or other
  modified_base (295)..(295): a, c, t, g, unknown or other
  modified_base (344)..(344): a, c, t, g, unknown or other
  modified_base (362)..(362): a, c, t, g, unknown or other
  modified_base (379)..(379): a, c, t, g, unknown or other
  modified_base (385)..(385): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccgctccatctcctgcagttctagtcaaagcctgtacatcatgatggcacacctattgattggtcgnagagcgagcatcacgagtcgtacttaattagtaggtntctaggacgaacggtccggtaccggaccagacgagtactcgaggcgagnggtaggcgaagcctagtntacttacactaagtaanaaacgngagagggtagggtagagtaggtaggtagttagttacgttaggttcgtacttaatttaggttacgtagtactaagtacgaacgaaacgtaacaaccgtacgtaccgtaccgtaccgttaaccgttaacggtttaccgggaaaccggtaaacggaacgtaacgtacggaaggttacttaccgtaacgtaaaccgtaacgttaacggtcggttaccgtaacgttcgtaaccg

SEQ ID NO: 420351 - DNA, 513 bp, Homo sapiens
  misc_feature: GZ8MTXP01AR57S.13.73.G07.1.454.CMB.2.raw
  modified_base (267)..(267): a, c, t, g, unknown or other
  modified_base (289)..(289): a, c, t, g, unknown or other
  modified_base (293)..(293): a, c, t, g, unknown or other
  modified_base (295)..(295): a, c, t, g, unknown or other
  modified_base (314)..(314): a, c, t, g, unknown or other
  modified_base (324)..(324): a, c, t, g, unknown or other
  modified_base (334)..(334): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtcgcagngcagcaatctcagcactattanagtntngacaggctcgggccagacngactcagcgnacgtgggtcnggcacgtgattcacatacgaaatcgaagcgaagggtggaggcgtgaggtattgttattgggacttcgtaagttattgacaatggacaagtacaaacactactcggtacctacgttaacgtttggccggaggggcccgtagcgttggacgagtcaagtccgaagtgttcggcttgtaacc

SEQ ID NO: 420352 - DNA, 567 bp, Homo sapiens
  misc_feature: GZ8MTXP01DLEVZ.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctcgcccgtcacccttggacagccggcctccatctcctgcagttctagtcaaagcctcgtacatcatgagtgggcacacctacttgaattggttcgcagaggccaggccaatctaccaaggctaccttaaatttacgtaaggtgtctaggacgacgggaccgtccggggtacccagacagtactcgagcggacaggtcgggtcaaggctacgtgtatttaccactactagaaatcaggcgagggtcggaggtcgtagagtaagttgttagtgggtcttcgttattagttgctagtgacaagcaaaactcgtacgtggtccgtaacgtaactttcgggaccgtaaggggacccaaaggcgttaggttagataacaatcgaacgtgacggtcttgaacc

SEQ ID NO: 420353 - DNA, 691 bp, Homo sapiens
  misc_feature: GZ8MTXP01DSAYT.13.73.G07.1.454.CMB.2.raw
  modified_base (409)..(409): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacacgccggcctccatcctcctgctagttctagtacaaagcctgtacatcatgatcgggacactacctattgtaagttggtacgcagcggacctaggcccaatcctaccgaaaggtccgtaacctttaaagttttaacgtaagggttcgtctaggaacggtacggggtaccggttaccccgggggtacccaaggacagacgttcaggcgcgtaggtcggacncgggctacgtgtactttaccgaactaactagaaactcgaagcggagggtaggacggtacgtaggtaaggttagttaggttagttaggtaccttagtttaagtttacgttaggtacctaagtacgaaccgaaggaaccctaaacgtaccgtaacgtaccgggttacccgttaacgttaaccgttttcggggacccggtaaggggaaaccgtaaacggtcgttaagggaacttaccgttaacgaaagttaaccggtaccgtaggttacggtcgttcggaacccg

SEQ ID NO: 420354 - DNA, 494 bp, Homo sapiens
  misc_feature: GZ8MTXP02IWBJJ.13.73.G07.1.454.CMB.2.raw
  modified_base (354)..(354): a, c, t, g, unknown or other
tcagtcacgtactacacgaccggtgctcgatttagctctacgctcaggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcggcagaggccaggccaatctccaaggcgcctaatttataaggtgtctgacagggactccggggtcccagacagattcagcggcagtgggtcngggcactgatttcacactgaaaatcagcagggtgaggctgaggatgttatgggctgttattattgcatgcaagcaacacactggccgtacactttggccaggggaccaagctaggagatcgaatcgaactgtaggctgac

SEQ ID NO: 420355 - DNA, 509 bp, Homo sapiens
  misc_feature: GZ8MTXP02HBRA0.13.73.G07.1.454.CMB.2.raw
  modified_base (436)..(436): a, c, t, g, unknown or other
  modified_base (483)..(483): a, c, t, g, unknown or other
  modified_base (485)..(485): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcggcagaggccaggccaatctccaaggcgcctaattataaggtgtctgacagggactccggggtcccagacagactcagcggcaggtgggtcaggcactgatttcacgactagaaaatcagcgagggtggagctgaggatgtagtgggctgtattattgctagtgacaagcaanacactggcctactacgtttggaccgaggggaccaaggcgtagggaananaacgaacgtacgactgcgctacgc

SEQ ID NO: 420356 - DNA, 480 bp, Homo sapiens
  misc_feature: GZ8MTXP02G1T24.13.73.G07.1.454.CMB.2.raw
  modified_base (296)..(296): a, c, t, g, unknown or other
  modified_base (302)..(302): a, c, t, g, unknown or other
  modified_base (389)..(389): a, c, t, g, unknown or other
  modified_base (418)..(418): a, c, t, g, unknown or other
tcagtcacgtactacacgaccggtgctcgatttagctctacgctcaggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgccagttctagtcaaagcctcgtacatcatgatgggcacactactgaattggttcgcagaggccaggccaatctcaaggcgcctaattanaaggtntctgacagggactccggggtccagacagattcagcggcagtggtcagggcactgatttcacactgaaaatcagcaggtgagctgagntgtatggctctatattgcatgacagcaanacactgccgtatactttggccaggggaccaagctaggagatcaatccgaactgtagctgacc

SEQ ID NO: 420357 - DNA, 558 bp, Homo sapiens
  misc_feature: GZ8MTXP02F9FE1.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcggcagaggccaggccaatctccaaggcgcctaatttataaggtgtctgacagggactccggggtccagacagacttcagcgcagtggtcaggcactgatttcacactagaaaatcaagcgagggtggaggctggaggagttgttagttggggtacttcgttatttagttgctagttgacaaagcaaacacaacctgggtacccgtaacgtaaccgttttcgggacccgaacgggggaaccaaacggcgtacggagactaacaaacgtacgtaaacgtggtacgggtctacggccg

SEQ ID NO: 420358 - DNA, 536 bp, Homo sapiens
  misc_feature: GZ8MTXP02G7JSM.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacactactgaattggttcgcagaggccaggccaatctccaaggcgacctaatttataaggtgtctgacagggactccggggtccaggacagacttcagcggcaggtgggtcaggcacgtgactttcaactactagaaaatcaagcgaggggtggagggctggaggtagttggttattgggcttattattattgcatagacaagacaacacacgtcggaccgtacgtacgtttacggaccgacgggggaaccaaggtcgtacggagataacaataccgaactgtcggctagacc

SEQ ID NO: 420359 - DNA, 650 bp, Homo sapiens
  misc_feature: GZ8MTXP02H7NCV.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcgcagaggccaggccaatcctccaaggcgacctaattataaggtgtctgacagggactcggggtcccagacagatcgagcggcagtgggtcaggcactgtatttcacactagaaaactcgagacgaggggtaggaggacgtaggaaggtagtaggtttagttggggtcttacgtttaatttaagtttggactagttacggacctaaaaggacctaaaacaaccgtaaccgttcggggtaaccccgtttaacgttaaacccggtttttcggggaaccccggtaaacggggggtaaaaccctaaaagggcccgttaacggggaaggtaaacttaaccgaaaacgttaccgggaaaaccgttgggtaccggggtcctttacggaaccccg

SEQ ID NO: 420360 - DNA, 568 bp, Homo sapiens
  misc_feature: GZ8MTXP02IYHJ5.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtcccaggatttagagggatgctgtaatgactcagtctccactctccctgcccgtcacccttggacagccggcctccatctcctgcagttctagtcaaagcctcgtacatcatgatgggcacacctattgaattggttcgcagaggccaggccaatcctaccgaaggccgaccttaaatttataaggtgtctagacgagggacctcccggggtccagacagtacttcgagcggcaggtggggtcaggggcactgtaactttcaacaactagaaaatcgaagcgaggggtggaggctggaggattgttagtgggacttgttatttagttgactatagacgagacaacacacgtacgtacgtacgttacgttacggtaccggacgggaacgaacgacgtacggagaacgtaacgtaacgtaacgtacgtaggtacggtacgtacgacg

SEQ ID NO: 420361 - DNA, 513 bp, Homo sapiens
  misc_feature: GZ8MTXP02HC9CO.13.73.G07.1.454.CMB.2.raw
  modified_base (354)..(354): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcgcagaggccaggccaatctccaaaggcgcctaatttataaggtgtctgacagggactccggggtccagacagactcagcgcagtgggtcnggcactgatttcacactagaaaatcagcagggtgagctgagatgtagtgggctgtattattgctatgacaagcaaacacacgtcggaccgtactacgtttcggtacgagggggtaccaacgtcgtaggaagataacgaatacgaactgtcggcgtgacc

SEQ ID NO: 420362 - DNA, 510 bp, Homo sapiens
  misc_feature: GZ8MTXP02FWJ9S.13.73.G07.1.454.CMB.2.raw
  modified_base (347)..(347): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcgcagaggccaggccaatctccaaggcgcctaattataaggtgtctgacagggactcgggtccagacagatcagcgcagtggtcnggcactgatttcacactagaaaatcagcgagggtggaggcgtgaggatgttagttgggtacgtctagttattgcatgacagacaacacactggccgtactacgtttcggacgtacggggacctaacgcgtaggagataacgaatcgaactgtacggctagacc

SEQ ID NO: 420363 - DNA, 505 bp, Homo sapiens
  misc_feature: GZ8MTXP02FUR59.13.73.G07.1.454.CMB.2.raw
  modified_base (279)..(279): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcgcagagcaggcaatcncaagcgcctaatttataaggtgtctgacagggactccggggtcccagacagattcagcgcagtgggtcaggcactgatttcacactgaaaatcagcagggtggaggctgaggatgtattgggctctattattgcatgcagacaacaacactagcgtactaactttcggtaccgacggggaccgaaagacgtaggaggaataacgaactacgacgtagtcgcgacgc

SEQ ID NO: 420364 - DNA, 522 bp, Homo sapiens
  misc_feature: GZ8MTXP02JQN0W.13.73.G07.1.454.CMB.2.raw
  modified_base (305)..(305): a, c, t, g, unknown or other
tcagtcacgtactacacgaccggtgctcgatttagctctacgctcaggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcgcagaggccaggccaatctccaaggcgacctaattataaggtntctgacagggactccggggtcccagacagacttcagcggcaggtgggtcagggcactgatttcacactagaaaatcagcgagggtggagcgtggaggtatgttagtgggctgtattatgcagtgacaagacaacacacgtcggaccgtactacgtttcggccgacgggaccaagccgtaggacgagtaacgaacgtacgaacgtgtcggtctcgacc

SEQ ID NO: 420365 - DNA, 517 bp, Homo sapiens
  misc_feature: GZ8MTXP02FY5OX.13.73.G07.1.454.CMB.2.raw
  modified_base (289)..(289): a, c, t, g, unknown or other
  modified_base (410)..(410): a, c, t, g, unknown or other
  modified_base (486)..(486): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcgcagaggccaggccaatctcaaggcnctaattataaggtgtctgacgagggaccgtccggggtccagacagactcagcggcagtggcaggcactgactttcaacactagaaaatcagcgagggtgaggctgagatgttagtggcttntattatgcagtgacaagacaacgactacgtcggaccgtacgtacgtttgggaccgaagggtaccaaagcgtagganaacgtcaagtacgtaacgtgtcggctcgacc

SEQ ID NO: 420366 - DNA, 501 bp, Homo sapiens
  misc_feature: GZ8MTXP02FYTZQ.13.73.G07.1.454.CMB.2.raw
  modified_base (410)..(410): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcggcagaggccaggccaatctccaaaggcgcctaaatttataaggtgtctgacagggactccggggtcccagacagacttcagcggcagtgggtcaggcactgatttcacactgaaaatcagcagggtggagctgagatgttatgggntctatattgcatgcaagcaacacactggccgtactactttaggccaggggacccaaagcctaggagataacaatcgaaactgtggctgacc

SEQ ID NO: 420367 - DNA, 492 bp, Homo sapiens
  misc_feature: GZ8MTXP02H0Z2A.13.73.G07.1.454.CMB.2.raw
  modified_base (354)..(354): a, c, t, g, unknown or other
  modified_base (441)..(441): a, c, t, g, unknown or other
tcagtcacgtactacacgaccggtgctcgatttagctctacgctcaggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtggtcngggcactgatttcacactgaaaatcagcagggtgagctgaggatgttattggctctattattgcatgcagcaacacactggccgtancttttggccagggaccaagccgtagagatcgaatcgaactgtacggctgcc

SEQ ID NO: 420368 - DNA, 517 bp, Homo sapiens
  misc_feature: GZ8MTXP02GSVHL.13.73.G07.1.454.CMB.2.raw
  modified_base (306)..(306): a, c, t, g, unknown or other
  modified_base (408)..(408): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcggcagaggccaggccaatctccaaggcgcctaattataaggtntctgacagggactccggggtccagacagattcagcggcagtgggtcagggcactgatttcaacactagaaaatcagcgagggtggagctgagatgtatgggntctattattgcatgacaagcaaacacacgtggaccgtactacgttttcggaccgtaacgggggacccaaaggccgtaggagagtaacaagtcgaactggtacgctgacc

SEQ ID NO: 420369 - DNA, 540 bp, Homo sapiens
  misc_feature: GZ8MTXP02ICUP6.13.73.G07.1.454.CMB.2.raw
  modified_base (300)..(300): a, c, t, g, unknown or other
  modified_base (352)..(352): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacactacttgaattggttcgcagaggccaggccaatctaccaaggcgcctaatttanaaggtgtctcacaggactccggggtcccagacagatcagcggcagtgggtcnggcaactgatttcacactagaaaatcgagcgagggtggaggctgagatgttagtgggctcttattattgcatgcaagcaacacactcggccgtaactacgttttcggccgtaacggggaaccgaaacgcgttagggagtaagtaacgtaaacgtacgtaaaacgtggttacgggtcttacggaacccg

SEQ ID NO: 420370 - DNA, 541 bp, Homo sapiens
  misc_feature: GZ8MTXP02HPHA2.13.73.G07.1.454.CMB.2.raw
  modified_base (359)..(359): a, c, t, g, unknown or other
  modified_base (446)..(446): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcggcagaggccaggccaatctccaaggcgcctaatttataaggtgtctgacgaggggacctccggggtcccagacagacttcagcgcaggtgggtcngggcactgatttcacactagaaaatcagcgagggtggagctggagtatgttagtgggcttcttattattgctagtgacaagcaaacncaacgtcggaccgtaactcgttttacgggaccgtacggggtacccaagtacgtaggagtataacgaaatacgtaacgtggtcggacgttgacccg

SEQ ID NO: 420371 - DNA, 491 bp, Homo sapiens
  misc_feature: GZ8MTXP02H8GX7.13.73.G07.1.454.CMB.2.raw
  modified_base (350)..(350): a, c, t, g, unknown or other
  modified_base (413)..(413): a, c, t, g, unknown or other
tcagtcacgtactacacgaccggtgctcgatttagctctacgctcagggggatcaggactcctcagttcaccttctcacaatgaggctcccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacactacttgaattggttcgcagaggccaggccaatctcaaggcgacctaattataaggtgtctgacagggactccggggtcccagacagatcagcgcagtggtcnggcactgatttcacactgaaaatcagcgagggtgagctgagatgttatggctcttattattgntatgcaagcaacacactagcgtactacgtttgccgagggaccaagcgtaggagataagacacgtactagtgcgtcgac

SEQ ID NO: 420372 - DNA, 513 bp, Homo sapiens
  misc_feature: GZ8MTXP02IY5FX.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcggcagaggccaggccaatctcaaggcgcctaattataagtgtctgacagggactccggggtccagacagattcagcggcagtggtcaggcactgatttcacactagaaaatcagcagggtggagctgagatgtatggctctattattgcatgacagacaacacacgtaggccgtactaacgttttcggaccacgggggaacccaaagccgtaggagattaacgaaactcgaaactggtacggctcggacc

SEQ ID NO: 420373 - DNA, 537 bp, Homo sapiens
  misc_feature: GZ8MTXP02GQ8RL.13.73.G07.1.454.CMB.2.raw
  modified_base (311)..(311): a, c, t, g, unknown or other
  modified_base (359)..(359): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcggcagaggccaggccaatcctaccaaggcgtacctaatttataaggtntctgacagggactccggggtacccagacagacttcagcgcagtggtcnggcactgattcgacactagaaaatcaagcgagggtggagcgtggagtagtgttagtgggctatattagttgctagtgacaagacaacacacgtggaccgtaactacgtttcggaccgtacggggaccaagacgtacggaagattaaccgaaagtaccgtaaacgtggtcggctcgacc

SEQ ID NO: 420374 - DNA, 516 bp, Homo sapiens
  misc_feature: GZ8MTXP02GTMTY.13.73.G07.1.454.CMB.2.raw
  modified_base (353)..(353): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcggcagaggccaggccaatctccaaggcgcctaattataaggtgtctgacagggactccggggtccagacagacttcagcggcagtggtcnggcactgatttcacactgaaaatcagcagggtggagctgaggatgttagtggctcgtattattgcatgacagcaacacacgtcggaccgtactacgttttcggccgacggggacccaaaggcgtaggagacgtaacaacgtacgaaactggtcggcgtgaccg

SEQ ID NO: 420375 - DNA, 499 bp, Homo sapiens
  misc_feature: GZ8MTXP02GK6WA.13.73.G07.1.454.CMB.2.raw
  modified_base (356)..(356): a, c, t, g, unknown or other
tcagtcacgtactacacgaccggtgctcgatttagctctacgctcaggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagaccagattcagcggcagtgggtcngggcactgatttcacactgaaaatcagcagggtgagctgaggatgttattgggctctattattgcatgcaagcaacacactggcctactactttggccaggggaccaagcctaggagatcgaatacgaactgtggcctagacc

SEQ ID NO: 420376 - DNA, 676 bp, Homo sapiens
  misc_feature: GZ8MTXP02G35AY.13.73.G07.1.454.CMB.2.raw
  modified_base (360)..(360): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcggcagaggccaggccaatcctccaaggcgcctaatttataaggtgtctgacagggactcccggggtcccagacagacttcgagcggcaggtgggtcngggcacgtgatttcacactagaaaatcagcgaggggtggaggtctaggaggtagttggttagttggggtacttacgttaaagtttagtttaggtactagttacggacctaaaaggtaccctaaaaccaaccgtaaaccggttaccggggtaacccccggtttaaccgtttaaaacccggttttttccggggaaacccccgggttaaacggggggtaaaccccctaaaaggggcccggttaacgggggaaggtaacttaacccgaaaagtttaccggaaaacgtttcgggtaaccggggtccttacgggaacccccg

SEQ ID NO: 420377 - DNA, 526 bp, Homo sapiens
  misc_feature: GZ8MTXP02FREGM.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcgcagaggccaggccaatctcaaggcgacctaatttataaggtgtctgacgagggactccggggtccagacagacttcagcggcaggtggtcaggcacgtgatttcaacactagaaaatcagcgagggtggaggctgaggtattgttagttgggtcttattattattgctatgacaagcaaacacactcggccgtactacgtttcggaccgacggggaccaacgcgtaggagactaacgaagtacgtaacgtgtgcgtacgacc

SEQ ID NO: 420378 - DNA, 525 bp, Homo sapiens
  misc_feature: GZ8MTXP02IGILE.13.73.G07.1.454.CMB.2.raw
  modified_base (357)..(357): a, c, t, g, unknown or other
  modified_base (400)..(400): a, c, t, g, unknown or other
  modified_base (412)..(412): a, c, t, g, unknown or other
  modified_base (484)..(484): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacactacttgaattggtttcgcagaggccaggccaatctccaaggcgacctaatttataaggtgtctgacgagggactccggggtcccagacagacttcagcggcagtgggtcnggcatgatttcacactagaaaatcagcgaggggtgagctgagntgttatgggctnttattattgctatgcaagctaacacacgtcggcttactacgtttgaccgtagggaaaccaacgcgtaggganacgttaaccgaaagtcgtaaacgtgttcggacgtcgaaccc

SEQ ID NO: 420379 - DNA, 558 bp, Homo sapiens
  misc_feature: GZ8MTXP02G2F7K.13.73.G07.1.454.CMB.2.raw
  modified_base (304)..(304): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcgcagaggccaggccaatctccaagcacctaattataaggtntctgacgagggacgtccggggtaccagacagacttcgagcggcaggtgggtcaggcagtgtatttcaacactagaaaatcagacgaggggtggaggacgtaggaggtagttaggttagttggggtacttacgttaatttagttagactagtagacgaagacaacacactacgaccctaactacgtttcggaccgacggggaaccaaggcgtaggaagactaacgaacgtacgtaacgtggtacgtcgtacgacc

SEQ ID NO: 420380 - DNA, 499 bp, Homo sapiens
  misc_feature: GZ8MTXP02HVGX5.13.73.G07.1.454.CMB.2.raw
  modified_base (400)..(400): a, c, t, g, unknown or other
  modified_base (496)..(496): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttcagtcaaagcctcgtacatcatgatgggcacacctactgaatggttcgcagaggcaggccaatctccaaggcgcctaatttataaggtgtctgacagggactccggggtccagacagattcagcgcagtggtcaggcaatgatttcacactagaaaatcagcagggtggagctgagatgttatgggntctattattgctatgcaagacaaacacactggaccgtactacttttggaccgaacggggaccaaagcgtaggagatcaatacgaactgtacggctnacc

SEQ ID NO: 420381 - DNA, 503 bp, Homo sapiens
  misc_feature: GZ8MTXP02HOD0Q.13.73.G07.1.454.CMB.2.raw
  modified_base (290)..(290): a, c, t, g, unknown or other
  modified_base (353)..(353): a, c, t, g, unknown or other
  modified_base (366)..(366): a, c, t, g, unknown or other
  modified_base (408)..(408): a, c, t, g, unknown or other
  modified_base (416)..(416): a, c, t, g, unknown or other
  modified_base (426)..(426): a, c, t, g, unknown or other
  modified_base (476)..(476): a, c, t, g, unknown or other
  modified_base (502)..(502): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagcccggcctccatctcctgctagttctagtcaaagcctcgtacatcatgatgggcacactactgaattggttcgcagagccaggccaatctacaaggccnctaaatttagaaggtgtctgacgagggactccggggtccagacagactcagcggcagtggacngcactgattcaanataccgaaaatcaagcgagggtgagctgagatgtagtggctntattatgnagtgacaaanacaacacacgtacgtacgtacgtacgttacggacgacggacacgcgaganactaacgaactacacgtgtcgcgtanc

SEQ ID NO: 420382 - DNA, 534 bp, Homo sapiens
  misc_feature: GZ8MTXP02ILASS.13.73.G07.1.454.CMB.2.raw
  modified_base (405)..(405): a, c, t, g, unknown or other
  modified_base (424)..(424): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatcctccaaggcgacctaatttataaggtgtctgacaggggactcccggggtcccagacagacttcagcggcagtggggtcagggcacgtgatttcacactgaaaatcagcgaggggtggaggcnggaggatgtagttgggctntattattgcatgacaagacaacacactaggccgtactaacgttttggaccgacgggggaccaaaggcgtaggacgataaccgaaagtacgaaactggtacggccgtgacc

SEQ ID NO: 420383 - DNA, 522 bp, Homo sapiens
  misc_feature: GZ8MTXP02JV8OA.13.73.G07.1.454.CMB.2.raw
  modified_base (415)..(415): a, c, t, g, unknown or other
  modified_base (423)..(423): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtccagacagacttcagcggcaggtgggtcagggcactgatttcacactagaaaatcgagcgagggtggagctgagatgttatgggctntattatgnatgctaagcaaacacacgtcggaccgtactacgtttggaccgtacggggaccaaaggtccgtaggacgataacgaagtccgaaagtgtcggtctagacc

SEQ ID NO: 420384 - DNA, 524 bp, Homo sapiens
  misc_feature: GZ8MTXP02JSVD3.13.73.G07.1.454.CMB.2.raw
  modified_base (303)..(303): a, c, t, g, unknown or other
  modified_base (412)..(412): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctactgaattggttcgcagagccaggccaatctcaaggcgacctaattataaggtntctgacagggacctccggggtcccagacagacttcgagcggcaggtggtcaggcactgatttcacactagaaaatcagcgagggtgagctgagtatgttagtgggtctnttattatgcatgacaagacaacacacgtcggaccgtactacgtttcggaccgaacgggggaccaaaggccgtaggagtactaacgaacgtacgaactggtacggctacgacc

SEQ ID NO: 420385 - DNA, 658 bp, Homo sapiens
  misc_feature: GZ8MTXP02IRGQ6.13.73.G07.1.454.CMB.2.raw
  modified_base (363)..(363): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagcccggcctccatctcctgcagttctagtacaaagcctcgtacatcatgatggcacacctacttgaattggttcgcagaggccaggccaatcctcaaggcgtacctaatttataaggtgtcagacgaggaccgtccggggtcccagtacagactcgagcggcaggtgggtacngggcacgtgtactttcacactagaaaatcgagacgaggggtaggaggtcgtaggaaggtagttaggtttagttgggggtacttacgtttaaagtttacgttttaggacctaagttcggaaaccgtaaacggaaccgtaaaaccaaaccgtaaccggttaccgggtaaccccgttaaaccgtttaccggtttttaccggggacccggtaaacgggggtaaacccgaaacggtccggtaaggaacggtactaaccgtaaacgtacggtaaaccggtggtacggacgttacgaacccg

SEQ ID NO: 420386 - DNA, 547 bp, Homo sapiens
  misc_feature: GZ8MTXP02JCKJ9.13.73.G07.1.454.CMB.2.raw
  modified_base (353)..(353): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcggcagaggccaggccaatctccaaggcgacctaatttataaggtgtctgacaggggactccggggtccagacagatcagcgcagtggtcnggcactgattcacactagaaaatcagcgagggtggagctgaggatgtatgggtctcgtattagttgacatgcaagacaacacacgtacggaccgttaactacgttttcgggaccgtacgggggaacccaaaggtccgtacggaagtactaacgaaacgttaccggtaaacgtggtacggtccgttacggaaccg

SEQ ID NO: 420387 - DNA, 543 bp, Homo sapiens
  misc_feature: GZ8MTXP02ID5QV.13.73.G07.1.454.CMB.2.raw
  modified_base (285)..(285): a, c, t, g, unknown or other
  modified_base (299)..(299): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagcccggcctccatctcctgcagttctagtcaaagcctcgtacatcatgatggcacacctattgattggttcgcagagccaggcaatctcaaggcnctaattataaggtntctgacgagggactccggggtcccagacagacttcgagcggcaggtgggcaggcaactgtatttcacactagaaaatcagcgaggggtaggaggcgtaggaggtacgtagtttagttgggtcttagttaattagtttgctagtgacaaagcaaacacacgtgacccgtactaacgtttcggaccgaaggggacccaaaggcgtacggagataaccaagtaccgtaaactggtacggtctcgacc

SEQ ID NO: 420388 - DNA, 567 bp, Homo sapiens
  misc_feature: GZ8MTXP02JWSF1.13.73.G07.1.454.CMB.2.raw
  modified_base (266)..(266): a, c, t, g, unknown or other
  modified_base (352)..(353): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttgaacagccggcctccatctcctgcagttctagtcaaagcctcgtacatcatgatgggcacacctacttgaattggttcggnagaggccaggccaatctccaaggcgcctaatttataaggtgtctgacgagggactccggggtcccagacagactcagcgcagtggnnggcactgattcacactagaaaatcgagcgagggtggagcgtagaggtattgttagttgggcttacgttagttattgctagtagacaaacggttaacacgtaacgtcggtacccctaacgttaccgttttcgggaccgacgggggaacccaaacggtcgtacgggaagtacgttaccaagttaccggaacgtggttacgggctcggacctaaccg

SEQ ID NO: 420389 - DNA, 528 bp, Homo sapiens
  misc_feature: GZ8MTXP02IIF5G.13.73.G07.1.454.CMB.2.raw
  modified_base (312)..(312): a, c, t, g, unknown or other
  modified_base (377)..(377): a, c, t, g, unknown or other
  modified_base (388)..(388): a, c, t, g, unknown or other
  modified_base (403)..(403): a, c, t, g, unknown or other
  modified_base (503)..(503): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagcccggcctccatctcctgcagttctagtcaaagcctcgtacatcatgatgggcacactacttgaattggttcgcagaggccaggccaagtcctaccaaggcgtaccttaatttataaggtntactgacgagggactccggggtcccagacagattcgagcggcaggtggcagggcatgatttccanactagaaaatnagcgaggggtgaggntgaggagttgtagttgggcttacttattatttgctagtagcaaagcaacacacgtagaccgttactacgtttggacgtacgggggaacacgcgtaggaanataacgagtacgacgtagcgcacgc

SEQ ID NO: 420390 - DNA, 571 bp, Homo sapiens
  misc_feature: GZ8MTXP02FT8TM.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcggcagaggccaggccaatctccaaggcgcctaatttataaggtgtctgacagggacctccggggtccagacagacttcagcggcaggtggtcaggcactgatttcacactagaaaatcagcgagggtggagcgtggaaggtattggttagttgggcttacgttatttagttgctaattgacaagacaacaacacgtacggccgttaactaccgttttacgggaccgtaacgggggaacccaaggtaccgttacggaggtaactaacgtaaaacgtaccggtaaaacgtggttacgggcttcggacccg

SEQ ID NO: 420391 - DNA, 525 bp, Homo sapiens
  misc_feature: GZ8MTXP02I7MV8.13.73.G07.1.454.CMB.2.raw
  modified_base (423)..(423): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaatggttcgcagagccaggccaatctccaaggcgcctaattataaggtgtctgacaggactccggggtcccagacagattcagcgcagtggtcagggcaactgatttcgacactagaaaatcagcgagggtgagctgaggatgttagtgggctctattattgctatganagacaacacactacgtacgtacgtacgtttcggtaccgacgggaaccgaacgaccgtacggagagtaacgtaagtacgtaaccgtagtcggtcgtcggaccg

SEQ ID NO: 420392 - DNA, 501 bp, Homo sapiens
  misc_feature: GZ8MTXP02JG7ZN.13.73.G07.1.454.CMB.2.raw
  modified_base (306)..(306): a, c, t, g, unknown or other
  modified_base (354)..(354): a, c, t, g, unknown or other
  modified_base (412)..(412): a, c, t, g, unknown or other
  modified_base (420)..(420): a, c, t, g, unknown or other
  modified_base (432)..(432): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcgcagaggccaggccaatctccaaggcgcctaatttataaggtntctgacagggactcccggggtccagacagacttcagcgcagtgggtcnggcactgattcacactagaaaatcgagcgagggtgagctgaggtatgttatgggactntattatgnatgcaagcaacncacgtgaccgtatacgtttaggccgaacgggacaagcgtaggagatcaagtacgacgtgcggactgacc

SEQ ID NO: 420393 - DNA, 508 bp, Homo sapiens
  misc_feature: GZ8MTXP02HJJLJ.13.73.G07.1.454.CMB.2.raw
  modified_base (355)..(355): a, c, t, g, unknown or other
  modified_base (411)..(411): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagcagattcagcggcagtgggtcnggcactgatttcacactagaaaatcagcgaggggtggagctgaggatgttatgggntctattattgcatgcaagcaacacacgtggccgtaactacgtttggccgtagggggaccaaggcgtggaagatcaagtcgaactggtcggctcgacc

SEQ ID NO: 420394 - DNA, 546 bp, Homo sapiens
  misc_feature: GZ8MTXP02H5LBP.13.73.G07.1.454.CMB.2.raw
  modified_base (278)..(278): a, c, t, g, unknown or other
  modified_base (292)..(292): a, c, t, g, unknown or other
  modified_base (297)..(297): a, c, t, g, unknown or other
tcagtcacgtactacacgaccggtgctcgatttagctctacgctcaggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcgcagagcaggcaatcncagcgcctaattanaagtntctgacagggactccggggtcccagacagacttcgagcggacaggtgggtcagggcaactgatttcaacactagaaaatcaagcgaggggtggagcgtagaggatgttagtgggctagtattattgactagtgacaagacaaacacgaacgtcggacccgtaacgtaccgtttcgggaccgaacgggggaacccaaaggccgtacggagaagtaaccaaagtacggaaaccgttgacggcttagacccg

SEQ ID NO: 420395 - DNA, 493 bp, Homo sapiens
  misc_feature: GZ8MTXP02HP6WE.13.73.G07.1.454.CMB.2.raw
  modified_base (355)..(355): a, c, t, g, unknown or other
  modified_base (406)..(406): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcggcagaggccaggccaatctccaaggcgcctaatttataaggtgtctgacagggactccggggtcccagacagacttcagcgcagtgggtcngggcactgatttcacactgaaaatcagcaggtgagctgagatgttatgggntcgtattattgcatgcaagcaacacaactgacgtactacttttggccacggggaccaagctaggagatcgaatcgaactgtgctgac

SEQ ID NO: 420396 - DNA, 575 bp, Homo sapiens
  misc_feature: GZ8MTXP02I5C6E.13.73.G07.1.454.CMB.2.raw
  modified_base (307)..(307): a, c, t, g, unknown or other
  modified_base (533)..(533): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcgcagaggccaggccaatctccgaaggcgacctaattataaggtntctgacagggactccggggccagacagacttcgagcggcaggtgggtcagggcactgactttcgacactagaaaatcgagcgagggtggaggcgtggaggtattggttagttggggtaccttagtttaagtttagtttggactagttacggacaaagactaacgacaacgtcggtaccgttactacgttttcgggaccgaacggggacccaaggtccgtacggganacgtaacgaacgtcgtaaaccgtggtacggcttacggacccg

SEQ ID NO: 420397 - DNA, 510 bp, Homo sapiens
  misc_feature: GZ8MTXP02F7WZH.13.73.G07.1.454.CMB.2.raw
  modified_base (305)..(305): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctactgaattggttcgcagaggccaggccaatctccaaggcgcctaatttataaggtntctgacagggactccggggtcccagacagacttcagcggcagtgggtcagggcactgatttcacactgaaaatcagcgaggtggagctgagatgttatgggctcgtattatgcagtgacaagacaacacactggaccgtactacttttcggccgtacggggaccaagtcgtaggagataacgaatacgaactggtacggctgacc

SEQ ID NO: 420398 - DNA, 504 bp, Homo sapiens
  misc_feature: GZ8MTXP02FIZ7G.13.73.G07.1.454.CMB.2.raw
  modified_base (394)..(394): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtccagacagattcagcgcagtgggtcaggcactgatttcacactagaaatcagcgagggtggaggcngaggatgttatgggctcgtattattgcatgacaagcaaacacaactggccgtacacttttggccgaggggaccaaagcgtaggacgataacaatcgaactgtggctgacc

SEQ ID NO: 420399 - DNA, 572 bp, Homo sapiens
  misc_feature: GZ8MTXP02G70U9.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatggcacacctacttgaattggttcgcagaggccaggccaatctccaaggcgtcctaatttataaggtgtctgacgagggacctccggggtcccagacagacttcgagcggcaggtgggcagggcacgtgtatttcacactagaaaactcaagcgaggggtgaggctggagtattggttagtgggcttacgttattagttgactagtgaccgaagtaccaaacgacacgtacggtacccgtaacttaccgtttagggaccgaacgggggaccaaaggccgtaggaacgtaactaacgaaacgtaccggtaaacgttcggtacggacctaggaccc

SEQ ID NO: 420400 - DNA, 483 bp, Homo sapiens
  misc_feature: GZ8MTXP02J3G4B.13.73.G07.1.454.CMB.2.raw
  modified_base (248)..(248): a, c, t, g, unknown or other
  modified_base (302)..(302): a, c, t, g, unknown or other
  modified_base (330)..(330): a, c, t, g, unknown or other
  modified_base (350)..(350): a, c, t, g, unknown or other
  modified_base (403)..(403): a, c, t, g, unknown or other
  modified_base (425)..(425): a, c, t, g, unknown or other
tcagtcacgtactacacgaccggtgctcgatttagctctacgctcagggggatcaggactctcagttcaccttctcacaatgaggctccctgctcagctcctgggctgctaatgctctgggtcccaggattttagaggggatgctgtaatgactcagtctccactctccctgcccgtcacccttggacagccggcctccatctcctgcagttctagtcaaagcctcgtacatcatgatggcacacctnttgaatgtttcggcagaggccaggccaatctccaaggcgcctaattataaggtntctgacaggggactccggggtccagacngacttcagcgcagtgggtcnggcactgatttcacactagaaaatcagcagggtgagctgagatgttattgggntcttattattgcatgcaagcanacactggctactactttgccaggggaccaagctgagatcatcgaactgtcggctgacc

SEQ ID NO: 420401 - DNA, 515 bp, Homo sapiens
  misc_feature: GZ8MTXP02JNSCV.13.73.G07.1.454.CMB.2.raw
  modified_base (299)..(299): a, c, t, g, unknown or other
  modified_base (381)..(381): a, c, t, g, unknown or other
  modified_base (394)..(394): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatggcacactactgaattggttcgcagagccaggccaatctcaagcgcctaattataaggtntctgacagggactccgggtaccagacagactcgagcgcagtggtcaggcatgattcacactagaaatcagcgagggtgagcngagtatgtatggntcttattatgcagtgacaagactaacgactacgtcggtaccgtacgtacgtttcggaccgtacggggacccaaggccgtaggagtactaacgaacgtacgaacgtggtacggctacgaccg

SEQ ID NO: 420402 - DNA, 494 bp, Homo sapiens
  misc_feature: GZ8MTXP02FSU25.13.73.G07.1.454.CMB.2.raw
  modified_base (356)..(356): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagacttcagcgcagtgggtcnggcactgatttcacactgaaaatcagcagggtggagctgaggatgtattgggctctattatgcatgcaagcaacacactgcgtacactttggccgaggggaccaagcctaggagataacaatcgaactgtcgctgacc

SEQ ID NO: 420403 - DNA, 590 bp, Homo sapiens
  misc_feature: GZ8MTXP02JY1GJ.13.73.G07.1.454.CMB.2.raw
  modified_base (268)..(268): a, c, t, g, unknown or other
  modified_base (304)..(304): a, c, t, g, unknown or other
  modified_base (350)..(350): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcgcagngccaggccaatctcaaggcgacctaattataaggtntctgacagggactccggggtccagacagactcagcgcagtgggtcnggcatgattcacactagaaatcagcgaggggtggaggcgtggaggtagttaggttagttggggtacttacgtttaagttagttgactagttacggactaaaggaccaaacacgaaccgttcgggtacccgttaacgttaccgttttacgggacccggtaacgggggaaccctaaggtccgtagggaacgaacgtaaccgtaaacgtaccggaaacgttgggtacggtacgtcggaacccg

SEQ ID NO: 420404 - DNA, 570 bp, Homo sapiens
  misc_feature: GZ8MTXP02I11V0.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcgcagaggccaggccaatcctccaaggcgacctaatttataaggtgtctgacagggactcccggggtccagacagacttcagcggcaggtggtcagggcactgatttcacactagaaaatcagcgagggtggaggcgtaggaggtagttgttagttggggtacttacgttatttaattgctagtagacaagacaacaacacgtacggaccgttacgtaacgttttcggaccgtacggggaacccgaaaggcgtaggacgtaagtaactaaacgtaccggtaaacgtcggtaggcgttacggtaacccg

SEQ ID NO: 420405 - DNA, 521 bp, Homo sapiens
  misc_feature: GZ8MTXP02HYDFK.13.73.G07.1.454.CMB.2.raw
  modified_base (308)..(308): a, c, t, g, unknown or other
  modified_base (354)..(354): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagcccggcctccatctcctgcagttctagtcaaagcctcgtacatcatgatggcacacctacttgaattggttcgcagaggccaggccaatctccaaggcgtcctaaatttataaggtntctgacagggactccggggtccagacagattcagcgcagtgggtcngggcacgtgatttcacactagaaaatcaagcgagggtggagcgtaggaggtagtgttagtgggcttatattagttgactatgacaagacaaacacacgtacgaccgtactacgtttcggaccgaggggaccaagcgtagagatcgaatacgaactgtcggactcgac

SEQ ID NO: 420406 - DNA, 720 bp, Homo sapiens
  misc_feature: GZ8MTXP02HMSJ6.13.73.G07.1.454.CMB.2.raw
  modified_base (229)..(229): a, c, t, g, unknown or other
  modified_base (409)..(409): a, c, t, g, unknown or other
  modified_base (425)..(425): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagccctanatcatagagtaggtcgaccactaccttataacgttaggtttcgggtacgacgaggccgacggaccgaactactcctaacggacggtcctaactttaattaaggtaggtcgtcgtagacggacggtccggtcccggacagacgagtcctacgcggtcgagtgggtcgagcggctagagttntaccactacgaaatanacgcgagggtgggtacggagaggtaggtaaagtggtttaagttagggtcggttacctttaagttttagtttagggtttacccaatttaccgggtaaacgaaacgaacccgtaaactaaccggtaccggttaccggggttacccggttaaaacccgtttacggttttaacccgggggtacccgggaccgggggtaaaacccggtaaacggttacgggtacgggtaacggtaaactaaccggtaaacgttaaccggtaaccgggttacggtacgggtcccgtacggtaccgaacccg

SEQ ID NO: 420407 - DNA, 537 bp, Homo sapiens
  misc_feature: GZ8MTXP02HEJW8.13.73.G07.1.454.CMB.2.raw
  modified_base (349)..(349): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctactgaattggttcgcagaggccaggccaatctcaagcgcctaattataaggtgtctgacagggactccggggtccagacagacttcagcggcaggtggcnggcactgatttcacactagaaaatcagcgagggtggaggcgtgaggagtgttagttgggtcttcgttattatttgactatgacaagacaaacacacgtggaccgttacgtaccttttcggaccgaacgggaaccgaacggacgtacgggaagtataacgaaagtacgaacgtggtcgacgtagacccg

SEQ ID NO: 420408 - DNA, 578 bp, Homo sapiens
  misc_feature: GZ8MTXP02GZ30C.13.73.G07.1.454.CMB.2.raw
  modified_base (360)..(360): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcgcagaggccaggccaatctccaaggcgacctaatttataaggtgtctgacgagggacctcccggggtccaggacagacttcgagcggcaggtggtcnggcactgtatttcacactagaaaatcagcgagggtggaggctggaggtattggttagtgggtacttcgttatttagttgactagttaggactaacggacaaacacgtaaccgtcgggtaccgttaaccgttaaccgttttcgggaccgtaacgggggacccaaaggtccgtacggaagtacgtaactaacgtacggtaacgtggtcgacgtcggaccc

SEQ ID NO: 420409 - DNA, 589 bp, Homo sapiens
  misc_feature: GZ8MTXP02IZZXC.13.73.G07.1.454.CMB.2.raw
  modified_base (277)..(277): a, c, t, g, unknown or other
  modified_base (294)..(294): a, c, t, g, unknown or other
  modified_base (350)..(350): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatggcacacctacttgaattggttcgcagagcaggcatcncaagcactattatagtntctgacgagggactccggggtccaggacagtattcgagtcggcgaggtcgggtacncggggcactgtactttacacactagaaaatcgagacgaggggtggaagtcgtaggaaggtagttgttagttgggtcttacgttagtttatttgactagttcgacgaaacgacaaacgacgtaccgtacggtaccgttaaccttaaccggttttcggaccggttacgggggaaaccaacggtccgtaagggacgtaacttaaccgaaagtacgtaacgtcggttacggcgttacggaccc

SEQ ID NO: 420410 - DNA, 549 bp, Homo sapiens
  misc_feature: GZ8MTXP02HK903.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcgcagaggccaggccaatctccaaggcgcctaatttataaggtgtctgacgagggaccgtccgggtaccagacagtactcgagcgacgtaggtgggtacagggctacgtgtacttcaacactagaaaactcgagcgaggggtggagcgtaggagtagttgttagtgggtcttgttattagttgactagtgacaagacaacgacacgtcggaccgtactacgtttcggacgtaacggggaccaagcgtaggacgataacgaagtaccgtaacgtggtcggctacgacc

SEQ ID NO: 420411 - DNA, 555 bp, Homo sapiens
  misc_feature: GZ8MTXP02HYH7F.13.73.G07.1.454.CMB.2.raw
  modified_base (300)..(300): a, c, t, g, unknown or other
  modified_base (338)..(338): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttcagtcaaagcctcgtacatcatgatggcacactactgattggttcgcagacgcaggccaatctacaaggcacttaaattataaggtntctgacagggactccggggccagcagacttcgagcggnaggttgggcaggccagtgtatttcacactagaaatcagcgagggtggacgtgtggagtatgttagtgggattcgttatttattgactagtgacaagacaacacgaacgtcggaccgttaactacgtttacggccggtaaacggggacccaaaaggtccgttacggggaaagtacgttaaccaagtacccggtaaacgtggtcggtacttcggaaccc

SEQ ID NO: 420412 - DNA, 544 bp, Homo sapiens
  misc_feature: GZ8MTXP02I6PW5.13.73.G07.1.454.CMB.2.raw
  modified_base (261)..(261): a, c, t, g, unknown or other
  modified_base (298)..(298): a, c, t, g, unknown or other
  modified_base (354)..(354): a, c, t, g, unknown or other
  modified_base (401)..(401): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagagggatgctgtaatgactcagtctccactctccctgcccgtcacccttggacagccggcctccatctcctgcagttctagtcaaagcctcgtacatcatgatggcacacctactgattggttcgnagagcaggccaatctcaaggcacctaattataaggtntctgacgagggaccgtcccggggtaccagacagacttcgagcggacaggtcggtcnggccatgtattacacactagaaaatcgagacgcgggggtagagtcgnaggtagtagttagttaggtcgtctattattagcatgacgaacgacaacacacgtacgtcgtacctacgtttacggtaccgacgggaccgaacgacgtcggacgagtaacgtaacgtacgtaacgtacgtcggtacgtacgtcg

SEQ ID NO: 420413 - DNA, 564 bp, Homo sapiens
  misc_feature: GZ8MTXP02HR5W9.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcgcagagccaggccaatcctcgaaggccgaccttaaattagtaaggtgtctgacagggactccggggtccagacagactcagcggcaggtggtcaggctaactgtatttaccacactagaaaatcaagcgaagggtggaggctagaggtattagttagtgggaccttgttaatttattgatagtagacaaagacaaacgactaacgtcggaccgtacttacgtttcgggccgaacggggaaccctaaggccgtacgggaaagactaacgtaacgtaccgtaacgtggtacggcgtacgaccg

SEQ ID NO: 420414 - DNA, 566 bp, Homo sapiens
  misc_feature: GZ8MTXP02F60CS.13.73.G07.1.454.CMB.2.raw
  modified_base (282)..(282): a, c, t, g, unknown or other
  modified_base (297)..(297): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagcccggcctccatcctcctgcagttctagtcaaagcctcgtacatcatgatgggcacacctacttgaattggttcgcagagccagccaatcncaagcgctaatttanaaggtgtctgacgagggaccgtcccggggtacccagacagtacttcgagcgcaggtggtacagggcacgtgtactttcaactactagaaaatcagcgaggtggagcgtgagtagtgttagtgggtcttagttattagttgactagtgacaagacaaacacgacgtcgaccgttaactacgtttacggaccggaacggggaacccaaaggtacgttacgggagaactaacgaaacgtacggtaaaccgtggttacggacgttacgaaccg

SEQ ID NO: 420415 - DNA, 615 bp, Homo sapiens
  misc_feature: GZ8MTXP02H5M29.13.73.G07.1.454.CMB.2.raw
  modified_base (297)..(297): a, c, t, g, unknown or other
  modified_base (353)..(353): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctcgcccgtcacccttggacagccggcctccatctcctgcagttctagtcaaagcctacgtacatcatgatggcacactactgaattggttcgcagagcagcatctcaagctactaattataaggtntctgacgagggacgtcccgggtacccagacaggtactcgagcggacgaggtggtcngggcagtgtactttcgaactacgtaagaaactcgaggcgtaggggtaggagggtagttaggagtagtaggtttagtgggtactagttatttagtttgactagtacggacaaacggtactaacgaacgtaccgtacgggtacccgttaaccgttaacgtttttccgggacccggtaacgggggtaacccgaaacggtccgtaagggacgtaacgtaaccgaaaggttaaccgtaacgttcggtacggttactaccggaacccg

SEQ ID NO: 420416 - DNA, 509 bp, Homo sapiens
  misc_feature: GZ8MTXP02HE2HI.13.73.G07.1.454.CMB.2.raw
  modified_base (394)..(394): a, c, t, g, unknown or other
  modified_base (396)..(396): a, c, t, g, unknown or other
  modified_base (411)..(411): a, c, t, g, unknown or other
  modified_base (413)..(413): a, c, t, g, unknown or other
  modified_base (419)..(420): a, c, t, g, unknown or other
  modified_base (422)..(422): a, c, t, g, unknown or other
  modified_base (424)..(424): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctactgaattggttcgcagaggccaggccaatctccaaggcgcctaaatttataaggtgtctgacagggactccggggtcccagacagacttcagcggcagtgggtcagggcaactgatttcacactgaaaatcagcagggtgaggngngagagtagtagtgtntntatatnnananacagacaacacacacgtacgtactacgttacgtacgacggacgacgacgtacgagagtaacgaactacgtacgtagtcgcgacgc

SEQ ID NO: 420417 - DNA, 600 bp, Homo sapiens
  misc_feature: GZ8MTXP02H0CC4.13.73.G07.1.454.CMB.2.raw
  modified_base (265)..(265): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaatggtttcgnagaggccaggccaatctcagcgcctaattataaggtgtctgacagggactccggggtcccagacagacttcgagcggcagtgggtcagggcactgtatttccacacttagaaaatcaagcgagggtggaggctaggaggattgttagttgggcttctatttagttgactagttgacgaaacgaccaaacgaccgaacgttcgggacccgttaaaccgttacgtttttacggggaccccgaaagggggtacccaaaacgggtcccgtagggggtaaccagttaacccgaaagttaccggtaaaaccgttggttaccggtaccgtttacggaacccc

SEQ ID NO: 420418 - DNA, 591 bp, Homo sapiens
  misc_feature: GZ8MTXP02IZDSA.13.73.G07.1.454.CMB.2.raw
  modified_base (277)..(277): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctacgtacatcatgatggcacactattgaattggttcgcagagccagcaatcncaagcactaattagtaagtgtctagacgagggtacctccggggtccagacagtactcgagcgacgtaggtgggtcagggcacgtgtactttacaactactaagaaaatcgagacgaggggtaggaggcgtaggaaggtagttaggttagttggggtaccttagtttaatttagtttggactagtaggaaccaaagtacaaactacgtacggtacggtaccgttaacgttacgtttcggaccggtacggggaaccgaaaggtccgtaggtacgaactaaccgaaagtacgtaacgtggtcggacgttacgaaccc

SEQ ID NO: 420419 - DNA, 554 bp, Homo sapiens
  misc_feature: GZ8MTXP02HJWSH.13.73.G07.1.454.CMB.2.raw
  modified_base (468)..(468): a, c, t, g, unknown or other
  modified_base (532)..(532): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatcctcctgctagttctagtcaaatcctcgtacatcatgagtggcacacctactgaattggttcgcagacgcaggccaatcacaaggctactaattataaggtgtctggacgaggggtaccgtcccggggtaccaagacgagacttcgaggcggcgtaggtcgggacagggctactgtactttacacaactagaaaatcgaagcgaggggtaggacggtgtaggaggtagtagttagtgggtacttgttaatttagttgatagtaganaacgacaaacacgagtcggaccgtaacttacgtttcggaccgagggacctaagcgtaggagtanaacgatacgatgcgctacgacc

SEQ ID NO: 420420 - DNA, 547 bp, Homo sapiens
  misc_feature: GZ8MTXP02IX8LD.13.73.G07.1.454.CMB.2.raw
  modified_base (280)..(280): a, c, t, g, unknown or other
  modified_base (345)..(345): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactcctccctgcccgtcacccttggacagccggcctccatctcctgcagttctagtcaaagcctcgtacatcatgatggcacacctactgaattggttcgcagagccaggccaatcncaagcgactaattataaggtgtctgacagggactccggggccagacagactcgagcgcagtggcnggcactgatttcacactagaaaatcgaagcgaggggtacggaggcgtaggaaggtattggttagtgggtacttcgttaattatttgactatgacaagacaacacactacggtaccgtacgtacgtttcggaccgtaacggggaaccgaagaccgtaggaagtacgtaacgtaacgtacgaacgtgtacggtctacggtaccg

SEQ ID NO: 420421 - DNA, 618 bp, Homo sapiens
  misc_feature: GZ8MTXP02G2CJN.13.73.G07.1.454.CMB.2.raw
  modified_base (265)..(265): a, c, t, g, unknown or other
  modified_base (311)..(311): a, c, t, g, unknown or other
  modified_base (352)..(352): a, c, t, g, unknown or other
  modified_base (364)..(364): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcgnagaggccaggccaatctaccaaggcgtacctaaatttagtaaggtntctgacgagggacctccggggtccagacagactcgagcggnaggtggtcgggnacgtgatttcacactagaaaactcagacgagggtaggaggctaggaggtagtaggtttagttaggggtacttacttagtttaattggtactagttacgggactaaaacggaccaaaaccaaccgtaacgtaccgggtaccccctttaacgtaccgtttttacgggacccggaaacgggggaacccaaaggccgtacgggaagaacttacgaaaacgtacggaaaaccgttggtcgggtacttcggaccaacccg

SEQ ID NO: 420422 - DNA, 563 bp, Homo sapiens
  misc_feature: GZ8MTXP02ID8QJ.13.73.G07.1.454.CMB.2.raw
  modified_base (234)..(234): a, c, t, g, unknown or other
  modified_base (277)..(277): a, c, t, g, unknown or other
  modified_base (299)..(299): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctcgcccgtcacccttggacagcccggcctccatctcctgcagttctagtcaaagcctcgtacntcatgatgggcacactacttgaatggttcgcagagccagcaanctcaagcgctaattataaggtntctgacagggctccggggtcccagacagacttcagcggcagtgggtcagggcactgatttcacaactagaaaatcagcgaggggtaggaggcgtaggaggagttggtttagttggggtacttcgttaatttaagtttggctaagttggaccaaaaggcaaacaactacgtaggacccgttaactacgttttcgggaccgtaacggggacccaaaggtctacgggagaataacgaaacttcgaaacgtggtcgggactcggaacc

SEQ ID NO: 420423 - DNA, 551 bp, Homo sapiens
  misc_feature: GZ8MTXP02GACA2.13.73.G07.1.454.CMB.2.raw
  modified_base (268)..(268): a, c, t, g, unknown or other
  modified_base (416)..(416): a, c, t, g, unknown or other
  modified_base (424)..(424): a, c, t, g, unknown or other
tcagtcacgtactacacgaccggtgctcgatttagctctacgctcgaggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcgcagngccaggccaatctcaagcgctaattataagtgtctgacgagggacgtcccggggtccagacagacttcgagcggcaggtcggtcagggcactgtatttcaactactagaaaatcagcagggtggagctggagatgttagtggtcgttntattattnctatgacaagacaaacacacgtcgtaccgtactacgttttcggaccgtaaacggggaacccgaaacggtccgacggtaaggaacgtaactaaacgtaccgaaacgtggtacggtacgcggtaacccc

SEQ ID NO: 420424 - DNA, 678 bp, Homo sapiens
  misc_feature: GZ8MTXP02JVN94.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtcccaggatttagagggatgctgtaatgactcagtcctccactcctccctcgcccgtcacccttggacacgccggcctccatcctcctgctagttctagtacaaacgtccctacgtacatcatgagtcgggaccactaccttacgttgtaagttggttacggcaaggacggaccgaggaccctaatccctaccgaacggccgtacctttaaagtttaagtaaggtgtacgtacggacggtacgggtaccgtcccggggtaccagacgtagtacttcgaggcggacgtagggtcggtacgagggtcctaacgttgtactttaccaaccgtaaacgtaacgaaaactcgaaggtacggtaaggggtacggacgtagtaggtaaggttagtttaggttacgttcgggtactttagttaagtttagtcgactagtacgaacgaacgaccaaaccgtcgtacgtacggtacctacgttaccggttacgggacgtaacgggtaccaggtcgtaaggactacgaaccgtaacgtaccgtagtcggtacgtaccgtactaccg

SEQ ID NO: 420425 - DNA, 587 bp, Homo sapiens
  misc_feature: GZ8MTXP02GMRUE.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcggcagaggccaggccaatcctccaaggcgacctaatttataaggtgtctgacgagggactccggggtccagacagacttcagcggcagtgggtcagggcaactgatttcacactagaaaatcagcgaggggtggaaggcgtggaggtattggttagttggggtacttacgttaagtttatttggactagttaggacaaagacaaacacgacgttcgggaccgttaacgtaccgttttaggaccggtacgggggaacccaaggtccgtacgggaagaacgttaacgaaacgttacgaaaccgttggtacggccgttacggaaccc

SEQ ID NO: 420426 - DNA, 556 bp, Homo sapiens
  misc_feature: GZ8MTXP02GF586.13.73.G07.1.454.CMB.2.raw
  modified_base (262)..(262): a, c, t, g, unknown or other
  modified_base (265)..(265): a, c, t, g, unknown or other
  modified_base (272)..(272): a, c, t, g, unknown or other
  modified_base (286)..(286): a, c, t, g, unknown or other
  modified_base (290)..(290): a, c, t, g, unknown or other
  modified_base (292)..(292): a, c, t, g, unknown or other
  modified_base (335)..(335): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctcgcccgtcacccttggacagccggcctccatctcctgctagttctagtcaaagcctcgtacatcatgatggcacactactgattggtcgnagngcagcancacagcactattanagtntngacgaggcgtccgggccagacagactcgagcggcaggtggtcnggcacgtgtactttcgaactacgtaagaaaactcgaagtacgtagggggtaggaacggtgtagggaaggtaagttggttaagttggggtacctttagtttaatttagttacgactagtagacaaagactaacacgacgtacgacgttactacggtttacggaccgtaacggggaaccaggcgtaggagagtaaccgaagtacgaacgtgtacgacgtcgac

SEQ ID NO: 420427 - DNA, 553 bp, Homo sapiens
  misc_feature: GZ8MTXP02FSZGM.13.73.G07.1.454.CMB.2.raw
  modified_base (413)..(413): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcgcagaggccaggccaatctccaaggcgcctaatttataaggtgtctgacgagggacctccggggtcccagacagacttcgagcgacaggtgggtcagggcactgatttcacactagaaaatcagcgagggtgagctgagatgttatgggnttcgtattatgctagtgacaagacaacacaacgtggacccgttaacgtacgttttcgggaccgtaacgggggaacccaaaggtccgtacgggaagtaactaacgtaaacgtacggaaactggtacggcgttacgaacccg

SEQ ID NO: 420428 - DNA, 672 bp, Homo sapiens
  misc_feature: GZ8MTXP02HAJBS.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacactacttgaattggttcgcagaggccaggccaatcctccaaggcgtacctaaatttagtaaggtgtctgacgagggaccgtccggggtacccagacagtactcgagcggacgaggtggggtcacgggcacgtgactttaccgaactacgtagaaaactgaaggtcgaagggggtggaggcgtagaagggtagttaggttagttggggacttacgttaatttagtttggacctagttaggaacaaacggtaaccgaaaaccctaacgtaaccgtaccgggtaacccgttaaccgtttaccggtttttaccggggacccgggttaaaccgggggaaacccgaaaacgggtacccgttaacgggaacgtaaaggtaacctaaacggttaccggtaaaaccgttgggtaccggttacgtacggtaaacccg

SEQ ID NO: 420429 - DNA, 571 bp, Homo sapiens
  misc_feature: GZ8MTXP02IRTON.13.73.G07.1.454.CMB.2.raw
  modified_base (283)..(283): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcggcagaggccaggccaatcnccaaggcgcctaatttataaggtgtctgacgagggacctccggggtcccagacagacttcagcgcgagtcggggtcagggcacgtgatttcgacactagaaaatcaagcgaggggtggaaggctaggaggtaatggttagttggggcttacgttatttagtttgactagtgacaagacaacgacacgtgtaccgtactacgtttcggaccgtaacggggaacccaaaggtccgtacggaagtacgtaacgtaaacgtacggtaaacgtaggtcggcgttacgaacccg

SEQ ID NO: 420430 - DNA, 603 bp, Homo sapiens
  misc_feature: GZ8MTXP02H0Z0I.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatggcacacctacttgaattggtttcgcagacggcaggccaatctccaaggcgcctaaatttataaggtgtctagacagggacctcccggggtcccagacagacttcgagcggacaggtggtcagggcaactgatttcacactagaaaatcgagcgaggggtggacggagtgaggtaatggttagttggggcttattatttagtttgatagtagacaacggacaaacacgtaaacgtcggaccgtttaaacccgtcgtttttacgggacccggtaacgggggtaaaccgaacggtaccgttacgggaacggttaaacgtaaccgtaaacgtaaccggtacggttacggtacggtacgtacgtaccg

SEQ ID NO: 420431 - DNA, 604 bp, Homo sapiens
  misc_feature: GZ8MTXP02JHB06.13.73.G07.1.454.CMB.2.raw
  modified_base (315)..(315): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactcctccctcgcccgtcacccttggacagcccggcctccatcctcctgctagttctagtcaaagcctcgtacatcatgagtgggcacacctatgaattggttcgcagaggccaggccaatcctacgaaggcgtaccttaatttataaggtntctagacgagggaccgtcccggggtaccagacagtactcgaggcgacgaggtcgggcaggctacgtgtactttcaactactagaaaactcgagacgaggggtggacggtgtaggaggtagttaggttagttgggtaccttattaagtttagttagacgtagttacggaactaaacgacaaactacgaccgtacggtacccttaacgttacgtttaccgggaccggtaacggggaccaaggtcgtacgggatacgtaacgaagtaccgaagtcggtacgccgtagacccg

SEQ ID NO: 420432 - DNA, 554 bp, Homo sapiens
  misc_feature: GZ8MTXP02GJUDD.13.73.G07.1.454.CMB.2.raw
  modified_base (345)..(345): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgctagttctagtcaaagcctcgtacatcatgatggcacactacttgattgttcgcagagccaggcaatctacaagcgacctaattataaggtgtctgacgaggactccgggccagacagactcgagcgcgagtggtcngggcactgattcacactagaaaatcagcgaagggtggaggtcgaggaggtagttaggttacgttgggtacttacgttatttatttagctagtgaccaagaccaaacaccacgtcggacccgttaactaccgttttacggaccgtaacgggggaaccaaacggtccgtaggaagtataacgaaacgtacgaactggtacggcgtagaccc

SEQ ID NO: 420433 - DNA, 577 bp, Homo sapiens
  misc_feature: GZ8MTXP02J2CLY.13.73.G07.1.454.CMB.2.raw
  modified_base (264)..(264): a, c, t, g, unknown or other
  modified_base (309)..(309): a, c, t, g, unknown or other
  modified_base (439)..(439): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactcctccctgcccgtcacccttggacagccggcctccatctcctgcagttctagtcaaagcctcgtacatcatgatggacacactacttgattggttcgnagacgccaggccaatctaccaaggcctaccttaatttataaggtntcgtgacgacgggacgtccggggtaccaggacagactccgagcggcaggtgggtcagggcacgtgacttcaactacgtagaaaactcgagcgaggggtggagcgtggaggtatggttacgtgggtacttntattagttgactagtgaccaagacaaaccgtacgaccgtacggtacccgttaacttaccggtttacgggacccgtacgggggaaccaagggtcgtaggacgtataacgaaacgttccggaacgttggcgacgtcgacc

SEQ ID NO: 420434 - DNA, 544 bp, Homo sapiens
  misc_feature: GZ8MTXP02H5AHU.13.73.G07.1.454.CMB.2.raw
  modified_base (300)..(300): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatggcacacctacttgattggttcgcagagccaggccaatctcaagcgactaattataaggtntctgacgagggactccggggtacccagacagacttcgagcggctaggtgggtacagggctactgtattcacactagaaaactcagcgagggtggagctggaggtatgttagtggtctacttattattgacagtgacaagacaacgacacgtcgaccgttactacgtttcggaccgtaaggggacccaaaggtcgtaggagtacgtaacgaacgtacggaaacgtggtacggtactacggaaccc

SEQ ID NO: 420435 - DNA, 556 bp, Homo sapiens
  misc_feature: GZ8MTXP02HWFCX.13.73.G07.1.454.CMB.2.raw
  modified_base (354)..(354): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcgcagaggccaggccaatctccaaggcgcctaatttataaggtgtctgacagggactccggggtccagacagattcgagcgcaggtgggtcngggcacgtgactttcgacactagaaatcgagcgagggtggaggctggaggtagtgttagtgggtcttcgtatttattgctagtgacgaagacgaaacacacgtacggacccgttacgtacgttttacgggaccgtacggggaacccaaaggccgtaggacgtataacgtaaactcggtaaactggtcggtacgtcgtacccg

SEQ ID NO: 420436 - DNA, 610 bp, Homo sapiens
  misc_feature: GZ8MTXP02IGF3I.13.73.G07.1.454.CMB.2.raw
  modified_base (231)..(231): a, c, t, g, unknown or other
  modified_base (265)..(265): a, c, t, g, unknown or other
  modified_base (307)..(307): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagagggatgctgtaatgactcagtctccactctccctgcccgtcacccttggacagccggcctccatctcctgcagttctagtcaaagcctcgtacntcatgatgggcacacctacttgaattggttcggnagaggccaggccaatcctccaaggcgacctaattataaggtntctgacagggactccggggtacccagacagacttcagcggcaggtgggtcaggggcctacgtgtatttccaagtactagaaaatcagcgaggggtaggaggctaggagtagtggttagttggggtccttagtttaatttagtttagacctagttacggaccaaaggaccaaacacgtaaccgtcgggtacccgttaccgttaacgttttcggggacccgtaacgggggaaaccccaaaggtccgttaggacggtaataacccgtaaaagtaccgaaaacttgggtcggtacctacggtaaccc

SEQ ID NO: 420437 - DNA, 689 bp, Homo sapiens
  misc_feature: GZ8MTXP02JU8Y9.13.73.G07.1.454.CMB.2.raw
  modified_base (265)..(265): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatggcacacctacttgaattggttcggnagaggccaggccaatcctaccgaaggcgtacctaatttataaggtgtactgacgagggtaccgtcccggggtaccagaccagacttcgacggtcggactaggtcgggtacacggggctacgtgtaactttcaacgtaacgtaagaaaaactccgaaggtcggaagggggttagggaacgggacgttagggaagggtaagttagggtttagttaggggtacttacgtttaagtttagttaggtaccgtagttacgaacgtaaacgaccgaaaaccgtacgtaaccggtaccgggtacccgttaaccgttaaccggtttttaccgggaaccggtaaaccgggggtaacccgaaaggtaccgtagggaaacgtacgtaaccgtaaacgtaccggtaaacgttgggtaccggtacgtacggtaacccg

SEQ ID NO: 420438 - DNA, 573 bp, Homo sapiens
  misc_feature: GZ8MTXP02FRHT2.13.73.G07.1.454.CMB.2.raw
  modified_base (313)..(313): a, c, t, g, unknown or other
  modified_base (416)..(416): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagcccggcctccatcctcctgcagttctagtcaaagcctcgtacatcatgatgggcacacctacttgaattggttcggcaggagccaggccaatctaccaaggcgaccttaatttagtaaggtntcgtgacgagggactcccggggtccagacagacttcgagcggctaggtcggtcagggcacgtagtactttcgaactactagaaaactcagcgaggtggagcgngagtatgtagtggtctcgtattatgctatgacgaagacaacgaacgacgtacgtaccgttaactaccgttttacgggaccgtaacgggggacctaaacggaccgtacggagtaactaacgtaaacgtacgtaaacgtggtacggtcgtacgtaaccg

SEQ ID NO: 420439 - DNA, 652 bp, Homo sapiens
  misc_feature: GZ8MTXP02JXGAY.13.73.G07.1.454.CMB.2.raw
  modified_base (386)..(386): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactcctccctgcccgtcacccttggacacgccggcctccatctcctgctagttctagtacaaagcctcgtacatcatgatgggcacacctacttgtaagttggttcggcaggacggccaggccaatcctaccgaaggctaccttaaatttagtaaggttgtcgtaggacgacggggtaccgtccggggtacccagacagtactcgaggcgacgaggtgggacncggcagtgtattcacactagaaatcgagcgagggtgagctaggagtagttgttagtcgggtacttagttaagttcgtagtactagttacgaaccgtaaacgaacctaaaccgtacgtaccggttacgggtaaccccgtttaacgtttaacccggttttacggggacccgggtaaacgggggaaccctaaacgggtaccgttaggaaacgtacgtaaccgtaaacgttacccggtaaggttcggtaacgggtcctacggaacccccg

SEQ ID NO: 420440 - DNA, 561 bp, Homo sapiens
  misc_feature: GZ8MTXP02G0G0W.13.73.G07.1.454.CMB.2.raw
  modified_base (356)..(356): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacactacttgaattggttcgcagaggccaggccaatctccaaggcgcctaattataaggtgtctgacagggactcccggggtccagacaggacttcgagcggcaggtgggtcnggcactgattcacactagaaatcagcgagggtggaggcgtggaggagtgttaagttcgggtacttacgttagtttaagttgtctagttacggacaaagacaaacaaccgtacgtacgggaccgttaacgtaccgttttcggaccgtaacggggaccaaacggcgtacggagtagtcgaatacgtaactaggtcggtctacggacc

SEQ ID NO: 420441 - DNA, 570 bp, Homo sapiens
  misc_feature: GZ8MTXP02F47E4.13.73.G07.1.454.CMB.2.raw
  modified_base (312)..(312): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccgcctccatctcctgcagttctagtcaaagcctcgtacatcatgatggcacacctattgaattggttcgcagaggccaggccaatctaccgaaggccgaccttaatttagtaaggtgtcngacgaggacgtccggggtaccagacagacttcgagcggacgaggtcgggtcagggcacgtgactttcacactagaaaactcgagcgagggtggaggctaggagtagtgttagtgggtacttacttagtttagttgactagtgacaagacaaacactaccgtacggtaccgtaacgtacgttttacgggaccgtacggggaaaccaacggcgtaggaacgtagtaacgaaacgtacgtaaacgtggtacgcgtacgacc

SEQ ID NO: 420442 - DNA, 540 bp, Homo sapiens
  misc_feature: GZ8MTXP02GDBIF.13.73.G07.1.454.CMB.2.raw
  modified_base (508)..(508): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatggggcacacctacttgaattggttcgcagaggccaggccaatctaccaaggcgacctaatttataaggtgtctgacagggaccgtccggggtccagacagacttcagcgcagtgggtcaggcactgatttcacactagaaaatcagcgagggtggagctgagagtgttagttggtctgtattagttgctatgacaagaccaaacaactaacgtcgggaccgttacgtacgttttcgggaccgtacgggggaacccaaggcgtacggaanagtaacgaacgtacgacgtgtacgtctacgac

SEQ ID NO: 420443 - DNA, 569 bp, Homo sapiens
  misc_feature: GZ8MTXP02IY1O6.13.73.G07.1.454.CMB.2.raw
  modified_base (436)..(436): a, c, t, g, unknown or other
  modified_base (526)..(526): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcgcagaggccaggccaatcctccaaggcgacctaatttataaggtgtctagacagggacctcccggggtccaggacagactcagcggcaggtcgggtcagggcactgtactttccactactagaaaactcaggcgaggggtggaggctaggaggtagtgttacgtgggtacttnttattatttgctagtgacaagcaaacacgacgttggaccgttactaacgtttcgggaccgtacgggggaaccaaaggtccgtacgggaanacgtaacgaacgtaccggtaaacgtggtacggacgtcgaaccg

SEQ ID NO: 420444 - DNA, 595 bp, Homo sapiens
  misc_feature: GZ8MTXP02IID4U.13.73.G07.1.454.CMB.2.raw
  modified_base (372)..(372): a, c, t, g, unknown or other
  modified_base (384)..(384): a, c, t, g, unknown or other
  modified_base (414)..(414): a, c, t, g, unknown or other
tcagtcacgtactacacgaccggtgctcgatttagctctacgctcagggggatcaggactcctcagttcaccttctcacaatgaggctcccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatggcacactacttgaattggttcggcagacggccaggccaatcctaccgaaggcgtaccttaatttaagtaaggttgtacgtgaacgacggggtaccgtcccggggtacccagaccagtacttccgagtcggnaggtcgggtacnggggcacgttgtactttaccaactacgtanaaaatcagcgaaggggtgaggcaggaggtagtagttagtggtcttgttaattcgttgatagtgacagactaacacgtattacggaccttactcgtttacgggccgtaaacgggggaccaaggtccgtaacgggagtacgaaccgtaagtaccggtaaacgttggtcggttactacgaaccc

SEQ ID NO: 420445 - DNA, 560 bp, Homo sapiens
  misc_feature: GZ8MTXP02H8P4A.13.73.G07.1.454.CMB.2.raw
  modified_base (355)..(355): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatggcacacctacttgaattggttcgcagaggccaggccaatctcaaggcacctaattataaggtgtctgacgagggactccggggtccagacagacttcgagtcggcaggtgggtcngggctactgtatttcgaacatagaaaatcagcgagggtggaggctaggaggtatagttagtgggtacttacgttaattagttgacagtgacaaagacaaacactacgtggtaccgtaactacgtttcggaaccgtaacggggaaccctaaaggcgtacggtaagaacgtaacgaaacgtacgtaaacgtggcggcttacgaaccg

SEQ ID NO: 420446 - DNA, 580 bp, Homo sapiens
  misc_feature: GZ8MTXP02FSQJD.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctattgaattggttcgcagagccagccaatctccaagcgactaatttataaggtgtctgacgaggaccgtccgggtaccagacagacttcgagcggtcaggtcgggtcagggccaactgtaactttcgaactactagaaaatcgagacgaaggggtggagcgtggaaggtattggttagtgggtacttacgttatttagttgctagtgacaagacaaacacgtacgtacggtacccgttacgtaacgtttcgggaccgaacgggggaaccaacggcgtacggaagtaacgtaacgtaacgtaccggtaaacgtcggtacgtaccgtaggaccc

SEQ ID NO: 420447 - DNA, 565 bp, Homo sapiens
  misc_feature: GZ8MTXP02GX0I4.13.73.G07.1.454.CMB.2.raw
  modified_base (307)..(307): a, c, t, g, unknown or other
  modified_base (358)..(358): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagcccggcctccatctcctgcagttctagtacaaagcctcgtacatcatgatgggcacactacttgattggttcgcagacggccaggccaatccacaaggctcttaatttataaggtntctgacgagggtacctccggggtaccagacagactcgagcggcaggtggcnggctatgactttcaactactaagaaaactcgaagcgaggggtggaagtcgtagggaagtagttgtttagtgggtacttacgttattagttgtactagtgacaagaccaaacgactacgttacggccgttaacgttcgtttacggacgtaacggggaccaaaggtccgaggactagtaacgaaacgtcggaactggtcgactcgaccc

SEQ ID NO: 420448 - DNA, 637 bp, Homo sapiens
  misc_feature: GZ8MTXP02GOL5D.13.73.G07.1.454.CMB.2.raw
  modified_base (304)..(304): a, c, t, g, unknown or other
  modified_base (312)..(312): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcgcagaggccaggccaatcctcaagcgactaattataaggtntctgacgngggacctccggggtcccagacagacttcgagcggcaggtcgggtacgagggcaacgtgtactttacaacgtactaaggaaaaactcgaaaggccgtaagggggtaggacgggtcgttagggaaggtagttaggtttagttggggtactttcgttaatttagttagtacctagtagaccgtaaagaccaaacgtacgtaaccgttcgggtacccgttaacgttaccgttttacgggacccgttaacgggggaacccaaaggtccgttacggacgaacgtaacgtaaacgtaccgtaaacggttcggtacgggtcttcggtaacccg

SEQ ID NO: 420449 - DNA, 561 bp, Homo sapiens
  misc_feature: GZ8MTXP02IAP23.13.73.G07.1.454.CMB.2.raw
  modified_base (178)..(178): a, c, t, g, unknown or other
  modified_base (260)..(260): a, c, t, g, unknown or other
  modified_base (263)..(263): a, c, t, g, unknown or other
  modified_base (286)..(286): a, c, t, g, unknown or other
  modified_base (290)..(290): a, c, t, g, unknown or other
  modified_base (292)..(292): a, c, t, g, unknown or other
  modified_base (325)..(325): a, c, t, g, unknown or other
  modified_base (362)..(362): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtccaggatttagaggggatgctgtaatgactcagtctccactctccctgcccgtnacccttggacagccggcctccatctcctgcagttctagtcaaagcctgtacatcatgatgggcacacctatgaatggttcgnagngcagcatcacgagctactaatanagtntnagacgaggcgtccggacagacagactcgagcgngaggtggacagctactgtacttcaacataagaaatanagacgaggaggaggagtaggagtagtagttagttaggtacgttagttaagtttagttagtagtagtacgtacgaaacgaacgaaacaacgtacgtacgtaccgtaacgttacgttacggtacggaacgggtaaccgaaacggtacgtacggtaagaacgtaacgtaacgtaacgtaacgtaggtacggtacgtacgacg

SEQ ID NO: 420450 - DNA, 579 bp, Homo sapiens
  misc_feature: GZ8MTXP02JP4Y2.13.73.G07.1.454.CMB.2.raw
  modified_base (304)..(304): a, c, t, g, unknown or other
  modified_base (361)..(361): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacacgcccggcctccatcctcctgctagttctagtacaaagcctcgtacatcatgagtggcacacctacttgtattggttcgcagacggccaggccatctcgaagcgactaatttanaaggtgtctgacgagggaccgtccgggtaccagacagactcgagcgcaggtcgggcngggctacgtgtacttcgactacgtagaaaatcgaaggtcgagggggtggacggtgtaggaggtagttggttagttgggtacttagttagttagttgtactagtacgacgaagaccaacgtacgtaccggtacgtaccgttacgtacgtttacgggaccgtaacggggacacggtcgtaggactactaacgacgtacgtaacgtggtcgacgtcgaccg

SEQ ID NO: 420451 - DNA, 568 bp, Homo sapiens
  misc_feature: GZ8MTXP02JW4Y8.13.73.G07.1.454.CMB.2.raw
  modified_base (308)..(308): a, c, t, g, unknown or other
  modified_base (469)..(469): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgacccgtcacccttggacagccggcctccatctcctgcagttctagtcaaagcctcgtacatcatgatgggcacacctacttgaattcggttcgcagaggccaggccaatctccaaggcgcctaatttataaggtntctagacgaggggacctccggggtccagacacgtacttcgagcggcaggtcggtcaggcacgtgatttcaactactagaaaactcgagcgagggtggaggctaggaggtagtggttacgttggggacttcgttaattagttgccagtgacaaagacaaacncaaccgtcggacccgttaactacgttttacgggacccgacggggtaaacccaaggccgtacggagaactcgaaagtacgaacgtgtacggactcggacc

SEQ ID NO: 420452 - DNA, 527 bp, Homo sapiens
  misc_feature: GZ8MTXP02H2CXY.13.73.G07.1.454.CMB.2.raw
  modified_base (300)..(300): a, c, t, g, unknown or other
  modified_base (338)..(338): a, c, t, g, unknown or other
  modified_base (348)..(348): a, c, t, g, unknown or other
  modified_base (428)..(428): a, c, t, g, unknown or other
  modified_base (434)..(434): a, c, t, g, unknown or other
  modified_base (437)..(437): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaaagcctcgtacatcatgatggcacacctactgaatggttcgcagaggcagcaatcacaaggcgctaaattagtaaagtntctgacgagggactcggggaccagacagactcgagcgnagttggggcnggctaactgtatttcaacaactagaaaactcaagcgagggtgggagcgtagaggtaatgttagttgcttagtattattgnaatganaanacaacacacgtacgacgtacgtacgttacggtaccggaacggaacgaacgacgagagaataacgaactacgacgagtggacgtacgaccg

SEQ ID NO: 420453 - DNA, 590 bp, Homo sapiens
  misc_feature: GZ8MTXP02IB05W.13.73.G07.1.454.CMB.2.raw
  modified_base (280)..(280): a, c, t, g, unknown or other
  modified_base (294)..(294): a, c, t, g, unknown or other
  modified_base (300)..(300): a, c, t, g, unknown or other
  modified_base (398)..(398): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctgtacatcatgatgggcacacctacttgaattggttcgcagagccaggccaatcncaagcgctaattanaaggtntctgacgagggacctcccggggtcccaagacagacttcaggcgcaggtggtcaggcatgtatttcgacactagaaaactcaagcgaggggtggacggngtaggaaggtattcggttagttggggacttgttaattgtttgactagttgacaaagacaaacactacgtacggtacccgttaactacgttttacgggccgtaacgggggtaacccaaagggtccgttaacggggaataacgtaaccgtaaaacgttacccggtaacgtagggttcgggacttcggaaccccg

SEQ ID NO: 420454 - DNA, 600 bp, Homo sapiens
  misc_feature: GZ8MTXP02F31B9.13.73.G07.1.454.CMB.2.raw
  modified_base (281)..(281): a, c, t, g, unknown or other
  modified_base (374)..(374): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactcctccctgcccgtcacccttggacagccggcctccatctcctgcagttctagtcaaagcctcgtacatcatgatgggcacacctattgaattggttcgcagagccaggccaatcncaagcgacctaattataaggtgtctgacagggaccgtccggggtaccagacagactcgagcgcgaggtgggtcagggcacgtgtacttcgaanactagaaaatcaagcgagggtaggaggcgtgaaggtagttggttagttcggggtacttcttaagtttaattcgataagttcggactaaaggacaaaccgaacgtacgtacggtacccgtaacttaccgttttacgggacccggtaacgggggaacccaaagggtccgtaagggggactaacgttaacgaaacgtacggaaaccgttggttacggacgttcaacccg

SEQ ID NO: 420455 - DNA, 571 bp, Homo sapiens
  misc_feature: GZ8MTXP02I112U.13.73.G07.1.454.CMB.2.raw
  modified_base (283)..(283): a, c, t, g, unknown or other
  modified_base (302)..(302): a, c, t, g, unknown or other
  modified_base (308)..(308): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagagggatgctgtaatgactcagtctccactctccctgcccgtcacccttggacagccggcctccatctcctgcagttctagtcaaagcctcgtacatcatgatggcacacctacttgaattggtttcggcagaggccaggccaatccnccaaggcgacctaatttanaaggtntctgacagggactcccggggtccagacagacttcagcgcaggtggcagggcactgtatttcgacactagaaaatcagcgaggggtgaggctaggaggtattggttagtgggtacttcttaagtttacgtgactagtacgacgaaagacaaacgacgacgtacggacccgttacgtaccgttttcgggacccgtaacgggggtaacccaaaggtccgtaggacgtataacgaacgtacgtaaccgtggttacggcttacgaccc

SEQ ID NO: 420456 - DNA, 560 bp, Homo sapiens
  misc_feature: GZ8MTXP02F8TUA.13.73.G07.1.454.CMB.2.raw
  modified_base (264)..(264): a, c, t, g, unknown or other
  modified_base (303)..(303): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctattgaattggttcgnagagccaggccaatctccaagcgacctaatttataggtntctgacgaggaccgtccggggtaccagacagacttcgagcggcaggtcgggtcagggcacgtgtactttcaactactagaaaatcagcgaggggtggaggcgtaggaggtattggttagttgggtcttacttagttacttgactagtgacgtaagcaacactacgtaggtccgtaacgttacgtttcgaccggtacggggaacaacggtcgtaggaagtactaacgtaacgtacgaacgtggtacgctacgtacccg

SEQ ID NO: 420457 - DNA, 707 bp, Homo sapiens
  misc_feature: GZ8MTXP02GS6TJ.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatggcacacctacttgaattggttcggcaggaggccaggccaatctaccaaaggcgtaccttaaatttacgtaaggttcgtctaggaaccgaggggtaccgtccccgggggtacccaaggaaccgaaggtaccgtttaccgaacggtccgggacctaagggttcggggttaccagggggtccctaaaccgttggtaaacttttccgaacctacgttaaaggaaaaacttccgaaaggcgaagggggtcgggaagggtacgttagggaaggtagttaggtttaagttcggggtactttacgtttaagtttaagttcggtactaagttaggaaccgaaagaccaaacaacgtaccgttacgggtacccgttaacgttaccgttttacgggaccggtaacggggtaacccgaaggtccgtacggagtaactaacgtaacgtaccgtaacgtcggttacggacgttacgacccg

SEQ ID NO: 420458 - DNA, 626 bp, Homo sapiens
  misc_feature: GZ8MTXP02H82JQ.13.73.G07.1.454.CMB.2.raw
  modified_base (315)..(315): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctcgcccgtcacccttggacagccggcctccatctcctgctagtttctagtacaaagcctacgtacatcatgagtggcacacctacttgaattggttcgcagaggccaggccaatcctacaaggcgtaccttaattagtaaggtntctgacgagggaccgtccggggtacccagacagtactacgacggcggacgaggttggggtcacggggcctaacgttggtactttaccgaacgacgttaaagaaaacgtcgaaggcggtaaggggtcgggaaggtcgtagggaggtagttaggtttaggttgggtacttagtttaagttttagtttggctaaggtgacgaaaggaccaaacgactacgtcggtacccgttacttacggttttcggaccggtacgggacccaaggtcgtagaggactaacgtaacgtacggaacgtcggacgtcgtcgaaccg

SEQ ID NO: 420459 - DNA, 580 bp, Homo sapiens
  misc_feature: GZ8MTXP02H2H72.13.73.G07.1.454.CMB.2.raw
  modified_base (306)..(306): a, c, t, g, unknown or other
  modified_base (349)..(349): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaatttggttcgcagaggccaggccaatctccaaggcgcctaattataaggtntctgacagggactccgggccagacagctcagcgcaggtggtcngggcatgtattcacatagaaatcagcgagggtcggaggcgtaggaggtagttaggtttagttggggtacttacgttaagtttatttgactagtagaccgaaagacaaacgaacctacgtacggacccgttaacctacgtttttacgggaccggtaacggggaaccgaaacggtccgtaggaacgattaacgaacgtaacgtaacgtacggtacggtcgttacggtaacccg

SEQ ID NO: 420460 - DNA, 654 bp, Homo sapiens
  misc_feature: GZ8MTXP02FVS7Q.13.73.G07.1.454.CMB.2.raw
  modified_base (446)..(446): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgctagttctagtcaaagcctcgtacatcatgatggcacaccttattgtaattggttcgcagacggccaggccaatcaccgaagccgtacttaaatttagtaaggtgtctagacgacgggtccgtcccgggtcccagtacagtacttcgacggcggactaggtgggtcgagggtacctacgttagtactttaccaactacgtaaagaaaactccggaagacggtaagggggtgacgggtntagggtaaggttagtttgggtttaggggtttatacgtggactagtcgactaagtcctaaccgtactaaccgtcgtacggaccggttacgttcccggaccggtacggggtaaaccgtaaagggtacgggaaacttacggaaaaccgtaaaacggaacgtttcgggaacggtacccgttacgacgtaacctcggttccttacggtttccc

SEQ ID NO: 420461 - DNA, 625 bp, Homo sapiens
  misc_feature: GZ8MTXP02J0S4R.13.73.G07.1.454.CMB.2.raw
  modified_base (268)..(268): a, c, t, g, unknown or other
  modified_base (271)..(271): a, c, t, g, unknown or other
  modified_base (303)..(303): a, c, t, g, unknown or other
  modified_base (309)..(309): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgccccgtcacccttggacagccggcctccatcctcctgcagttctagtacaaagtcctacgtacatcatgatggcacacctactgtattggttcgnagngccaggaccaatctacgagccgacttaattanaaggtntacgtagacgacggggtaccgtccggggtacccagacagactccgagcggcgtaggtgggaccagggccagttgtatttaccaataaccgtaaggaaaactcgaacggagaaggggttgggaagtcgtaggaaggtacgtttaggttacgttcggggacctttactttaagttaagttccgatagtaccggaaacgaacgaacaacgacgtaccgtacggtaccgttacgttacggttacgggaccggtaacgggactaacggtcgtacggaagtacaacgtaacgtaacgtacgtacgtacggtacgtacgtacg

SEQ ID NO: 420462 - DNA, 576 bp, Homo sapiens
  misc_feature: GZ8MTXP02JXZ8D.13.73.G07.1.454.CMB.2.raw
  modified_base (268)..(268): a, c, t, g, unknown or other
  modified_base (309)..(309): a, c, t, g, unknown or other
  modified_base (419)..(419): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgctagttctagtcaaagcctcgtacatcatgatggcacacctacttgaattggttcgcagnggccagccaatcctacgaggcgtaccttaattagtaaggtntctagacgacgggacgtccggggtccaagacagtaccttcgagcggacgaggtcggtcagggccacgttgtattcgaactactagaaatcgaagcgaggggtggaacggngtaggagtagttggttagttggtacttacgttattgtgagtagtacaacgaagacaacgacgtacgtcgtaccgttacgttacgttaccgggaccgacgggtaacgacgtacgtaggtaacagtaacgtaacgtacgtacggtggtcgacgtacgac

SEQ ID NO: 420463 - DNA, 770 bp, Homo sapiens
  misc_feature: GZ8MTXP02JOW4W.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactcctccctgcccgtcacccttggacagcccggcctccatcctcctgctagttctagtacaaacgcctacgtacatcatgagtgggccactacctacgttagtaagttcggtttcgcgaggacggacccgaggaccctaatcccgtaaccgaagggtcccgttaacctttaaagtttaagttaacggttgtaccgttaggaaaccgggtacggggtacccgtaccccgggggtacccaacggaaccgtaggtaccgtttaccgaacgggtcggaccgtaggggtggggtaccgacgggtctacggttagttacctttacgaaaccgtaaactaagtaaaaactccggaaggtacgggtagggggttggaacgggtgtaaggggtaaggttagtttagggtttacgttacggggttacctttaagtttaacggtttattacggtacgttaacggtacgaaccgtaaacggaaccgtaaaccaacgttaacggtacggtacgtaaacggtttaccgttacggtttaccggggaccggtaaaccggggaaccaggtacgtaaggacggtaataacgtaacggtaccgtaaggtcggtacgcgttaaccg

SEQ ID NO: 420464 - DNA, 592 bp, Homo sapiens
  misc_feature: GZ8MTXP02GU3EV.13.73.G07.1.454.CMB.2.raw
  modified_base (190)..(190): a, c, t, g, unknown or other
  modified_base (217)..(217): a, c, t, g, unknown or other
  modified_base (287)..(287): a, c, t, g, unknown or other
  modified_base (334)..(334): a, c, t, g, unknown or other
  modified_base (381)..(381): a, c, t, g, unknown or other
tcagtcacgtactacacgaccggtgctcgatttagctctacgctcagggggatcaggactcctcagttcaccttctcacaatgaggctccctgctcagctcctggggctgctaatgctctggctcccagataccagatgtgacatccagatgacccagtctccatccctccctgtctgcatctcttgganacagagtcaccgtcacgttggccgggngagtcaacgatattaacacttattagcctggtatcagcagaagccaggagagtcctaaattattgatctntgctgcgtccgccttgcaagtcggggtcccatctccggttcagtggnggtggatcgtagggacaagattcactctcaaccatccaacctacacncctaccctagaagtattaggttagggtaaagtttacttaatcgttacaacggtaacctaagttacgggttggccggcccgtcgtacgttacggttttcgggacggggtacgggtaacccgaaagggtgaccgaagttacgtaaacgaaaaccgtaaacgttggttaacggcggttacgaccgtactaactacccgtttcgtttaccttacg

SEQ ID NO: 420465 - DNA, 575 bp, Homo sapiens
  misc_feature: GZ8MTXP02JX9V1.13.73.G07.1.454.CMB.2.raw
  modified_base (366)..(366): a, c, t, g, unknown or other
  modified_base (387)..(387): a, c, t, g, unknown or other
  modified_base (416)..(416): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtacaaagcctcgtacatcatgatggacacacctacttgaattggttcgcagaggccaggccaatctacaaggcgtactaaatttataaggtgtactagacgacgggaccgtcccggggtaccagacagtactcgagcggcaggtgggcnggcactgtattcaactactanaaaactcgaagacggaggggtggaacggngtagggaagtagttagtttagttgggtcttagttaattagttagatagtagaacaacgacaaacacacgtacggaaccgtaacgtacgtttacggaccgaacgggacccaaaggcgtaagggaacaataacgaacgtaccgaacgtgtcggctcgaacc

SEQ ID NO: 420466 - DNA, 601 bp, Homo sapiens
  misc_feature: GZ8MTXP02FQS38.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagcccggcctccatctcctgcagttctagtcaaagcctcgtacatcatgatggcacacctacttgaattggttcgcagagccagccaatctcaagcgactaatttataaggtgtctgacgaggggaccgtcccggggtaccagacagacttcgagcggcaggtgggtacagggcacgtgtactttcaactaacgtagaaaactcgaaggacgagggggtggagggtcgtaggaaggtagttggttaagttggggtcttacgttatttaagttgactagtaggacaaagacaaacgtaacgacgtacggtaccgtaacgttaccgtttcgggacccgaaggggaacccaaggtaccgtaggggaataacgtaacgtaaaacgtacggtaaacgtggtacggcgtcgtaacccg

SEQ ID NO: 420467 - DNA, 528 bp, Homo sapiens
  misc_feature: GZ8MTXP02FFFZ4.13.73.G07.1.454.CMB.2.raw
  modified_base (446)..(446): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcggcagaggccaggccaatctccaaaggcgcctaaatttataaggtgtctgacaggggacgtcccggggtcccagacagacttcagcgcaggtggtcaggcactgatttcaacactagaaaatcagcgagggtggagctggagatgttattgggctcgtattattgcatgcaagacaacacacnggtcccgtactacgttttcgggaccgtaagggggacccaaagcgtaggaagataacgaacttacgaactgtacggctcgacc

SEQ ID NO: 420468 - DNA, 652 bp, Homo sapiens
  misc_feature: GZ8MTXP02F9C12.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgccccgtcacccttggacacgcccggcctccatcctcctgctagttctagtacaaagtcctacgtacatcatgagtcggacactaccttacttagagttggttcgcaggacggccagcactcaccaaggctaccttaatttagtaaggtcgtctgacgtacggaccgttcccggggtacccaagaccgagtacgttaccgaggcggacgtaggttcgggacagggacccagtagtaactttacaaacgtacgtaaagaaaacttgaaacggcggtaaagggggtggaaacgggtagtagggtaaggtaagtttcgtttaggtgggtacttagttaattagttcacgtatacgacaaagacaaacactacggtacggtacccgttacgttacgttacgggaccgaaccgggggtaaaccgaaaggtcgtaaggaacgtacttaacgaaacgttacggaaacgttggtacggactcgaaccg

SEQ ID NO: 420469 - DNA, 521 bp, Homo sapiens
  misc_feature: GZ8MTXP02GVXY4.13.73.G07.1.454.CMB.2.raw
  modified_base (307)..(307): a, c, t, g, unknown or other
  modified_base (430)..(430): a, c, t, g, unknown or other
  modified_base (496)..(496): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggattttagaggggatgctgtaatgactcagtctccactctccctgcccgtcacccttggacagccgcctccatctcctgcagttctagtcaaagcctcgtacatcatgatgggcacacctacttgaattggttcgcagaggccaggccaatctaccaagcgcctaaatttataaggtntctgacagggactccggggtccagacagattcgagcggcaggtggcaggcactgtattcaacactagaaaatcagcgagggtggaggcgtaggaggattgttagttgggcttagtattattgnagtgacagacaacacactgaccgtacgtacgtttacggaccgaacgggaccaagcgtaggagtaanaacgtacgtacgacgtgcgctacgc

SEQ ID NO: 420470 - DNA, 558 bp, Homo sapiens
  misc_feature: GZ8MTXP02GCFSH.13.73.G07.1.454.CMB.2.raw
  modified_base (365)..(365): a, c, t, g, unknown or other
  modified_base (396)..(396): a, c, t, g, unknown or other
  modified_base (438)..(438): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatggcacacctacttgaattggttcgcagaggccaggccaatctaccgaaggcgtacctaatttataaggtgtctgacaggggacgtcccggggtacccagacagacttcgagcggtcaggtgggtcngggcacgtgactttcgaacactagaaaactnagcgagggtgagctgagatgttagtggtacttgtattattgntatgacaagctaaacacgtacgtacgggtaccttacgtacgttttcgggaccgaacgggggaacccaaaggccgtacggagtactaacgaaagtcgtaaacgtggtacggcgtagaaccc

SEQ ID NO: 420471 - DNA, 721 bp, Homo sapiens
  misc_feature: GZ8MTXP02JY6MC.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactcctccctcgcccgtcacccgttggacacgcccggcctccactcctcctgctagttctagtacaaacgtcctacgtacatcatgagtggccacaccttacttagtaagttggttcgcaggacggccaggaccaatccaccgaaggcgtacctttaaagtttagtaaggtgtctgacgacgggtaccgtcccggggtacccaagacgacgtactacgacggcggacgtaggtcggggtacaggggcctaacgttaggtaccttttcaaccgttaacgtaaagtaaaaccgttcgaaaggtacgggggtaagggggttaggggaaggtacggtaggggtaaagggttaacgtttagggtttaaggttcggggttacctttagtttaagttttagtcggtacaaggttacggaaactaacggaacaaaccgtacgtaaccggttaccgggtaaccccgttacggttaccgtttacgggaaccggtacggggaaacccgaggtaccgtagggaactacgaaccgtaagtaccggtaagtgggttacgacgtacgtacccg

SEQ ID NO: 420472 - DNA, 624 bp, Homo sapiens
  misc_feature: GZ8MTXP02JZTGG.13.73.G07.1.454.CMB.2.raw
  modified_base (271)..(271): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagagggatgctgtaatgactcagtctccactcctccctgcccgtcacccttggacacgccggcctccatctcctgcagttctagtacaaagcctacgtacatcatgagtggcaactacctattgtattggttgcagngccagccatcctacgaagccgtactaattagtaaggtgtcagacgacggtctccgggaccgacgagacgactgagacggcgaggtagggtcgcggacgtactagtcgttactaacgaaacgtagaaagttaacaggacgggagggttagggagggacgtagaagggggtagtttagggtttagttacggggttaccgttagttttagttaaaggtttgtactagtagtacgaacgaacgaaactaccgaacgttcgtacgtacccgttacgtttacggaccggacgggtaacgacgtacgtacggtaacgaacgtaagaacgttacgtaccggtagtacggtaccgcgttacg

SEQ ID NO: 420473 - DNA, 696 bp, Homo sapiens
  misc_feature: GZ8MTXP02JBLSQ.13.73.G07.1.454.CMB.2.raw
  modified_base (374)..(374): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgctagttctagtcaaagcctcgtacatcatgatgggcacacctacttgtaattggttcgcagacggccaggccaatcctacgaaggctacctaatttagtaaggtgtctaggacgaggggtaccgtcccggggtaccagacgagacgttcagcgcgtaggtggtacngggcacgtgtactttaccgactaacgagtaaaactcgaggacgagggggttaggaagggtcgtagggtaaggttagttacggtttagttacggggttaccctttagtttaaagtttacgttttacgacgttaagtttacggaaaccgtaaagggtaaccaaaccgtaaccggtaccgttaccgggtaacccgtttaacccggttaacggtttttccgggaaaccgggtaaccgggggtaaacccaagggtaccgttaggggaactaacgtaaccgtaaaacgttacggtaaccgttagggtcggtaaccgttcggaaccccg

SEQ ID NO: 420474 - DNA, 569 bp, Homo sapiens
  misc_feature: GZ8MTXP02JV61K.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctggctcccagataccagatgtgacatccagatgacccagtcctccatccctccctgtctgcatctcttggagacagagtccaccgtcacgttggccgggcgagtccacgactattaacactttatttagcctggtatcagcagaagccagggagagtaccctaaattattgatctctgctgccgtccgcttgcaacgtccggggtcccagtctccggttcagtggcggtggtatctaggacagtacttcactctcaccatccacccaacctcgacctaccctagaacgagttggttaggagtttattacgtgtacagtacctagtaggtcggtacggcccgtcttcgtacggttttccgggacgggtacgggaaccgtaggtcgactacggactaacgaaaaccgtacgtggacggtaactcggacctacgactcttcggttctttaccc

SEQ ID NO: 420475 - DNA, 636 bp, Homo sapiens
  misc_feature: GZ8MTXP02GMH54.13.73.G07.1.454.CMB.2.raw
  modified_base (381)..(381): a, c, t, g, unknown or other
  modified_base (417)..(417): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactcctccctgcccgtcacccttggacagcccggcctccatctcctgcagttctagtcaaagcctcgtacatcatgatgggcacacctacttgaattggttcgcagacggccaggccaatcctaccgaaaggccgtaccttaaatttagtaaaggtgtacgtagaccgaggggtaccgtcccggggtcccaagacagtactcgagcggcaggtggtcnggcacgtgtattcacactagaaaatcgagcgagggnggaggcgtagaggtagttgttagttgggacttacgttaattagttgactagtacgacgtaaacgaccaaacgtaaccgtacgttaccggtacccgttaaccgtttaccgttttaccggggaacccggtaacgggggaaacccgaaacggtccgttaacggagtaaccgtaacgtaaacgtaaccggtaaacgtcggtaacggtccgtacggtaaccccg

SEQ ID NO: 420476 - DNA, 697 bp, Homo sapiens
  misc_feature: GZ8MTXP02JUF6Y.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtcccaggatttagagggatgctgtaatgactcagtctccactcctccctcgcccgtcacccttggacacgcccggcctccatcctcctgctagttctagtacaaacgtcctacgtacatcatgagtcgggccaactaccttattgtaagtttcggttacgcgaggacggccacggaccaatcctaccgaaggccgtaacctttaaagtttagtaaggtcgtcgtacgaccgacgggtaccgtccggggtaccagacgagtacgtcgagcgacgcggttagggcacgggctacgtacgtacttaccaacgtaaacgttaagaaaactccgaaggtacggtagggggttaggaggtacgtaggtaggttagttagggtttaccgttgggttacctttagtttaagttagttagacgtaggtaactaacgaaacgaaccaacccgtaacgtccggttaacccgggtacccgtttaacgtttaccgggtttacgggacccggtaaacggggtacccaacgggttacgtacgggaatacgttaacgaacgttaccgtacggtggtacgcgttacacccg

SEQ ID NO: 420477 - DNA, 560 bp, Homo sapiens
  misc_feature: GZ8MTXP02HG5Q0.13.73.G07.1.454.CMB.2.raw
  modified_base (418)..(418): a, c, t, g, unknown or other
  modified_base (457)..(457): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatcctcctgcagttctagtcaaagcctcgtacatcatgatggcacacctacttgaattggttcggcagaggccaggccaatcctccaaggccgaccttaatttagaaggtgtctgacgacggggactcccggggtccaggacagacttcagcggcaggtcggggtcaggggccaacgtgactttacacaacgttagaaaatcgagtcgagggtggagngtagaggtagtagttagttggtcgtacttattattagtntagtagacgacgacaacacacgtacgtacgtacgtacgttacggtacggacggacgacgacgtacgagacgtaactagtacgtacgtagtcggtcgtacgtcg

SEQ ID NO: 420478 - DNA, 601 bp, Homo sapiens
  misc_feature: GZ8MTXP02I36S6.13.73.G07.1.454.CMB.2.raw
  modified_base (307)..(307): a, c, t, g, unknown or other
  modified_base (313)..(313): a, c, t, g, unknown or other
  modified_base (589)..(589): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagcccggcctccatcctcctgctagttctagtacaaagtcctcgtacatcatgatcggcacacctattgaagttggttcgcagacggcaggccaatcctacgaaggctacctaattanaaggtntcagacgaggccgtcccgggtaccagacagactcgacgtcggactaggtggggacagggcaacgttgtaacttcgaacacttaagaaaatccgagtgaggggtgtaaggacgttggaaggtagttcggttaagttgggtacttagttaagtttagttggatagttacggaacaaacggacaacgtaaacgacgttacgggtaccccttaagtaccggtttacggaccggtaacggaacgtacgcggttaacgagactaacgtagtacgttaacggngtaccgcacgac

SEQ ID NO: 420479 - DNA, 745 bp, Homo sapiens
  misc_feature: GZ8MTXP02H66YD.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtccaggatttagaggggatgctgtaatgactcagtctccactctccctgcccgtcacccgttggacacgccggcctccatctcctgctagttctaagtcaaaacgcctacgtacatcagtgagtcgggacacctacctacttgtaagttggtttcgcgaacggacggaccgaggaccaatccgacgaaacggccgtacctaaatttaagtaaaggtgtacgttacgaacgacggggtaccgtccgggtacccaaaggaccaagtacccgttgaacggtccgacgtaagggttcggggacacgggtaccgtactaggttaccttttacgaaccgtaaaccttaaaggtaaaaacgtaacgaacggtacgggtaacggggtaacggggtagggtacggtaggtaagggttaaggttaggtttaggttacggttacgtttacgtttaagtttagtttacgtacgtacgtacgtaacgaaacgaaacgtaaacgtaacgtaaccggttaccgtaccgttaaccgttaaccggttaccgggtaccggtaacggtaaacggtaacggtacgtacggtaacgtaacgtaacgtaacgtaacgtacgtacggtacggtacgtacgtaccg

SEQ ID NO: 420480 - DNA, 601 bp, Homo sapiens
  misc_feature: GZ8MTXP02IK52L.13.73.G07.1.454.CMB.2.raw
  modified_base (265)..(265): a, c, t, g, unknown or other
  modified_base (292)..(292): a, c, t, g, unknown or other
  modified_base (298)..(298): a, c, t, g, unknown or other
  modified_base (302)..(302): a, c, t, g, unknown or other
  modified_base (326)..(326): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgctagttctagtacaaagcctcgtacatcatgatgggcacacctattgattggttcgnagacgcagcatcacgagctactattanaaggtntacngacgagggacctccgggccagacngactcgagcgcaggtggtcaggtcagttgtacttacactaacgtagaaaatcgagacgaggggtaggaggtcgtaggaaggtacgttaggttagttggggactttacgttaagttacgttagacctagtacgacgtaagacctaaacacggtaccgttaccgggtaccgttacgttacggttttacgggacccggtaacggggtaaacccgaagtacgtaacggaacgtaactaacgtaaacgtacggtaaactggtacgacccgttaggaaccc

SEQ ID NO: 420481 - DNA, 582 bp, Homo sapiens
  misc_feature: GZ8MTXP02FXA00.13.73.G07.1.454.CMB.2.raw
  modified_base (312)..(312): a, c, t, g, unknown or other
  modified_base (356)..(356): a, c, t, g, unknown or other
  modified_base (403)..(403): a, c, t, g, unknown or other
tcagtcacgtactacacgaccggtgctcgatttagctctacgctcagggggatcaggactcctcagttcaccttctcacaatgaggctccctgctcagctcctggggctactaatgctctgggtcccaggatttagagggatgctgtaatgactcagtctccactctccctgcccgtcacccttggacacgccggcctccatctcctgcagttctagtcaaagcctcgtacatcatgatggcacacctacttgtaagttggttcggcaggacggccaggccaatctaccaaggccgcttaatttataaggtntactgacgagggaccgtccggggtcccagacagattccgagcgngaggttggcaggcacgtgtattcacatagaaatcgagcgaggtgagngtagagtagtgttagtgggtcttagttattagttgagtagttacggacaacggaccaacaccgtacgtaccggtacccgtacgttaaccggtttcgggaccggtacgggggaacccaggtaccgtaggaaccgtagttacgaaacgttacgaacgttcggtaggactcggacctaaccg

SEQ ID NO: 420482 - DNA, 583 bp, Homo sapiens
  misc_feature: GZ8MTXP02GNDGL.13.73.G07.1.454.CMB.2.raw
  modified_base (343)..(343): a, c, t, g, unknown or other
  modified_base (355)..(355): a, c, t, g, unknown or other
  modified_base (401)..(401): a, c, t, g, unknown or other
  modified_base (416)..(416): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatcctcctgctagttctagtcaaagcctcgtacatcatgatcggcacaccttacttgaattggttcggctaggacggccgacgacactcctaccgaagcctactaattaagtaggtctgagacgagggccgtccgggacaganatcctgcgcggntgggtgcgcggctacgtagttatacacgtatagaaatcgtaacggngaggggtggcgtagnggtaagtagttaggttaggtcggttaacttagttaattgtacggtctagtccgaaataacgaccagtaacctggtacccggtacgttaaacccgttggttaccgggacggtaacggaacctaggtcgacgggaatctaacgagttacgagtcgtacggctacgaccc

SEQ ID NO: 420483 - DNA, 659 bp, Homo sapiens
  misc_feature: GZ8MTXP02HNPIH.13.73.G07.1.454.CMB.2.raw
  modified_base (369)..(369): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctcgcccgtcaccttggacagccgcctcatctcctgcagttctagtcaaagcctcgtacatcatgagtggacacacctacttgtaattggttcgcgagacggccaggccaatcctacgaaggcgtaccttaattacgaaggtgtctgacgacgggtaccgtcccgggtaccagacagtactcgagcgacgaggtggtcnggctacgtgtacgtttaccactaactaagaaaactcgaaggtcgtaaggggtggagtacgtaggaaggtaatttgggttagttcgggtactttacgttaagtttacgtttagcttaagtacggaacctaaaggaccaaaaccgtacgtacgttaccgggtacccgttaaaccgtttacggtttaccggggaacccggaaacgggggtaaaccctaaagggtccgtaaggggaacttaacgtaaacccgtaggttaaccgtaaacgttgggttaccgcgttacggaacccc

SEQ ID NO: 420484 - DNA, 601 bp, Homo sapiens
  misc_feature: GZ8MTXP02F8A99.13.73.G07.1.454.CMB.2.raw
  modified_base (266)..(266): a, c, t, g, unknown or other
  modified_base (293)..(293): a, c, t, g, unknown or other
  modified_base (298)..(298): a, c, t, g, unknown or other
  modified_base (301)..(301): a, c, t, g, unknown or other
  modified_base (306)..(306): a, c, t, g, unknown or other
  modified_base (351)..(351): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagcccggcctccatcctcctgctagttctagtcaaagcctcgtacatcatgatggcacacctattgaattggttcgnagcgccagccatcacagcactaattanaggtntcngacgngggaccgtccgggtaccagacagtactcgagcgacaggtcggacngggtccacgtgtactttaccaactacgtagaaaactcgaggtacgaagggggtggaggtacgtaggtaaggtagtttgtttacggttggggtactttacgttaatttagttggactagtacgacgaacgactaaaccacgtacgtacggtaccgtacgttaccggtttacgggaccggtaacggggaaccctaaggtcgtacggacgtaactaacgtaaacgtacgtaacgtggtacggctacggtaccc

SEQ ID NO: 420485 - DNA, 586 bp, Homo sapiens
  misc_feature: GZ8MTXP02JHEU4.13.73.G07.1.454.CMB.2.raw
  modified_base (263)..(263): a, c, t, g, unknown or other
  modified_base (364)..(364): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagcccggcctccatctcctgcagttctagtcaaagcctcgtacatcatgatggcacactacttgattggttcgnagagccaggccaatctaccaaggcgtacctaaatttagtaaggtgtctagacgagggtaccgtcccggggtcccagacagacttcgagcgcaggtgggtcngggcacgtgactttcaactactagaaatcgagcgaggggtcggaggctaggaggtagttaggttagtgggtacttacttaggttattgtactagttagacgaagaccaaaccactacgtacgtaccgtaccttaacggtttcggaccggtacgggggaacccaaggtcgtaggaacgtagtaaccgaacgttaaccggaagttcgtacggcgttacgaaccc

SEQ ID NO: 420486 - DNA, 618 bp, Homo sapiens
  misc_feature: GZ8MTXP02IQQSI.13.73.G07.1.454.CMB.2.raw
  modified_base (314)..(314): a, c, t, g, unknown or other
  modified_base (364)..(364): a, c, t, g, unknown or other
  modified_base (475)..(475): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagagggatgctgtaatgactcagtctccactctccctgcccgtcacccttggacagccggcctccatcctcctgctagttctagtcaaagcctcgtacatcatgatggcacacctactgaattggttcgcagacggccaggccaatcctaccaaggcaccttaatttagtaaggtgtcgngacgaggtaccgtcccggggtacccagaccagacttcgagtcggacgtanggggtcgcgcgactacgtgtacttacgactcgaaagtaactggacgacggtggggtagacggtcttaagggagttagttagtttaaggtcggtacctttaagtttgaaaantttagtacgtacgtacgtacgtaacgaacgtaacgtaaccgtaaccgtaacggttacggtaccgtacggttacgttacggtacggtaccggaacgtaacgtacgtaacggtacgtacgtacgtacgtaccgtacgtacgtacg

SEQ ID NO: 420487 - DNA, 618 bp, Homo sapiens
  misc_feature: GZ8MTXP02FN0Y9.13.73.G07.1.454.CMB.2.raw
  modified_base (264)..(264): a, c, t, g, unknown or other
  modified_base (378)..(378): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttgacagccggcctccatctcctgcagttctagtcaaagcctgtacatcatgatggcactacctacttgaattggttcggnagaggccaggccaatcctaccgaaggcgtaccttaaattttagtaaggtcgttcgtagaacgacggggtaccgtccggggtccccagacagattcgagcggacaggtcgggtcngggcactgtattcaactactagaaaatcgagcgaggggtggaggcgaggaagtagttggttaagttcggggtacttcgttaatttagttacggtactagtagacgaaacgaccgaaacacgtaccgtacgggtacccgttaacgtaccgttttcgggaccgtaacggggaaccgaacggtaccgtagggacgtagtaaccgtaaacgtaccggtaaactggttacggccgtacgtaaccg

SEQ ID NO: 420488 - DNA, 552 bp, Homo sapiens
  misc_feature: GZ8MTXP02F6EOW.13.73.G07.1.454.CMB.2.raw
  modified_base (291)..(291): a, c, t, g, unknown or other
  modified_base (380)..(380): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatggcacactactgaattggttcgcagagcagcaatctcaagcgcctaatttanaagtgtctgacaggactccggggtccagacagactcagcgcagtggcaggcactgatttcacactagaaaatcagcgagggtggaaggngtaggaggtagtagttagtggtacttattagttagttgatagtagacaagacaaacacgacgtacggtaccgtaacgttacggtttacggaccggaacggggaaccgaacggtacgtacgggacgtaacgtaacgtaaacgtacggtaacgttaggtcggtactacgtaccg

SEQ ID NO: 420489 - DNA, 524 bp, Homo sapiens
  misc_feature: GZ8MTXP02FGVA0.13.73.G07.1.454.CMB.2.raw
  modified_base (297)..(297): a, c, t, g, unknown or other
  modified_base (418)..(418): a, c, t, g, unknown or other
  modified_base (422)..(422): a, c, t, g, unknown or other
  modified_base (432)..(432): a, c, t, g, unknown or other
  modified_base (441)..(442): a, c, t, g, unknown or other
  modified_base (444)..(444): a, c, t, g, unknown or other
  modified_base (450)..(450): a, c, t, g, unknown or other
  modified_base (521)..(521): a, c, t, g, unknown or other
  modified_base (523)..(523): a, c, t, g, unknown or other
tcagtcacgtactacacgaccggtgctcgatttagctctacgctcagggggagtcgaggactcctcagttcaccttctcgacaatgaggctccctgctccagctcctggggctgctaatgctctgggtcccaggattttagaggggatgctgtaatgactcagtctccactctccctgcccgtcacccttggacagccggcctccatctcctgacagttctagtacaaagcctcgtacatcatgatgggcacacctcttgaattggttcgcagaggccaggccaatctccaaaggcncctaaatttataaggtacgtctgacaggggacttcccggggcccaaggacctaggacttcgagcggctaggtgggacaggcatgtacttcacgactagaaaatcaagcaggggtgaagtgngagngtgtagtgtntatatagtnnanagaganacacacacgacgtacgtacgtacgttacgacgacggacgacgcgacgacgacaacgacacacgtagtcgcncnc

SEQ ID NO: 420490 - DNA, 601 bp, Homo sapiens
  misc_feature: GZ8MTXP02JVBCG.13.73.G07.1.454.CMB.2.raw
  modified_base (373)..(373): a, c, t, g, unknown or other
  modified_base (398)..(398): a, c, t, g, unknown or other
  modified_base (423)..(423): a, c, t, g, unknown or other
  modified_base (477)..(477): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcaccctggacagccggcctccatctcctgctagttctagtacaaagcctacgtacatcatgatgggcactacctacttagtaattggttcgcagagccaggccaatcctaccgaacggcgtacctaatttataaggtgtctagacgtagggacgtcccggggtacccagacagtactcgagcgataggtgggtcngggcaacgtgtacttcactacgtanaaaactcaaggcgaggggtggaagngtaggaggtagtgttagttgggtacttagttattagtgtactagtcggaactanaacaaccgagtacgtacgtaccgtaacttacggtttaccgggaccgtacggggaacccaaggtccgtaaggtagtaactaacgtaaacgtacggtaaaccgttggtaccggacgtacgtaaccg

SEQ ID NO: 420491 - DNA, 885 bp, Homo sapiens
  misc_feature: GZ8MTXP02GSVGL.13.73.G07.1.454.CMB.2.raw
  modified_base (263)..(263): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttacaggggatgctgtaatgactcagtctccactctccctgcccgtcaccttggacagccggcctccatcctcctgctagttctagtcaaagcctcgtacatcatgatggcacacctactgattggttcgnagacggccaggccaatcctccaaggccgtaccttaaatttagtaaggtgtctaggtacgacggggtaccgtccggggtaccccaggaaccaggtactttaccgaggtccggacgtaggggtaggggtccaggggtacctacgttaggtacttttacccaaacgtaaccgttaaagtaaaaaacgttccgaaaggaaccggtaaggggggttagggaaaggggttacccgtagggggtaaacgggggttaacgttttaacggggtttagtttacgggggttaccccttttacggtttaaagtttttaacggttttagaccgttaagggttacgggtaaaacctaaaaccgggtaaccctaaaaacccgtaaacccgttaaaccgggttacccgggggttaacccccggtttaaaacccgttttaacccggggtttttaaccgggggtaaaccccggggtaaaacccgggggggtaaaacccgtaaaacgggggttcccggtttaaagggggtaaacccggtaaaacggtttaaaacccggaaaacggtttaaacccccggggttaaaaacccgggttttggggaaaccccgggggttcctttaaccccgggggtaaaaccccg

SEQ ID NO: 420492 - DNA, 595 bp, Homo sapiens
  misc_feature: GZ8MTXP02HGI1C.13.73.G07.1.454.CMB.2.raw
  modified_base (265)..(265): a, c, t, g, unknown or other
  modified_base (268)..(268): a, c, t, g, unknown or other
  modified_base (282)..(282): a, c, t, g, unknown or other
  modified_base (290)..(290): a, c, t, g, unknown or other
  modified_base (294)..(295): a, c, t, g, unknown or other
  modified_base (315)..(315): a, c, t, g, unknown or other
  modified_base (321)..(321): a, c, t, g, unknown or other
  modified_base (325)..(326): a, c, t, g, unknown or other
  modified_base (332)..(332): a, c, t, g, unknown or other
  modified_base (346)..(346): a, c, t, g, unknown or other
  modified_base (351)..(351): a, c, t, g, unknown or other
  modified_base (372)..(372): a, c, t, g, unknown or other
  modified_base (460)..(460): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctcgcccgtcacccttggaccagccggtcctccatcctcctgcagttctagtcaaagcctcgtacatcatgatggcactactctgattggttcgnagngcagcatcacagcnctaattanagtnngacgaggctcgggccagacngactcngcgnngtggcnggcagtgacttcanactanaaaactcgagacggtaggggngaaggtcgtaggaaggttagttgggtttaacgtcgggttactacgtttaagttagtttgacctaagttcgacgaaacgtaccaaaacncgtaaacgttcgggtaacccgttacgtttaccggtttaggggaaacccgaaacgggggaaactacggtaccgtacggggaaatacgtaaacggaaacgttacgtaaccggtaggtccggtaccgttacggaaccc

SEQ ID NO: 420493 - DNA, 691 bp, Homo sapiens
  misc_feature: GZ8MTXP02G9OPP.13.73.G07.1.454.CMB.2.raw
  modified_base (265)..(265): a, c, t, g, unknown or other
tcagtcacgtactacacgaccggtgctcgatttagctctacgctcagggggatcaggactcctcagttcaccttctcacaatgaggctccctgctcagctcctggggctgctaatgctctggtcccaggatttagaggggatgctgtaatgactcagtctccactcctccctgcccgtcaccttggacacgccgcctccatctcctgctagttctagtcaaacgcctcgtacatcatgatggcactacctagtgtaattggtcgnagacgcagcaatcctacgaggctactaattacgaggtgtactagacgaggtaccgtcccgggaccagactagacgttacgaggtcgacgtaggtcggtacaggggtcctaagtacgttacttaccaacgtaaacgtaaagtaaaacgtccgtaacggtacggaacgggggtacggaggtacgtaaaggggaacgggtttaagtttaccgggtttaaacgggttgggttaaacccgtttatttaaacgttttaagttccggaacttagtaacggaaccaaaacggtacctaaaaccgaccgtaaccgttcgggttaacccgttaaccgtttaaacgtttccggggaacggaacggggtaacccaaagggttccgtaggggtaacaggtaactaacggtaccgtaacggtggtacgactcggtaaccg

SEQ ID NO: 420494 - DNA, 653 bp, Homo sapiens
  misc_feature: GZ8MTXP02J0Y3I.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactcctccctcgcccgtcacccttggacacgcccggcctccatcctcctgctagttctagtacaaacgcctacgtacatcatgatcgggcaactaccttacttagtaagttcggttcggcgagacggccgacggaccaactccgtaccgaggaccgtacctttaaagtttaagtaaggtgtacgtacggacggacgggtaccgtcccggggtacccagacgagtaccgtacgaggcggtcgagggtacggtcgacggctacgttagtacttaccgaactacgtaaacgaaagtccgaaggcgggtaaggggtacgggtacggagttaggtaaggttatttagggttacgttcgggttacttacgttagttagtgtactagtcaacgacgtacacgacgtacgtacgtaccgtactacggttcggacggaacggacgacgtacgacggtaacacgtaacaacggtacgtacgtggtacgacgtcgtaaccg

SEQ ID NO: 420495 - DNA, 562 bp, Homo sapiens
  misc_feature: GZ8MTXP02JRV2S.13.73.G07.1.454.CMB.2.raw
  modified_base (274)..(275): a, c, t, g, unknown or other
  modified_base (285)..(285): a, c, t, g, unknown or other
  modified_base (304)..(304): a, c, t, g, unknown or other
  modified_base (307)..(307): a, c, t, g, unknown or other
  modified_base (358)..(358): a, c, t, g, unknown or other
  modified_base (405)..(405): a, c, t, g, unknown or other
  modified_base (555)..(555): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactcctccctcgcccgtcacccttggacacgccggcctccactcctcctgctagttctagtacaaacgtcctacgtacatcatgagtggcactactactgtaattggtcgnngacgcagcancacagctactatagtagtntcngacgaggccgtccgggtaccagacagtctacgacgcgacgtaggtggacgnggctagtagtacttacactaataagaaatcgagacggagggtcgagngtaggagttgtagttagtggacttagttattagtgactagtacgaacgaacgtacaacgtacgtaccgtacggtacgttaccgtacggtttcggaccggacggacaaggtcgaacggataacgtaagacgtacgtacggtgtacggtacngtaaccc

SEQ ID NO: 420496 - DNA, 607 bp, Homo sapiens
  misc_feature: GZ8MTXP02H41DB.13.73.G07.1.454.CMB.2.raw
  modified_base (260)..(260): a, c, t, g, unknown or other
  modified_base (263)..(263): a, c, t, g, unknown or other
  modified_base (273)..(273): a, c, t, g, unknown or other
  modified_base (290)..(290): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctcgcccgtcacccttggacagccggcctccatctcctgcagttctagtcaaagcctcgtacatcatgatggcacactatgatggttcgnagngcagccatcncagcactattataagtntctgacaggactccgggtccagacagtactcgagcggacgtaggtcgggtacagggctaacgtgtactttaccgacaacgtagaaaatcgaaggcgtaaggggtggaggtcgtaggaagggtaagttaggtttagtggggtactttactttaagtttagttgtacctagtacgacgaaaggacaaaccaacgtaccgtacggtaccgtaaccgttaacggttttcgggacccggtaacggggaaacccgtaaaggtccgtacggaagtaacgtaactaaacggtaacgtaaacgtggtacggtacgttacggaaccg

SEQ ID NO: 420497 - DNA, 721 bp, Homo sapiens
  misc_feature: GZ8MTXP02FW2ES.13.73.G07.1.454.CMB.2.raw
  modified_base (242)..(242): a, c, t, g, unknown or other
  modified_base (574)..(574): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctcgcccgtcaccttggacagccgcctccatcctcctgctagttctacgtacaaagccctcgtacatcatgntcgggacactaccttacttagtaagttgggttcgacaggacggccgacggaccaactccgtaccgaacggccgtaccctttaaagtttaagtaaggttgtacgtaggtaccggacggggtacccgttccccggggtacccaggtaacctaggaccgttccgaacggcggtacgtacgggttacgggtacgacggcgtacgttagtaacgtttccaaactaaacgtaaacgtaaaaacgtccgaaaggtagggtacgggggtaggaacggggtacgtaggaagttagttggtttaaccggttgggactttacttatttaacgtgaccttaagngaacaagaccaacgaactaccgtacggtaccgttacttacggtttaccgggaccggtaaccgggggaaactaaacggtccgtagggaacgtacgttaaccgtaaacggtaacggtaaccgttaggtcgggttaaccgtaccgtaacc

SEQ ID NO: 420498 - DNA, 556 bp, Homo sapiens
  misc_feature: GZ8MTXP02FITTP.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggttcgcagagccaggccaatctccaaggcgacctaatttataaggtgtctgacgagggaccgtcccggggtcccagacctagacttcagtcggcaggtgggtcagggcactgtactttccaacactagaaaatcgagcgagggtgggaaggcgtggaggtagtgttagtgggtactactattattgcagtgtcaagacaacacgacctacggtaccctaacgtacgtttccggacggtacggggaacctaacgcgtacggagtacgtaactaagacgtaacgtgtacggcctgaccc

SEQ ID NO: 420499 - DNA, 614 bp, Homo sapiens
  misc_feature: GZ8MTXP02JSCBH.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagcccggcctccatctcctgcagttctagtcaaagcctcgtacatcatgatggcacacctactgtaattggttcgcagacggccaggaccaatcctaccgaaggccgtaccttaaagtttagtaaaggtgtacctaggaaccgtaggggaccttcccggggtacccaggaaccagtacttcgagcggacaggtcgggtcaggcacgtgtacttacaacactagaaatcgagcgagggtaggaggcgtaggaggtagttagttagttggtacgttattagtttagttgtactagtacgacgaacgaccaacgaacgacgtacggtaccgtacgttacgtttacgggaccgtaacggggaccgtaacgtacgtacggaagtacgtaacgtaacgtaacggtaacgtggtacggtacgtacgtaaccg

SEQ ID NO: 420500 - DNA, 557 bp, Homo sapiens
  misc_feature: GZ8MTXP02FVR09.13.73.G07.1.454.CMB.2.raw
  modified_base (300)..(300): a, c, t, g, unknown or other
  modified_base (306)..(306): a, c, t, g, unknown or other
  modified_base (336)..(336): a, c, t, g, unknown or other
  modified_base (433)..(433): a, c, t, g, unknown or other
  modified_base (443)..(443): a, c, t, g, unknown or other
  modified_base (538)..(538): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatggcacacctacttgaattggttcgcaggagccaggccaatctccaaggcgacctaatttanaaggtntctgacagggactcccggggtcccagacanattcagcggcaggtggggtcagggcactgactttccaactacgtagaaaaatcaaggcgaaggggtggaaggctggaaggattggttatggggcttntattaattgntaatgacaagacaaacacacgtggtaccgtacttactttcggaccgaacgggggaaccaaaggcgtacggagaactaacgaaataccgtaaacgnggttaggccttaggaaccc

SEQ ID NO: 420501 - DNA, 644 bp, Homo sapiens
  misc_feature: GZ8MTXP02FSBDW.13.73.G07.1.454.CMB.2.raw
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactcctccctgcccgtcacccttggacagccggcctccatctcctgcagttctagtacaaacgcctcgtacatcatgatggacactaccttagttagtaagtttggttcggacaggacggaccaggccaagtcctaccgaaaggtccgtaaccttaaatttagtaaggtgtacgtaggacgacggggtaccgtccggggtacccagactagtacttacgagacggcgaggtcgggacaggcacgtagtacttaccaacgtactaaagaaaactcgaaggacggaaggggtgggaagtacgtaggtaagtagtttagggtttacgttcgggtactttacttaagtttacgtgtactagttacgacgaagtaccaactacgacgtacgacgttacgttaacgtttcggacgtaacgggaccaaggtccgtaaggactaacgtaaccgtaaacgtaccggtaaagtcggtacgcgtacgtaacc

SEQ ID NO: 420502 - DNA, 599 bp, Homo sapiens
  misc_feature: GZ8MTXP02JO69B.13.73.G07.1.454.CMB.2.raw
  modified_base (305)..(305): a, c, t, g, unknown or other
  modified_base (350)..(350): a, c, t, g, unknown or other
  modified_base (361)..(361): a, c, t, g, unknown or other
  modified_base (485)..(485): a, c, t, g, unknown or other
  modified_base (495)..(495): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgctagttctagtacaaagcctcgtacatcatgatgggcacactatgtagttggttcgcagacgccaggccaatcacgaggctaccttaattataggtntactggacgtacgggccgtccgggtccagacagtacctcagcggngtaggtggtcngggctactgtaactttccaactaataacgaaaacttcgaaggtacggagggggtaggacggtacgtagggtaaggtagtttaggttagttacgggtcttacgtttaattagttgctagtacganacgtacaacnctacggtcgtaacgtacgttacggtttaggacccggtaacggggaccaaggtcgtaaggtcaactaacgtaacgtacgtaaccgtggtcggtaacgtcgtaccg

SEQ ID NO: 420503 - DNA, 653 bp, Homo sapiens
  misc_feature: GZ8MTXP02GEHVP.13.73.G07.1.454.CMB.2.raw
tcagtcacgtactacacgaccggtgctcgatttagctctacgctcagggggatcaggactcctcagttcaccttctcacaatgaggctccctgctcagctcctgggctgctaatgctctggtcccaggatttagagggatgctgtaatgactcagtctccactctccctgcccgtcacccttggacagcccggcctccatcctcctgctagttctagtcaaagcctcgtacatcatgagtgggacactacctacttgtaagttggttcgcaggacgccgaggaccaactctaccgaacgcgtaccttaatttaagtaaggtgtcgtacgacgtacggaccgttacccggggtaccagacagtaccgttcgagtcggacgaggtcggtcagggtccacgttgtactttacgaactaacgtagtaaaactcgaacggacgtaaggggtacggaacgtagtagggtaagggtaattacgggtttagttcggtaaccgtttacttaaagtttaacgtttggaacctttagacgaaccgtaagactaaccgacgtacgtacgtaccgttaaccgtacgtttacgggaccgtaacggggaaccctaggtaccgtaaggcgtaacgtaactaaacgtcgaacgttgtacgcgtacgaccg

SEQ ID NO: 420504 - DNA, 661 bp, Homo sapiens
  misc_feature: GZ8MTXP02GR40I.13.73.G07.1.454.CMB.2.raw
  modified_base (384)..(384): a, c, t, g, unknown or other
tcagtcacgtactacacgaccggtgctcgatttagctctacgctcagggggatcaggactcctcagttcaccttctcacaatgaggctccctgctcagctcctggggctgctaatgctctgggtcccaggatttaggaggggatgctgtaatgactcagtctccactctccctgcccgtcacccttggacagcctgcctccatctcctgctagttctagtacaaacgtcctacgtacatcatgagtcggacacctactacttgtaattggttcgacgagacggacacggaccatcctccgaaggtccgtaccttaagtttaagtaaggttgtaccgtaggacgacgggtacccgtccggggaccaggacacgtactcgagcggngaggtcgggtcgaggactacgtgtaacttacaacgtactaagaaacgtacaggacggagggtcggaggtacgtaggaggtagttaggttaggttagggttaccttagttagtttagtacgtacgtagtacggaacaaacggaccaaaaccgtacgtaccggttaccggtacccgtttaaccggttaccggtttacgggaacccgggtaaacggggaccctaaagggacgtacgggaacgtaacgtaacgtaacgtacggaacgtggtacgacgtacg

SEQ ID NO: 420505 - DNA, 539 bp, Homo sapiens
  misc_feature: GZ8MTXP01AQ6QE.19.17.B06.1.454.CMB.2.raw
  modified_base (422)..(422): a, c, t, g, unknown or other
  modified_base (489)..(489): a, c, t, g, unknown or other
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgctgggttttccttgttgctattttagaaggtgtctctctatttgcaagtgtccagtgtgaagtgcagctggtggagtcgtgggggaggcctggtcaagccgtgggggtccctgcgactctcctgtgtggtctccggattcccattcagtcactatagtatgatgtcggcccgcaggctccgggggaagggctggaatggcttcgcatcccgttggtggaagtgggaattaatacacaccacgcagactcagtgaggggtccggttcaccgatctcaganacaacgccaagacggacaatgtattaacgaatgaactaaggcctagagacgccgaaggacttcgggnttgtgtattagttgttagcgtagtaatttcccgagccgtcgaacttaacg

SEQ ID NO: 420506 - DNA, 527 bp, Homo sapiens
  misc_feature: GZ8MTXP01CQYX9.19.17.B06.1.454.CMB.2.raw
  modified_base (412)..(412): a, c, t, g, unknown or other
  modified_base (461)..(461): a, c, t, g, unknown or other
  modified_base (470)..(470): a, c, t, g, unknown or other
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgctgggttttccttgttgctattttagaaggtgtctctctatttgcaagtgtccagtgtgaagtgcagctggtggagtctgggggaggcctggtcaagccgtggggggtccctgcgactctcctgtgtggctccggattcccattcagtcactatagtatgatgtgggcccgccgaggcgtccgggggaaggggctggaatggcttcgcatcccgtggtgaagtggaattaatacaacaccacgcagactcagtgagggcgtcaccatcncagagacaacgccaagaggtacaatgtattaacaaatgaacagcctganagcgaaganacggcttgtgtattagttgttaggcgagtaatttccgaggccctcttaacgttaacg

SEQ ID NO: 420507 - DNA, 518 bp, Homo sapiens
  misc_feature: GZ8MTXP01CBASN.19.17.B06.1.454.CMB.2.raw
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgctgggttttccttgttgctattttagaaggtgtctctctatttgcaagtgtccagtgtgaagtgcagctggtggagtctgggggagcctggtcaagcctggggggtccctgcgactctcctgtgtggctcggattcccattcagtcactatagtatgatgtgggcccgcaggcgtccggggagggctggatggcttgcatccctggtggagtggaatatacacacacgcagactcagtgaggggccggttcaccgatctccagagacaacgccaagaggtacaatcgtatttacaaatgaacagctagagacgccgaagattacgggcttgtgtattagttgttgcgagaatttccgagccgtcaacgtttaacg

SEQ ID NO: 420508 - DNA, 654 bp, Homo sapiens
  misc_feature: GZ8MTXP01ENL0L.19.17.B06.1.454.CMB.2.raw
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgctgggttttccttgttgcttattttagaaggtgtctctctatttgcaagtgtccagtgtgaagtgcagcgtggtggagtcgtgggggagccgtggtcaaggccgtggggggtccctgcgactctccgtgtgtggtctcggattcccattcagtcactatagtatgatggtcggccccgcgaggccgtaccgggggaaggggcgtaggaagtggtcttcggcctacgttcccgttgggttggaaggttagggtaattaaactaccaacgacccaacgcagacttacgaggttcggacgggggccttacactacttccaccaggaacgaaccgaaaccgtaccaaagacggtaaactaagttgttaaactttaaacaaattcggaaacacgaccgtaggaacggaaccggaccggaagggtaagttacccgggtagttggtttaggttaatttaggttggttacgaacggtaacgtaacgtttccgaacgcccgtaacttaaccgtttaacgg

SEQ ID NO: 420509 - DNA, 651 bp, Homo sapiens
  misc_feature: GZ8MTXP01CCKWM.19.17.B06.1.454.CMB.2.raw
  modified_base (525)..(525): a, c, t, g, unknown or other
  modified_base (575)..(575): a, c, t, g, unknown or other
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgcttgggttttccttgttgcttattttagaaggtgtctctctatttgcaagtgtccagtgtgaagtgcagcgtggtggagtcgtgggggagccgtgtcagccggtgggggtcctgcgactctcgtgtgtcggtctcggtacttccattcagtcactatagtatgagtggtacgggccccgaccgagggtcccggtaccggggggaaggggccgtagggaagtgggcttcggacctacgttcccggtttgggtagggtaagttagggtaattaaacgtaccgaaccacccgacgacgacgactcgaggtcggacggggtccgttacacgtattccgacagacacgaacgaccaaagaggtaactaagttacgttaactttaaanaaacgttcgaaacgtacgcctaaggacgacgccgggaagtagttaccggnttaggtagtttaatttagttggttacgtaacgaagttaacgtttcggacgttaccgtaacttaacgttttaaccgg

SEQ ID NO: 420510 - DNA, 535 bp, Homo sapiens
  misc_feature: GZ8MTXP01A8O3K.19.17.B06.1.454.CMB.2.raw
  modified_base (481)..(481): a, c, t, g, unknown or other
  modified_base (519)..(519): a, c, t, g, unknown or other
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgctgggttttccttgttgctattttagaaggtgtctctctatttgcaagtgtccagtgtgaagtgcagctgggtggagtcgtgggggaggcctggtcaaggccgtggggggtccctgcgactctcctgtgtggctccggattcccattcagtcactatagtatgatggtgggccccgcgaggcgtccgggggaaggggctggatggcttcgcatccctggtggagtaggaattaatacacaccacgcagactcagtggaggggccgttcaccatctcagagacaacgcctaagaggtacaatgtaactttacaaatgaacagcctgagagccgaagganacggcttgtgtaattgttgttgcgagtaactttcccgngccgtcaacgttaacg

SEQ ID NO: 420511 - DNA, 508 bp, Homo sapiens
  misc_feature: GZ8MTXP01A7NMY.19.17.B06.1.454.CMB.2.raw
  modified_base (449)..(449): a, c, t, g, unknown or other
  modified_base (492)..(508): a, c, t, g, unknown or other
tcagtactctcgtgcacgaccggtgctcgatttagtcgatagtgaaggggctggaatggcttgcatcccttggttggagtggaattaatacacaccacgcagactcagtgaggggccggttcaccatctccagagacaacgccaagagtacaatgtatttacaaatgaacagcctgagagccgaggatacggctgtgtattattgtgcgagaatttccgagccgcacttactttgactacgtgggggccaggggacgccctggtccaccgtctcctcacgccctccaccgaacgggccccagttccggtcccttcccccgtggcccgcccctgcctccgaaggacgccacccgtccgagacgccacgcggccggcccgtggggcctcggccccgtgggtaccaaaacgggtaccttaaccgtccccgaaagggtagacggttaaccggnggggacgggccgggcgtacgggaccgaacgggcgacaagtagnnnnnnnnnnnnnnnnn

SEQ ID NO: 420512 - DNA, 590 bp, Homo sapiens
  misc_feature: GZ8MTXP01EJSL3.19.17.B06.1.454.CMB.2.raw
  modified_base (279)..(279): a, c, t, g, unknown or other
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgctgggttttccttgttgctattttagaaggtgtctctctatttgcaagtgtccagtgtgaagtgcagctggtggagtcgtgggggaggccgtggtcaaggccgtgggggtccctgcgactctctgtgtgtctcggnttcccattcagtcactatagtatgatgtcggcccgcgaggcgtcgggggaagggcgtaggatggcttcgctagtcccgttggtggaagtaggaattatacgacaccgacgcagctcgagtggacggggccgttcacctactctacgagacgaccgaacgacaagaacggtaactaacgttagttaacttaacgaaatgtaaacgagtccgtaggaacgacggccggaaggtacgttacgggtcttaggtagttaagttagttggttagtaacgagttaacgtttccgagttcccgtcgttaacgtttaacg

SEQ ID NO: 420513 - DNA, 586 bp, Homo sapiens
  misc_feature: GZ8MTXP01BTQZQ.19.17.B06.1.454.CMB.2.raw
  modified_base (520)..(520): a, c, t, g, unknown or other
  modified_base (528)..(528): a, c, t, g, unknown or other
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgctgggtttttccttgttgctattttagaaggtgtctctctatttgcaagtgtccagtgtgaagtgcagctggtggagtcgtgggggagcctggtcaagccgtgggggtccctgcgactctcctgtgtggctccggattcccatcagtcactatagtatgagtgtcgggccccgccgaggccgtccgggggaaggggctgggaagtggcttcgctacgttcccgttgggttacggaagttagggtaattaaactaccgacaccacgcagactcgaggtggacggggccgttcacctagtcctaccgagacgaacaacgaccaaagacggtaacaagttagtaatttaacaagtagaacacgccgtagagacgcgaagngttacggnttgtagttattagttgttgcgtagtaacttccggacggttcctaacttcgtttaaccg

SEQ ID NO: 420514 - DNA, 639 bp, Homo sapiens
  misc_feature: GZ8MTXP01B0A8E.19.17.B06.1.454.CMB.2.raw
  modified_base (284)..(284): a, c, t, g, unknown or other
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgctgggttttccttgttgcttattttagaaggtgtctctctatttgcaagtgtccagtgtgaagtgcagcgtgggtggagtcgtgggggaggccgtggtcaacgccggtgggggtccctgcgctctcgtgtgtggctccggnttccatcagtcacttatagtatgagtggtcgggccccgccgaggccgggtacgggggaaggggtcgtaggaagtggcttcgctacgtcccgttggtcggaagtgtaatataccacaccgacgcacgactcgaggtcgggaacggggtccgttaccaaccgtatccgtaccagacaacaacgaccaaaggataactaagttgttaaacttaacaaagtcgaaactacgtacctaggaacgacggcccggaaagggtacgttacgggtcgttaggttagtttaagttgttcggttaggtaacggtaacgtttaacgttacccggagttaccccggtaacttaaccgttttaacccgg

SEQ ID NO: 420515 - DNA, 815 bp, Homo sapiens
  misc_feature: GZ8MTXP01CQLS4.19.17.B06.1.454.CMB.2.raw
  modified_base (213)..(213): a, c, t, g, unknown or other
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgcttgggttttccttgttgcttattttagaaggtgtctctctatttgcaagtgtccagtgtgaagtgcagngtgggtggagtcggtgggggagccgtggtcgaacggccggtgggggtccctggcgtactctcgtggtgtcggctcggacttccattcagtcatagtagtagtgagtcggtcggcccgcgaggcggtaccgggggaagggtcgttaggaagtggcgttcgctacgttccggttaggtaggtaaagtaggtaatttaaacgaaccgacaaccgacgacgacgaaccgttacgagggttacgggaacgggggtcccttacaacccgtaacgttccgaacccgaaaggaaccggaaaccaaaccggttaaccgaaaacgggtaacggttaaacttaaaagggtttagtttaaaacccgtttaaaaaaacgaaaacggtaaacgtaaacggtaaaccggtaaccggtaacgggtaaacggtaaaccgggtaaccgggtaaacgggtaaacgggttaaccgggttacggtttacggtttaaacggtttaaggtttaacggtttacgggttaaccggggttaaccgggttaaaccgggtttaaacccgggtttaacccgggtaacccgggttaacccgggttaacccggtttaacccggtttaaccggg

SEQ ID NO: 420516 - DNA, 692 bp, Homo sapiens
  misc_feature: GZ8MTXP01AEVQW.19.17.B06.1.454.CMB.2.raw
  modified_base (181)..(181): a, c, t, g, unknown or other
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgcttgggttttccttgttgcttattttagaaggtgtctntctatttgcaagtgtccagtgtgaagtgcagcgtggtggagtcgtgggggagctggtcagccggtgggggtcctgcgactctccgtgtgtggtctcggtcttcccgattcagtcactatagtatgagtcgtcgggcccgcgacgggccgttaccgggggaaggggtcgtagggatcgggtcttcgacctagttccccgttggggttacggaaggtttagggtaatttaaacgtaccacgaacccgacgacacgtactcgaagggttagggacggggtccggttaccaacgtacgtcctaccgacgaacgaaccaaacgacccaaaggacggtaactaaaggttacttaaacgtttaaaccaattacggaaacacgtcccgtaggaaccggtacgcccgggtaaaggaacgttccggggactttggttacgttaaagtttcgttggttacggtaacggtacgtaacttttccccgggaacggttaccccgtaacttcgtttttaaaccccgg

SEQ ID NO: 420517 - DNA, 688 bp, Homo sapiens
  misc_feature: GZ8MTXP01EP9DV.19.17.B06.1.454.CMB.2.raw
  modified_base (610)..(610): a, c, t, g, unknown or other
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgcttgggttttccttgttgcttattttagaaggtgtctctctatttgcaagtgtccagtgtgaagtgcagcgtggtggagtcggtgggggacggccgtggtcgaaggccggtcgggggtccctgcgactcctctgtgtggtctccggcttcccattcagtcactatagtatgagtggtcgggccccgcgacgggtccgggtaccggggggaagggggtcgtagggaagtcgggtacttcggcctacgttcccggttaggggttgggaagttaggtaacttaaactaaccaaccgacccgacgtacgaacgtactacgaacgggtgggaacgggggtcccgttacacctacgtcccacgagaacgaaccgaacgaaccgaaagaaggtaactaagttaagttaaactttaaacgaaagtacgaaacacgtccgtaagacggacgaccggtaaggtaaccgttacgggtnttaggttagttaagttgttcgttacggtaagtaacgttaaccggttcggaacgttcccgtaactttaacgtttaacgg

SEQ ID NO: 420518 - DNA, 614 bp, Homo sapiens
  misc_feature: GZ8MTXP01AHVZK.19.17.B06.1.454.CMB.2.raw
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgctgggttttccttgttgctattttagaaggtgtctctctatttgcaagtgtccagtgtgaagtgcagctgggtggagtcgtgggggaggcctggtcaagccgtgggggtccctgcgactctcctgtgtggtctccggattcccattcagtcactatagtatgatgtgggcccgccgagggcgtccgggggaaggggcgtgggaagtggcttcgctattcccgttggttggaagtggaattaagtacacaccacgcagactcgaggtcggacggggccgttcgacctacgtctaccgaagacgaaccgaacgacaaagacggtaacaagtagttaatttaacaaatgaaacacgtacctagacgacggcccggaagggagttaccgggagttggtagttaacgtttagttggttacggtaacggtaagtaacgtttcccggaacgttcccggaacttaaccgtttaacccgg

SEQ ID NO: 420519 - DNA, 648 bp, Homo sapiens
  misc_feature: GZ8MTXP01EV1PJ.19.17.B06.1.454.CMB.2.raw
  modified_base (211)..(211): a, c, t, g, unknown or other
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgcttgggttttccttgttgcttattttagaagtgtctctctatttgcaagtgtccagtgtgagtgcagntggtggagtcgtgggggagccgtgtcaaggccggtcgggggtcctgcgctctctgtgtgctcgtactccatcatcactatagtatgagtcggtcggccccgccgacggtccggtacgggggaaggggcgtaggaacgtggtctccgctacgtcccgtttggtacggtaagttaggtaattaacgtaacaccgaccgacgacagtaccacgtaggtcgggacgggggtccgttacaacccgtacgttacccaccgagaaaccgaacctaaaccgaccgaaagtacgtaactaaagttagttaaactttaaccaaagttagaaccagcctaggacgacggaccggaaggtattacggtcttagtagttagtttagttggttacgtaacgtaaaggttaaccgtttaccgggacgttaccgtaaccgttaacgtttaacg

SEQ ID NO: 420520 - DNA, 579 bp, Homo sapiens
  misc_feature: GZ8MTXP01D6DCP.19.17.B06.1.454.CMB.2.raw
  modified_base (515)..(515): a, c, t, g, unknown or other
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgcttgggttttccttgttgctattttagaaggtgtctctctatttgcaagtgtccagtgtgaagtgcagcgtggtggagtcgtgggggagcctggtcagcgtgggggcctgcgactctctgtgtggctccggattccattcagtcactatagtatgatggtcggcccgcgaggccgtcgggggaagggctggaagtggcttcgctacgtcccgttggtcggaagttaggtaattaataccaaccaccacgcagactcgagtcggacggggccgttacaccgtactcctaccgagacgaacaacgaccaaagacgggtaacaattagtaattaacgaaatacgaacagcctagacgcgcggaagtagttccggnttgtagttatttaagttggttacgcgtaaagtcgtttacccgagttaccggtcttcgtttaacg

SEQ ID NO: 420521 - DNA, 786 bp, Homo sapiens
  misc_feature: GZ8MTXP01CFMGU.19.17.B06.1.454.CMB.2.raw
  modified_base (618)..(618): a, c, t, g, unknown or other
  modified_base (694)..(694): a, c, t, g, unknown or other
tcagtactctcgtgcacgaccggtgctcgatttagtcgatagtgaaggggtctgagagaggagccttagccctggattccaaggcctctccacttgatgatcagcactgagcaccgaggattcaccatggaactggcgctccgcttgggttttccttgttgctattttagaaggtgtctctctatttgcaagtgtcagtgtgaagtgcagtcgtgggtggaggtcggtggggggacgcgtggtcgaaggccggtgggggtccctgcgactctccgtgtgtcggtctccggtacttccctattcacgtctactagtagtatgtagtggcgggccccgccgacgggcggtaccgggggaagggggcgtagggtagtcggtccgttggactacgttcccggttaggggttagggtaggttaacgggaaattttaaacgaaacccgaaccctaccccgaaccggtaccgaaacggtaccgtacgtaggggttacgggaccggggggtaccccggtttaccaacccgtacctacccgtacccggaaaggtacccgaaacccgtaaaccgacccgtaaaacggtacggttaaaccgttaaagttaacggttaaaacctttaaanaaaacggttaaccggaacgtacggtaccctggggaaaccggaaccggggtaaccggtaaggttacggttaaccggnggtttaacggttagttacgtttagttcgggtaagtaccggtaaccggtttaacgtttcccggggacgtccccggttaacgtttaaccccggg

SEQ ID NO: 420522 - DNA, 714 bp, Homo sapiens
  misc_feature: GZ8MTXP01AYH36.19.17.B06.1.454.CMB.2.raw
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgctgggttttccttgttgctattttagaaggtgtctctctatttgcaagtgtccagtgtgaagtgcagctgggtggagtcgtgggggaggcctggtcaagccgtggggggtccctgcgactctccgtgtgtggctccggattcccattcagtcactatagtatgatggtcggcccgcgaggcgtccgggggaaggggctaggagtggcttcgcagtcccgttgggttcggaaggtaggtaattaagtaaccacaccacgtacacgactcgaggtcgggacgggggtccccggttacacccgtatccgtaccaagggaaccgaaacccaacggaacccgaaaaggtacggggtaaactaaagtttacggtttaaactttaaaccaaaagttacggaaaaccgtacggtccccgtaagggaaacggtaaccgggaacccgggaaaggggtaaaccgttaaaccgggggtccttgggtttaaagggtttaatttaggtttgggttacgggtaacgtaaggttaaccgttttacccgggaaccggttcccggtaacgttaaccctttttaaccggg

SEQ ID NO: 420523 - DNA, 507 bp, Homo sapiens
  misc_feature: GZ8MTXP02IYPAC.19.17.B06.1.454.CMB.2.raw
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgctgggttttccttgttgctattttagaaggtgtctctctatttgcaagtgtccagtgtgaagtgcagctggtggagtcgtgggggaggcctggtcaagccgtggggggtccctgcgactctcctgtgtggtctccggattcccattcagtcactatagtatgatgtggcccgcaggcgtcggggagggctggatggcttgcatccgtggttggagtggattatacacaccacgcagactcagtgaggggccgtcaccatctcagagacacgccaagagtacatgtattacaaatgaacagctgagagccgagatacggctgtagtattagttgtgcgagtaactttccgagccgcgtacttacg

SEQ ID NO: 420524 - DNA, 535 bp, Homo sapiens
  misc_feature: GZ8MTXP02IO12B.19.17.B06.1.454.CMB.2.raw
  modified_base (389)..(389): a, c, t, g, unknown or other
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgctgggttttccttgttgctattttagaaggtgtctctctatttgcaagtgtccagtgtgaagtgcagctggtggagtcgtgggggaggcctggtcaagcctgggggtccctgcgactctcctgtgtggtctccggatcccattcagtcactatagtatgatgtggcccgccaggcgtccggggaagggctggaatggcttgcatcccgtggttggagtggattaatacacaccacacagactcagngaggggccgttcacccgatctaccagacacaacgccaaagagtaacatgtattaacaaatgaacagactgagagaccgagacgtacggcttagtagttagttattgtagaacgtagtaacgtttccgaagtcccgacactttaacg

SEQ ID NO: 420525 - DNA, 558 bp, Homo sapiens
  misc_feature: GZ8MTXP02J0F3N.19.17.B06.1.454.CMB.2.raw
  modified_base (541)..(541): a, c, t, g, unknown or other
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgctgggttttccttgttgctattttagaaggtgtctctctatttgcaagtgtccagtgtgaagtgcagctggtggagtcgtgggggaggcctggtcaagccgtgggggtccctgcgactctcctgtgtggtctccggattcccattcagtcactatagtatgatgtgggcccgccgaggcgtccggggaaggggctggaatggcttggcatcccgttgggttggagtgggattaataacacaccacgcagactcgagtggacgggggtcccgttcgaaccctatccctccgaagacgaccaaaccgaccaaagacgtaacaaagtgtaatttaacaaaatcgaaacagcctaggacgggaccgaaggacgacggccgtactatattgtgtgagtgttanggacgagtggctggtag

SEQ ID NO: 420526 - DNA, 507 bp, Homo sapiens
  misc_feature: GZ8MTXP02I75EW.19.17.B06.1.454.CMB.2.raw
  modified_base (381)..(381): a, c, t, g, unknown or other
  modified_base (410)..(410): a, c, t, g, unknown or other
tcagtactctcgtgcacgaccggtgctcgatttagtcgatagtgaaggggtctgagagaggagccttagccctggattccaaggcctctccacttgatgatcagcactgagcaccgaggattcaccatggaactggcgctccgctgggttttccttgttgctattttagaaggtgtctctctatttgcaagtgtccagtgtgaagtgcagctggtggagtctgggggagcctggtcaagcctggggggtccctgcgactctcctgtgtggtctccggattcccattcagtcactatagtatgatgtggccgccaggcgtcggggagggctggaatggctgcatccttggtggagtggaattaatacacaccacgcagactnaggtgaggggccgttcaccatctccaganacaacgccaagagtacaatgtaattacaaatgaacagcctagagacgcgagatacggctgtagtattagtgtgacgagtacttccgagccgactaac

SEQ ID NO: 420527 - DNA, 551 bp, Homo sapiens
  misc_feature: GZ8MTXP02JY99P.19.17.B06.1.454.CMB.2.raw
  modified_base (399)..(399): a, c, t, g, unknown or other
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgctgggttttccttgttgctattttagaaggtgtctctctatttgcaagtgtccagtgtgaagtgcagctggtggagtagtgggggaggcctggtcaagccgtgggggtccctgcgactctcctgtgtggtctccggattcccattcagtcactatagtatgatgtgggcccgcgaggcgtccggggaaggggcgtggaagtggcttcgctacgtcccgttgggttcggagttggattaatacacaccacgcagacncaggtggacgggggtccggttcaccgatcctaccagacgacaacgaccaaagagtacaatagttaatttaacgaaatagaacagcctagagagccgaggataccggctgtagtattgtgagaacgtagtacgttcgagccgtactacttacg

SEQ ID NO: 420528 - DNA, 554 bp, Homo sapiens
  misc_feature: GZ8MTXP02JLQT1.19.17.B06.1.454.CMB.2.raw
  modified_base (511)..(511): a, c, t, g, unknown or other
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgctgggttttccttgttgctattttagaaggtgtctctctatttgcaagtgtccagtgtgaagtgcagctggtggagtcgtgggggaggcctggtcaaggccgtgggggtccctgcgactctcctgtgtggtctccggattcccattcagtcactatagtatgatgtggcccgccaggcgtccggggaagggctggagtggctgcagtcccgttgggttggagtggattaatacacaccacgcagactcagtgaggggccgtcaccatctcagagacaacgaccaagagtacaatagtaattaacaaatagaaactagaccgtagaagacgaccggaaggactacgggcgtagttagtattagtttggngtaacgtagtaacgtttccggacgtaccggtccaactttaccg

SEQ ID NO: 420529 - DNA, 548 bp, Homo sapiens
  misc_feature: GZ8MTXP02F55VE.19.17.B06.1.454.CMB.2.raw
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgctgggttttccttgttgctattttagaaggtgtctctctatttgcaagtgtccagtgtgaagtgcagctggtggagtcgtgggggaggcctggtcaagccgtggggggtccctgcgactctcctgtgtggtctccggatcccattcagtcactatagtatgatgtgggccccgcgaggccgtccggggaaggggctggaatggcttgcatcccttggtggagtggattaatacacaccacgcagactcagtggaggggccggttacacatctaccagagacaacgaccaaagagtacaatagtaatttaacaaaatgaaacagcctgaagagaccgaaggataccggcgtgtagttattagttgtagcgtaagtaactttaccggagtccggactactttaaccg

SEQ ID NO: 420530 - DNA, 561 bp, Homo sapiens
  misc_feature: GZ8MTXP02GG63R.19.17.B06.1.454.CMB.2.raw
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgctgggttttccttgttgctattttagaaggtgtctctctatttgcaagtgtccagtgtgaagtgcagctggtggagtcgtgggggaggcctggtcaagccgtgggggtccctgcgactctcctgtgtggtctccggattcccattcagtcactatagtatgatgtggcccgcgaggcgtccggggaaggggctggaatggcttcgctacgtcccgttggttggagttggattaatactacaccacgacagactcgagtggaggggccgttcaacccgtatcctaccagacgacaacgcaaagagtacaatgtattaacaaaatgaaacagacctgaacgacgccgaggatacgggctggttagtattactggttacgcggtaagtaaacgtttccgacgtaccgtacaactttaaccg

SEQ ID NO: 420531 - DNA, 557 bp, Homo sapiens
  misc_feature: GZ8MTXP02HWC5S.19.17.B06.1.454.CMB.2.raw
  modified_base (383)..(383): a, c, t, g, unknown or other
tcagtactctcgtgcacgaccggtgctcgatttagtcgatagtgaaggggtctgagagaggagccttagccctggattccaaggcctctccacttgatgatcagcactgagcaccgaggattcaccatggaactggcgctccgctgggttttccttgttgctattttagaaggtgtctctctatttgcaagtgtccagtgtgaagtgcagctggtggagtcgtgggggaggcctggtcaaggccgtgggggtccctgcgactctcctgtgtggtctccggatcccattcagtcactatagtatgatggtcgggccccgccgagggcgtccggggaaggggctaggatggccttgctatcccgttggtggagtggtaattaaanacacaccacgcagactcaggtggacggggccgttcaccgatcctccagacaacaacgccaaagagtacaatgtaattaacaaatgaaacagacctgaagacgaccgtaggactaacggctaggttagtatttagtgtcgcgtaaggtaactttccggacgtcccgacttaaccg

SEQ ID NO: 420532 - DNA, 577 bp, Homo sapiens
  misc_feature: GZ8MTXP02H8FD5.19.17.B06.1.454.CMB.2.raw
  modified_base (194)..(194): a, c, t, g, unknown or other
  modified_base (405)..(405): a, c, t, g, unknown or other
  modified_base (409)..(409): a, c, t, g, unknown or other
  modified_base (434)..(434): a, c, t, g, unknown or other
tcagtactctcgtgcacgaccggtgctcgatttagtcgatagtgaaggggtctgagagaggagccttagccctggattccaaggcctctccacttggtgatcagcactgagcaccgaggattcaccatggaactggcgtctccgctgggttttccttgttgctattttagaaggtgtctctctatttgcaagtntccagtgtgaagtgcagctggtggagtcgtgggggaggcctggtcaaggccgtgggggtccctgcgactctcctgtgtggtctccggattcccattcagtcactatagtatgatgtcgggcccgccgaggcgtccgggggaagggcgtgggaagtggcttcgctacgttcccgttggggttggaggtggtaattaagtacacaccacgcanaccncgagtggacggggtccgttcaaccntctaccagacgacaacgaccaagagtactaatagtaattacaaagtagaaacagcctagagacgaccggaggacgtcggactaggtagttaagtttagttgaggtaaccgtagtaacgttccgaacgtccgacttaacttacg

SEQ ID NO: 420533 - DNA, 547 bp, Homo sapiens
  misc_feature: GZ8MTXP02F15XR.19.17.B06.1.454.CMB.2.raw
  modified_base (374)..(374): a, c, t, g, unknown or other
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgctgggttttccttgttgctattttagaaggtgtctctctatttgcaagtgtccagtgtgaagtgcagctgggtggagtcgtgggggaggcctggtcaagccgtgggggtccctgcgactctcctgtgtgtctccggattcccattcagtcactatagtatgatggtcgggccccgcgaggcgtccggggaaggggctggaatggctgcatccgtggttggagtggattaanacacaccacgacagactcagtggagggggcccgttacaccatcctacagacgacaacgaccaaagagtaacaaattgttaatttaacaaatgaaacagcctagagagccggaagatacggctgtagtattatggtagaacgtaagtaactttccgagtccgactaactttacg

SEQ ID NO: 420534 - DNA, 514 bp, Homo sapiens
  misc_feature: GZ8MTXP02I962J.19.17.B06.1.454.CMB.2.raw
  modified_base (452)..(452): a, c, t, g, unknown or other
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgctgggttttccttgttgctattttagaaggtgtctctctatttgcaagtgtccagtgtgaagtgcagctggtggagtcgtgggggaggcctgggtcaagcctggggggtccctgcgactctcctgtgtggtctccggattccccattcagtcactatagtatgatgtggccccgcaggctccggggagggctggatggcttgcatcccttggtggagtggattatacacaccacgcagactcagtgaggggccgttcaccatcctcagagacaacgccaaagagtacaatgtatttaacaaatgaaacngcctagagagcgagatacggctagtgtattatgtgcgagtactttccgagccgcactttacg

SEQ ID NO: 420535 - DNA, 536 bp, Homo sapiens
  misc_feature: GZ8MTXP02JFZ2J.19.17.B06.1.454.CMB.2.raw
  modified_base (521)..(521): a, c, t, g, unknown or other
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgctgggttttccttgttgctattttagaaggtgtctctctatttgcaagtgtccagtgtgaagtgcagctggtggagtctgggggagcctggtcaagcctgggggtccctgcgactctcctgtgtggtctccggattcccattcagtcactatagtatgatggtggcccgcaggccgtccggggaagggctggaatggcttgcactccgttggttggagtggattaatacacaccacgcagactcagtggaggggccgttcaccgatctaccagagaccaacgcaagagtacaatcgtaatttaacaaatagaacagcctagagagcccgaggactacggctgtagttacttagttgtcgaacgaagtaactttccgancccgactactttacg

SEQ ID NO: 420536 - DNA, 561 bp, Homo sapiens
  misc_feature: GZ8MTXP02JNRSN.19.17.B06.1.454.CMB.2.raw
  modified_base (430)..(430): a, c, t, g, unknown or other
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgctgggttttccttgttgctattttagaaggtgtctctctatttgcaagtgtccagtgtgaagtgcagctggtggagtcgtgggggaggcctggtcaagccgtggggggtccctgcgactctcctgtgtggtctccggattccccattcagtcactatagtatgatgtcgggcccgccgaggcgtccgggggaaggggcgtggaatggcttgcagttcccgttggttggagtaggattaatacacaccacgacagactcgagtggacggggccggttcacccgatccncagagacaacgcaagagtacaatgtaattacaaatagaaacagcctagacgacgaccggaaggagtaccggcgtgtacgtattacgttgtagcggtaagtaacgtttccggacgtccgtactacgtttacg

SEQ ID NO: 420537 - DNA, 513 bp, Homo sapiens
  misc_feature: GZ8MTXP02JN55O.19.17.B06.1.454.CMB.2.raw
  modified_base (363)..(363): a, c, t, g, unknown or other
  modified_base (391)..(391): a, c, t, g, unknown or other
  modified_base (398)..(398): a, c, t, g, unknown or other
  modified_base (402)..(402): a, c, t, g, unknown or other
  modified_base (415)..(415): a, c, t, g, unknown or other
  modified_base (439)..(439): a, c, t, g, unknown or other
  modified_base (457)..(457): a, c, t, g, unknown or other
  modified_base (463)..(463): a, c, t, g, unknown or other
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgctgggttttccttgttgctattttagaaggtgtctctctatttgcaagtgtccagtgtgaagtgcagctggtggagtcgtgggggaggcctggtcaagccgtgggggtccctgcgactctcctgtgtggtctccggattcccatcagtcactatagtatgatgtggcccgcaggcgtccggggaagggctgatggctgcatcctggttggagtgattaancacaccagcagctcagtggagggccgtnaccatcncagnacaacgccaaganacaatgtaattaacaaatgaaacngcctagagagaccgaganaccggntgtattattagttgtagcggtataaacgttccgaagccgtacacctttag

SEQ ID NO: 420538 - DNA, 583 bp, Homo sapiens
  misc_feature: GZ8MTXP02GNI3X.19.17.B06.1.454.CMB.2.raw
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgctgggttttccttgttgctattttagaaggtgtctctctatttgcaagtgtccagtgtgaagtgcagctggtggagtagtgggggagcctggtcagccgtggggtccctgcgactctctgtgtggtctccggattcccattcagtcactatagtatgatgtcggcccgccgaggcgtccggggaagggcgtaggagtggcttcgctactccgttggttggagttaggattaatacaacaccacgcagactcgagtggacggggtccgttacacctactcctaccgagacgaccaaccgacaaagagtacaattgtaaacttaacaaagtagaacagacctagacgacgaccgaaggacgtacgggtcttaggttacgttatttacgttgtacggaacgtaacgttacgtttacccggagtccccgtactacgtttaaccg

SEQ ID NO: 420539 - DNA, 602 bp, Homo sapiens
  misc_feature: GZ8MTXP02I0H8J.19.17.B06.1.454.CMB.2.raw
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgctgggttttccttgttgctattttagaaggtgtctctctatttgcaagtgtccagtgtgaagtgcagctggtggagtcgtgggggaggcctggtcaagccgtgggggtccctgcgactctcctgtgtggtctccggattccccattcagtcactatagtatgatgtcggcccgccgaggccgtccggggaagggcgtggaatggcttcgctatcccgttgggttggagtaggattaatacacaccacgcagactcgagtggacggggtccgtacaccgatcctccaagacgacaacgaccgaaaggacgtaacaagtacgttaatttaaacaaagtagaaacaggacctaggaagacggaccgaagggtactaccggcgttaggtagttacgtttaagttggttaggaacggtaaacgtaacgtttcccggaacggtcccggacttaccgtttaaccgg

SEQ ID NO: 420540 - DNA, 576 bp, Homo sapiens
  misc_feature: GZ8MTXP02J1IMP.19.17.B06.1.454.CMB.2.raw
  modified_base (376)..(376): a, c, t, g, unknown or other
  modified_base (392)..(392): a, c, t, g, unknown or other
  modified_base (481)..(481): a, c, t, g, unknown or other
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgctgggttttccttgttgctattttagaaggtgtctctctatttgcaagtgtccagtgtgaagtgcagctggtggagtagtgggggaggcctggtcaagccgtgggggtccctgcgactctcctgtgtggtctccggattcccattcagtcactatagtatgatgtggccccgcgaggcgtccggggaaggggctggaatggcttcgctatcccgttggttggagtggattaanacacaccacgcagacncaggtggacggggtccgttcacccgatcctccgagacgaccaacgccaaaggacgaacaagttagtaaactttaacaaaattcgaaacnggaccctggaacgaggccgaaggacgtacgggcttagtagttacttacgttgtggaacgtagtaactttcccggaagcccgtactacgtttaccg

SEQ ID NO: 420541 - DNA, 633 bp, Homo sapiens
  misc_feature: GZ8MTXP02I46BC.19.17.B06.1.454.CMB.2.raw
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgctgggttttcctgttgctattttagaaggtgtctctctatttgcaagtgtccagtgtgaagtgcagctggtggagtcgtgggggagcctggtcaagccgtgggggtccctgcgactctcctgtgtggtctccggattcccattcagtcactatagtatgatgcgggcccgcgacggcgtaccggggaagggctaggaatggcttggcagtcccgttggtcggagtggattaagactacgaccacgcagtactcaggtcgacgggggccggttacacccatcctacaagacgacgaaccgacccaaaggacgtaaccaagttacgttaaactttaaaccgaaaattacgaaactacggtaccctaggaacgaacggtacccggaaaggtacgttaaccgggcgttaggttacgttaatttagtttacgtcggtaaccggtaggttaaaacgttttcccggaacgtaccccgtacgtaaccgttttaaaccg

SEQ ID NO: 420542 - DNA, 578 bp, Homo sapiens
  misc_feature: GZ8MTXP02F7MI7.19.17.B06.1.454.CMB.2.raw
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgctgggttttccttgttgctattttagaaggtgtctctctatttgcaagtgtccagtgtgaagtgcagctgggtggagtcgtggggggaggcctggtcaagcccgtggggggtccctggcgactctcctgtgtggtctccggattccccattcagtcactatagtatgatgtggccccgcgaggcgtccggggaagggctggatggcttgcatcccgttggtggagtggattaatacacaccacgcagactcagtggacggggccgttcaccgtatcctacagacaacaacgacccaaagagtaacaatagttaattaacaaaatgaaactagacctaggaagacgaccggaaggtacgtaaaccgggctaggttacgttatttaagttggtagtaacgtaagtaaacgtttcccggagcccgactactttaaccg

SEQ ID NO: 420543 - DNA, 610 bp, Homo sapiens
  misc_feature: GZ8MTXP02G1CAD.19.17.B06.1.454.CMB.2.raw
  modified_base (378)..(378): a, c, t, g, unknown or other
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgctgggttttccttgttgctattttagaaggtgtctctctatttgcaagtgtccagtgtgaagtgcagctggtggagtcgtgggggaggcctggtcaaggccgtggggggtccctgcgactctcctgtgtggtctccggattcccattcagtcactatagtatgatgtcggcccgccgaggcgtccggggaaggggctggaatggcttgcagtcccgttggttggagtggattaanacacaccacgcagactcagtggaggggtccggttcaccatcctaccgagacgacaacgacccaaagacgtacaaattgttaatttaaacaaaagtcgaaacgaacgacctaggaacgacggacccggaagggtacgtaaaccgggcttaggttaggttactttaaggtttggacggtaaccggtaagttaaaacgttttcccggaaggtccccgtactaaccgttttaaccg

SEQ ID NO: 420544 - DNA, 622 bp, Homo sapiens
  misc_feature: GZ8MTXP02GSK2F.19.17.B06.1.454.CMB.2.raw
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgctgggttttccttgttgctattttagaaggtgtctctctatttgcaagtgtccagtgtgaagtgcagctggtggagtcgtgggggaggcctggtcaagccgtggggggtccctgcgactctcctgtgtgtctccggattccccattcagtcactatagtatgatgtgggccccgccaggccgtccggggaaggggctagggaatggcttggcctagttcccgttggttggagtaggattaatacaccaccacgcagactcgagtggacggggtccgttcaccgatcctccaagacgaccaacgtaccaaaggaacgtacaaatggttaaatttaacaaaacgttgaaaccagacccgtaggaacgacggacccggaagggtacgtaccggggtacttaggtagtttaacgtttaagttggttaggaacgttaacgtaaacgttttccccggaaggccccgtacgttaacctttaaccgg

SEQ ID NO: 420545 - DNA, 577 bp, Homo sapiens
  misc_feature: GZ8MTXP02H7V2I.19.17.B06.1.454.CMB.2.raw
  modified_base (400)..(400): a, c, t, g, unknown or other
  modified_base (408)..(408): a, c, t, g, unknown or other
  modified_base (481)..(481): a, c, t, g, unknown or other
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgctgggttttccttgttgcttattttagaaggtgtctctctatttgcaagtgtccagtgtgaagtgcagctgggtggagtcgtgggggaggcctggtcaagccgtggggggtccctgcgactctcctgtgtggtctccggattcccattcagtcactatagtatgatgtggcccgcaggcgtcggggaagggctggaatggcttcgctacgttcccgttggggttggaggttggatttaaacgtacaccaccacgcanactcaggngacgggggccgttacacctagtctaccgagacgacaacgaccaagatacaatgtaatttaacaaagtgaaacngcctagagacgccgagacgtacggcttaggtacgttattacgttggtagtaacggaacgtaaacgtttccggaacgtcccgacttaacgtttaccg

SEQ ID NO: 420546 - DNA, 772 bp, Homo sapiens
  misc_feature: GZ8MTXP02IUTNK.19.17.B06.1.454.CMB.2.raw
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgctgggtttcctgttgctatttagaggtgtctctctatttgcaagtgtccagtgtgaagtgcagctggtggagtcgtgggggagcctggtcaagccgtgggggtccctgcgactctcctgtgtggtctccggattccccattcagtcactatagtatgatgtcggcccgtccgaggccgtccgggggaagggccgtagggaatcgggtctttcggcctaacgttcccccgttggggtttacgggtaaggttagggtaacgtttaaaacgtaaccaaccgtaaaccccgtaaccgacgtaaacggtaccttacccgtaagggttacggacggggggtaccccggttaccggaaccctacgttacccgttacccgaaacggacggaacccgaaaaccggacccaaaaggggtaaactaaaccgttaaaagtttagggtttaaacttttaaaaccggaaaaattaacgggtaaacctaacggaaccccgttaaggaacgggaaaccgggacccgggttaaagggaaaccgttacgggggtaccttacgggttacggttaactttaacgtttcggtaggtaaccggtaagtaaacgtttcccggaaacgtcccgtacggttaactttaaaccgg

SEQ ID NO: 420547 - DNA, 571 bp, Homo sapiens
  misc_feature: GZ8MTXP02JR7FW.19.17.B06.1.454.CMB.2.raw
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgctgggttttccttgttgctattttagaaggtgtctctctatttgcaagtgtccagtgtgaagtgcagctggtggagtctgggggaggcctggtcaagccgtgggggtccctgcgactctcctgtgtggtctccggattcccattcagtcactatatatgatggtggccccgccgaggcgtccggggaaggggcgtggaagtggcttgcatccgtggttcggagtgattatacacaccagcagactcaggtgacggggccgttcgacccagttccacagacgacaacgaccaaagagtacaatgtaactttaacaaagttgaacgataccgtgaaggacgaccgaagggacgtacggacgttagtacggttattaagttggtaggtccgtaaagtaactttccggaacgtcccggactacgtttaaccg

SEQ ID NO: 420548 - DNA, 586 bp, Homo sapiens
  misc_feature: GZ8MTXP02I5WHJ.19.17.B06.1.454.CMB.2.raw
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgctgggttttccttgttgctattttagaaggtgtctctctatttgcaagtgtccagtgtgaagtgcagctgggtggagtcgtgggggagcctggtcagccgtgggggtcctgcgctctctgtgtggtctcggatccattcagtcactatagtatgatggtcgggccccgcgaggccggtccgggggaagggtctagggagtggtctcgctacgtcccgttggttggagtagtattaacacacaccgacgcagactgaggtcggacggggtccgttacactatccgtacgagacgaacaaccgacaaaggtataactattagttaactttaaacgaaatagaaacacgtactaggacgacgtaccggaaggtacgtaccggtcgtaggttacgttagttagtggtagaacgtaagttacgttccgagtccgtactacgtttaacg

SEQ ID NO: 420549 - DNA, 651 bp, Homo sapiens
  misc_feature: GZ8MTXP02JZEY3.19.17.B06.1.454.CMB.2.raw
  modified_base (224)..(224): a, c, t, g, unknown or other
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgctgggttttccttgttgctattttagaaggtgtctctctatttgacaagtgtccagtgtgaagtgcagctggtggagtcgngggggagcctggtcagccgtggggtccctgcgctctctgtgtgtctccggattcccattcagtcactatagtatgatggtcggccccgccgagggtccggtaccggggaagggcgtagggagtggtacttcgctacgttcccgttggttggaggttaggtacttaactacgaccaccgacgactaagacctacgtaggtacggacgggggtcccgttacgacccaagttccaccgaagaacgaccgaaaaccgaccgaaagtaacgtaaccgtaaagttacgtaactttaaaccgaaagttacgaaacgacgtaccgtagaacgacggaccgtaagggtacacgggttcttaggttagttaagttacgttaggtacgtaagtaacgttacggttacccggtacggacccgtaccgttacgtttaacg

SEQ ID NO: 420550 - DNA, 640 bp, Homo sapiens
  misc_feature: GZ8MTXP02JM9OI.19.17.B06.1.454.CMB.2.raw
tcagtactctcgtgcacgaccggtgctcgatttagtcgatagtgaaggggtcgtgagagaggagccttagccctggattccaaggcctctccacttggtgatcagcactgagcaccgaggattcaccatggaactggcgctccgctgggttttcctgttgctatttagaaggtgtctctctatttgcaagtgtccagtgtgaagtgcagctggtggagtcgtgggggagcctggtcaaggccgtgggggtccctggcgactctcctgtcgtcggtctccggattccccattcagtcactatagtactgatgtcggcccgccgagggccgtaccgggggaaggggctgggaactcgggtctggctacgtccgttagggtcggaggttgggattaaactacgacaccgacggacacgtaccgtcgaggttacgggacggggcccggttacacccgtaactccgtacccgaaggaacgacccaaacggtacccaaagtaagtaccgaaattaggttaactttaaacaaacgttagaaaccgtaggacccgttaggaacgacgaccggaagggtacgtaccgggtcgtagttacggtaaatttgtagtgaacgtagtaaacgttcgagtccgtacacgtttacg

SEQ ID NO: 420551 - DNA, 581 bp, Homo sapiens
  misc_feature: GZ8MTXP02G6UQ3.19.17.B06.1.454.CMB.2.raw
  modified_base (498)..(498): a, c, t, g, unknown or other
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgctgggtttcctgttgctattttagaaggtgtctctctatttgcaagtgtccagtgtgaagtgcagctggtggagtcgtgggggagccgtggtcagtccggtgggggtccctgcgactctcctgtgtggtctccggatcccattcagtcactatagtatgatcggtcggcccgtccgagggcccgtcgggggaagggctaggaagtggtctcgctacgttcccgttagggttcggagttagggatttaataccaaccacctacgcagcctagagttggcgggtaccgttcactacgtccacgaagtacaccacgacctaaagagtacaaagtctaatttaacaaaagtcgaaaccnggacacgagacgcgaacgacgtaggtctagtagttaactagttcgagccgtaaggttaacttcggaacgtccgtctaacttcg

SEQ ID NO: 420552 - DNA, 586 bp, Homo sapiens
  misc_feature: GZ8MTXP02F9GWV.19.17.B06.1.454.CMB.2.raw
  modified_base (342)..(342): a, c, t, g, unknown or other
  modified_base (480)..(480): a, c, t, g, unknown or other
tcagtactctcgtgcacgaccggtgctcgatttagtcgatagtgaaggggtctgagagaggagccttagccctggattccaaggcctctccacttggtgatcagcactgagcaccgaggattcaccatggaactggcgctccgctgggttttcctgttgctattttagaaggtgtctctctatttgcaagtgtccagtgtgaagtgcagctggtgagtctgggggagctggtcaagcctggggggtccctggcgactcgtcctggtgtggtctccgggattcccgatttcagttcactatgatgatggtggcccgcaggctccggggagggctggaatggtntgctagtccgttgttaggacgtggtattaatacgacacccagactagactaccagtagacggggtccgtaactaccgaatccgtaccgacgagacaccgtaccaaagaacgtacaagtagttattaagaaatgaaacncgactcggagaaggacccgaggtacaacggtacgttgtacggttaactttagtagttacgtaacggtaacgtaacgtttcgaacggtcccgacgtacgtttaaccg

SEQ ID NO: 420553 - DNA, 537 bp, Homo sapiens
  misc_feature: GZ8MTXP01A0MG1.45.84.H07.1.454.CMB.2.raw
  modified_base (378)..(378): a, c, t, g, unknown or other
  modified_base (437)..(437): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggagcctggtcaagccgtgggggtccctgagactctcctgtgcagcctctggattcgacttcagtatttatagtgtgaaatggtccgcaggctccgagggaggggctggagtgggtctcgatccattagcagtagccagtgtcacataatattcgcagactcagtgaaggccnttacaacatctaccagagacaacgaccaaagactcactgtaatactaacaaatgaaacngtactagaagagacccgaaggaccacgggtcttaggtttactacgttgtaacgaagacgaagacgcttaagtaacggtctttggatggttggtaacgggg

SEQ ID NO: 420554 - DNA, 530 bp, Homo sapiens
  misc_feature: GZ8MTXP01BQ48L.45.84.H07.1.454.CMB.2.raw
  modified_base (325)..(325): a, c, t, g, unknown or other
  modified_base (381)..(381): a, c, t, g, unknown or other
  modified_base (388)..(388): a, c, t, g, unknown or other
  modified_base (392)..(392): a, c, t, g, unknown or other
  modified_base (467)..(467): a, c, t, g, unknown or other
  modified_base (492)..(492): a, c, t, g, unknown or other
  modified_base (507)..(507): a, c, t, g, unknown or other
tcagacgcgatcgacacgaccggtgctcgatttagcagacgtctgtcgcggggagagaggagccttagccccggattccaaggcctatccacttggtgatcagcactgagcaccgaggattcaccatggcactgggctccgctgggttttccttttgctattgtagaaggtgtccactgtgaggtgcagctggtggaggtcgggggagcctggtcaagccgtgggggtccctgagactctcctgtgcagcctctggattcgacttcagtattatagtgtgaaatgggtccgccaggctccgaggggaagggctggagtgggtctnatccattagcagtagcagtggtacacatataattacgcagactcagtgaacgggcncttcaanatcnccagagacaacgccaaagaactcactagtatacgtaacaaattgaaacagtctgagagccgtaaggacaccgggntgttacttactgttacgagacaagngactaataagggttntttagagttgtggttcgggaacg

SEQ ID NO: 420555 - DNA, 528 bp, Homo sapiens
  misc_feature: GZ8MTXP01EDU4X.45.84.H07.1.454.CMB.2.raw
  modified_base (261)..(261): a, c, t, g, unknown or other
  modified_base (283)..(283): a, c, t, g, unknown or other
  modified_base (302)..(302): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttcctttttgctattgtagaaggtgtccactgtgaggtgcagctggtgggaggtcggggggaggcctggtcaaggccgtgggggtccctgagactctctgtgcagccctntggattcgacttcagtatttanagttgtgaaatgggtaccnccaggctccagggaagggggctggagtgggtctcgatccattagcagtagccagtggtcacgataatattaacgcaagactcagtgaaagggccgcttcaacatctccagacgacaaacgccaaagaactacaactgtaatctaacaaatagaaacagtctgagagccgaggacacggctgttactacttgtacgagacagagctataagctttgatgttgtgggg

SEQ ID NO: 420556 - DNA, 524 bp, Homo sapiens
  misc_feature: GZ8MTXP01A5ZSA.45.84.H07.1.454.CMB.2.raw
  modified_base (362)..(362): a, c, t, g, unknown or other
  modified_base (394)..(394): a, c, t, g, unknown or other
  modified_base (403)..(403): a, c, t, g, unknown or other
  modified_base (420)..(420): a, c, t, g, unknown or other
  modified_base (444)..(444): a, c, t, g, unknown or other
  modified_base (511)..(511): a, c, t, g, unknown or other
tcagacgcgatcgacacgaccggtgctcgatttagcagacgtctgtcgcgggagagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggaggcctggtcaagcctgggggtccctgagactctcctgtgcagcctctggattcgacttcagtattatagtgtgaaatgggtccgcaggctccgaggggaagggggctgggagtggggtctcagtccattagcagtagcagtggtcactaatatnttacgcagactcagtgaagggccgcttcaacntctccaganacaacgccaaagactanactggtatactaacaaatgaaacngtctagagacgacccgaggacaacgggcttggttacactgtacagaccagaagactaagaacggttnttagtgttggtgg

SEQ ID NO: 420557 - DNA, 516 bp, Homo sapiens
  misc_feature: GZ8MTXP01B6S63.45.84.H07.1.454.CMB.2.raw
  modified_base (460)..(460): a, c, t, g, unknown or other
  modified_base (482)..(482): a, c, t, g, unknown or other
  modified_base (486)..(486): a, c, t, g, unknown or other
  modified_base (500)..(500): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcggggggaggcctggtcaagccgtggggggtccctgagactctcctgtgcagcctctggattcgacttcagtatttatagtgtgaaatgggtccgccaggctccgagggaggggctggagtgggtctcatccattagcagtagcagtggtcacataatattcgcagactcagtgaagggccgcttcaacatctccagagacaacgccaaagactcactgtactactaacaaatgaaacagtctagagagccgaggacncggctgtttacacttgtacganacgngagctataaggttntttgagtgttggtggg

SEQ ID NO: 420558 - DNA, 542 bp, Homo sapiens
  misc_feature: GZ8MTXP01EMVQ0.45.84.H07.1.454.CMB.2.raw
  modified_base (383)..(383): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggagcctggtcaagccgtgggggtccctgagactctcctgtgcagcctctggattcgacttcagtatttatagtgtagaaatgggtccgccaggctccgagggaaggggctggagtgggtctcatccattagcagtagccagtggtcacataatattcgcagactcagtgaagggccnttcaacatctcagagacaacgccaagactcatgatctaaacaaatcgaaacagtctagaagcgaccgaaggaccacgggtcttaggtttacctacgttggtaacgaaggacaggagcttaaagtaagggttcttttggaagttggttgggtaacggggg

SEQ ID NO: 420559 - DNA, 547 bp, Homo sapiens
  misc_feature: GZ8MTXP01CVUU2.45.84.H07.1.454.CMB.2.raw
  modified_base (522)..(522): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcggggggaggcctggtcaaggccgtggggggtccctgagactctcctgtgcagcctctggatcgacttcagttatttatagtgtgaatgggtccgcaggctccgaggggagggctgggagtgggtctcatccattacgcagtagcagtggtcaacatatattacgcagactcagtggaacgggcccgtacttaccaacattcctaccaaggacgaacaacgaccaaagaactcaactgtaactacctaacaaatgaaactagtctagacgagccgtaaggacaccggcttacgtttcacgttgttacgaagacngatacttagtaagttcgttttaagg

SEQ ID NO: 420560 - DNA, 610 bp, Homo sapiens
  misc_feature: GZ8MTXP01B5MRP.45.84.H07.1.454.CMB.2.raw
  modified_base (240)..(240): a, c, t, g, unknown or other
  modified_base (419)..(419): a, c, t, g, unknown or other
  modified_base (548)..(548): a, c, t, g, unknown or other
tcagacgcgatcgacacgaccggtgctcgatttagcagacgtctgtcgcgggcgtagactttgtgtttctcgtagtctgctttgctcagcgtcagggtgctgctctggctcccaggtgccaaatgtgacatccagatgaaccaatctccttctaccctgtctgcatctgtaggagacagagtcaccatcacttgccgggccagtacaaagtattagtgactgggttggcctggtttttancaaggacgaaggaaacccgggggaaacgccccgtaaaggtccagatcctacgagggcgtacgtagtacgtaggaaaggtggggtacgacccgaaccgtaagggttacgaggcgggacaggtggagtcgtaggggaacaaggtaacttccactctaccaccaatccaagcagccctgacngcctgattgtatttgacttaacttctcgtagacctaagtacttgttagttttagtaggtacgggtacggacgaagggacgtaaaggtagaaatacgaaaacgtcgtaggtcgtactcgaactaaccttnttcgttgttccttacttccgttcccttaccccgtctagtcgtagacgttacgtcgttcgtcg

SEQ ID NO: 420561 - DNA, 646 bp, Homo sapiens
  misc_feature: GZ8MTXP01D1KUK.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcacgtggggctccgcttgggtttttcctttttgctattgtagaaggtgtccatgtgaggtgcagctggtgggaggtcggggggagcctggtcaagtccgtgggggtccctgagactctctgtgcagcctctggattcgacttcagtattagtagtgtagaaagtcgggtccgcgaggcctaccggaggggaagggggctagggaggtgggtctcgatccagttagcagtacgccgtagtggtacaactataaacttattaacgcaagacctacgaggtcggaaacggggccctacttacaaactactacctaccgaaggaacgaaccaaaccgaccaaaacgaacctctaaactagttaactacttaaacaaagtacgaaacctagtaccgtaggaacggacgtaccggaaaggaccgacggtctttagtttaacctacgttacgtaaacgaacgaacgttaggaactaacgttaaagttaaggttcttttaggagtttgggttcggtaacggggg

SEQ ID NO: 420562 - DNA, 539 bp, Homo sapiens
  misc_feature: GZ8MTXP01AK0DO.45.84.H07.1.454.CMB.2.raw
  modified_base (363)..(363): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttcctttttgctattgtagaaggtgtccactgtgaggtgcagctggtggaggtcggggggaggcctggtcaagccgtggggggtccctgagactctcctgtgcagcctctggatcgacttcagtatttatagtgtgaaatgggtccgccaggctccgagggaggggctgggagtgggtctcatccattacgcagtagcagtggtacncatatattacgcagactcagtgaacgggccgcttcaaacatcctaccagacgacaacgccaaagaactcactgtactactaacaaatacgaaacagtctagagcgcgacggacacggcttagtttaacttacgttggttacgaagtacaagacgacttagtaaggttcttttaagg

SEQ ID NO: 420563 - DNA, 734 bp, Homo sapiens
  misc_feature: GZ8MTXP01DYY65.45.84.H07.1.454.CMB.2.raw
  modified_base (311)..(311): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggttttccttttgctattgtagaaggtgtccactgtgaggtgcagcgtgggtgggagggtcggggggagccgtggtcaagccgtgggggtccctgacgactctcctgtgcagcctctggatcgacttcagtatttagtagtgtagaaagtgggtcccnccgaggcctaccggaagggggaagggggctgggagttgggtctacgatccctagtttacgctaaggtagctaggttcggtaccaatattaagttaactttaccgacaaggacttcgaagggttagaaacggggccctactttaccaaactacttcccaccgaaggaacgaaccaaaccggtaccaaaacggtaacctaccgtaaccgttagtaaactaaccttaaaaccggaaaattacggaaaaccaggtttcccgtaaggaaaccgggaacgggaacccccggaaaggggaaaccgttaacccgggggttacttttaaacgggttttaaccttaaacccgtttgggttaaaacccggaaggtaaaacccgaaggtaacgggtactttaaaaggttaaaaccgggtttcgttttttaagggg

SEQ ID NO: 420564 - DNA, 521 bp, Homo sapiens
  misc_feature: GZ8MTXP01DR3ZV.45.84.H07.1.454.CMB.2.raw
  modified_base (364)..(364): a, c, t, g, unknown or other
  modified_base (381)..(381): a, c, t, g, unknown or other
  modified_base (393)..(393): a, c, t, g, unknown or other
  modified_base (400)..(400): a, c, t, g, unknown or other
  modified_base (410)..(410): a, c, t, g, unknown or other
  modified_base (425)..(425): a, c, t, g, unknown or other
  modified_base (429)..(429): a, c, t, g, unknown or other
  modified_base (446)..(446): a, c, t, g, unknown or other
  modified_base (451)..(451): a, c, t, g, unknown or other
  modified_base (456)..(456): a, c, t, g, unknown or other
  modified_base (496)..(496): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggttttcctttttgctattgtagaaggtgtccatgtgaggtgcagctgggtggaggtcggggggagcctggtcaagccgtggggggtccctgagactctcctgtgcagcctctggatcgacttcagttatttatagtgtagaaatgggtccgcaggctccgagggggaaggggctgggagtgggtctcatccattagcagtagcagtgtcnatatattacgcagactnagtgaagggccnctacaanattcacaganacaacgcaaagactnactnatcaaacgaatgaaacnggtanagagngaacgagacgacgttcttagttaacacgttgaacgaaganaagatacttaagtaagttgtttaag

SEQ ID NO: 420565 - DNA, 581 bp, Homo sapiens
  misc_feature: GZ8MTXP01DIZGO.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttcctttttgctattgtagaaggtgtccactgtgaggtgcagctggtgggaggtcggggggaggcctggtcaagccgtggggggtccctgagactctcctgtgcagcctctggattcgacttcagtatttatagtgtagaaatgggtccgcaggctccgaggggaaggggctggagtgggtctcatccattagcagtagccagtggtcacataatattcgcagactcaaggtggaaacgggcccgtacttacaaactactcctacccgaagaacgaccaaacggacccaaagaacctcacttagtaacttactaaacaaattacgaactaagttcaggaagcgacccggagaccgacgggtcttaggtttactacgttgtaaccgagacgagagtctaagtaaggtctttggattggttggtaaccggggg

SEQ ID NO: 420566 - DNA, 740 bp, Homo sapiens
  misc_feature: GZ8MTXP01DZHDW.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttccttttgctattgtagaaggtgtccactgtgaggtgcagctggtggaggtcggggggagcctggtcaagccgtgggggtccctgagactctcctgtgcagcctctggattcgacttcagtatttatagtgtagaagtcggtccgcgagctcggaaggggacgggcgtggtaggtcgggtctacgtactacctagttacgacgtaaggtacgacccgtagggttcggtactaactaattaaacttaacgttaaccggactaacggtacctacgtaagggtacggggaacggggtccctacttaaccaaactactcctaaccgaaaggaaccgaaacccgaaaccgaacccgaaaacgtaacctacctaacgttacgttaaacttaaccctaaaactaaaagttacccgaaaagtccggttacgtaagggaaacggaccggtaaccccgggaaaggaaccgtaccgggttaacttttaacggtttaaacctaacggttacggtaaacgacgttaaacgaggttaacgtaacttaaaaggttaacgggtttattttaggacggtttaacgggttggggtaaacccggggg

SEQ ID NO: 420567 - DNA, 539 bp, Homo sapiens
  misc_feature: GZ8MTXP01AY7SI.45.84.H07.1.454.CMB.2.raw
  modified_base (277)..(277): a, c, t, g, unknown or other
  modified_base (293)..(293): a, c, t, g, unknown or other
  modified_base (529)..(529): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttcctttttgctattgtagaaggtgtccactgtgagtgcagctggtggagtcgggggagcctggtcaagccgtgggggtccctgagactctcctgtgcagcctctggattcgacttcagtatttanagtgtgaaatggtccncaggctccgagggaaggggctggagtgggtctcatccattagcagtagccaggtggtcacataatattcgcagactcgagtgaaggcccgcttacaacatcctaccagacgacaacgccaagactcactagtatactaacaaatcgaacagtctagaacgacgtaccggagacctcgggcttggtttaaccacagtaacgagacgagacgtctagtaacggtctttaggattcggnggtaacgggg

SEQ ID NO: 420568 - DNA, 536 bp, Homo sapiens
  misc_feature: GZ8MTXP01DON9P.45.84.H07.1.454.CMB.2.raw
  modified_base (450)..(450): a, c, t, g, unknown or other
  modified_base (461)..(461): a, c, t, g, unknown or other
  modified_base (480)..(480): a, c, t, g, unknown or other
  modified_base (507)..(507): a, c, t, g, unknown or other
  modified_base (515)..(515): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttcctttttgctattgtagaaggtgtccactgtgaggtgcagctggtggagtcgggggaggcctggtcaagcctggggggtccctgagactctcctgtgcagcctctggatcgacttcagtatttatagtgtgaaatgggtccgccaggctccgagggaggggctgggagtgggtctcgatccattagcagtagcagtgtcaacatatattacgcagactcagtgaagggccgcttacaactatctaccagagaacaacgcaaagaactacactgtaatctaacaaatgaaacngtacctgaagngaaccgaaggacacggttntacgtttaacaccgttgttaaccgaanacgaaganacttagtaagttcgttttaag

SEQ ID NO: 420569 - DNA, 569 bp, Homo sapiens
  misc_feature: GZ8MTXP01BTG4V.45.84.H07.1.454.CMB.2.raw
  modified_base (265)..(265): a, c, t, g, unknown or other
  modified_base (300)..(300): a, c, t, g, unknown or other
tcagacgcgatcgacacgaccggtgctcgatttagcagacgtctgtcgcgggcgtagactttgtgtttctcgtagtctgctttgctcagcgtcagggtgctgctctggctcccaggtgccaaatgtgacatccagatgacccaatctccttctaccctgtctgcatctgtaggagacagagtcaccatcacttgccgggccagtcaaagtattagtgactggttggcctggtatcagcagaaaccggggaagcccctaaggtccngatctacagggcgtctagtctaggaaagtggggtnccaccgaaggttcagcggcagtggatcgtgggacagaattcactctcaccaatcaagcagcctgcagcctgatgtattttgactaacttacttctagaccaaagtaacttgttaacgtttttatcgggtacgggttacgggaccgtaaaggggacggaaagggtaggaaacttacgaaaacgtacgtggtaggcctggaacctacgttattcttcgtccttcttacgttccttcccgccctagtccttggacttcgtaacgttcggtcg

SEQ ID NO: 420570 - DNA, 534 bp, Homo sapiens
  misc_feature: GZ8MTXP01BUD8W.45.84.H07.1.454.CMB.2.raw
  modified_base (394)..(394): a, c, t, g, unknown or other
  modified_base (401)..(401): a, c, t, g, unknown or other
  modified_base (405)..(405): a, c, t, g, unknown or other
  modified_base (410)..(410): a, c, t, g, unknown or other
  modified_base (424)..(424): a, c, t, g, unknown or other
  modified_base (455)..(455): a, c, t, g, unknown or other
  modified_base (468)..(468): a, c, t, g, unknown or other
  modified_base (486)..(486): a, c, t, g, unknown or other
  modified_base (498)..(498): a, c, t, g, unknown or other
  modified_base (514)..(514): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttcctttttgctattgtagaaggtgtccactgtgaggtgcagctggtggagtcggggggaggcctggtcaagccgtgggggtccctgagactctcctgtgcagccctctggattcgacttcagtatttatagttgtagaaatgggtaccgccgaggctccgaggggaaggggctggagtggggtctcgatccattagcagtagccagtggtcacataataattcgcagactcagtgaagggccncttcaanatcncaganacaacgcaaagacnactgtatctaacaaatagaacagtctagaanacgccgaaggacncggtaactgttactacgngtaacgagacgngagaactagtaagttnttgagttgttggtaacgggg

SEQ ID NO: 420571 - DNA, 614 bp, Homo sapiens
  misc_feature: GZ8MTXP01CQWC1.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttcctttttgctattgtagaaggtgtccactgtgaggtgcagcgtgggtgggaggtcggggggaggccgtggtacaaggacgtggggggtccctggagactctcctgtgcagcctctggattcgacttcagtatttatagtgtagaaagtgggtccgcaggctccgaggggaagggggctgggagtggggtctacatccattagcagtagccaggtggtcacataatattaacgcagactcgaggtacggaaacgggcccgtacttacaaactactcctacccgaagaacgaaccaaaccgaccaaagaaacctcaacgttacgtaattacctaaacgtaaaattacggaaacctagtcctaggaacggacgtcccggaagaccacgggtcttagtttaactacgttgtaaaccgagttacgagagtctaagtaagttctttagagttggttgggtaacgggg

SEQ ID NO: 420572 - DNA, 555 bp, Homo sapiens
  misc_feature: GZ8MTXP01CFU1F.45.84.H07.1.454.CMB.2.raw
  modified_base (287)..(287): a, c, t, g, unknown or other
  modified_base (479)..(479): a, c, t, g, unknown or other
  modified_base (532)..(532): a, c, t, g, unknown or other
  modified_base (535)..(535): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggttttcctttttgctattgtagaaggtgtccactgtgaggtgcagctggtggaggtcggggggagcctggtcaaggccgtggggggtccctgagactctcctgtgcagcctctggatcgacttcagtatttanagtgtgaaatgggtccgcaggctccgagggggaggggctgggagtggggtctcgatccattacgctagtagcaggtcggtcaacatatattacgcagactcaggtgaagggcccacttcaaacgtatcctaccgagaacgaaccaaacggccaaagaactcaacttagaattcctaaacaaatacgaaaccngtctagacgagcccgaaggacacggttctagtttacacgttgttacgaagacngancttaataaggttctttaagg

SEQ ID NO: 420573 - DNA, 630 bp, Homo sapiens
  misc_feature: GZ8MTXP01BFULV.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggtttttccttttgctattgtagaaggtgtccactgtgaggtgcagctggtggaggtcggggggagcctggtcaagccgtgggggtccctgagactctcctgtgcagcctctggtattcgacttcagtatttatagtgtagaaagtcgggtcccgccgaggcctccgaaggggaagggggcgtagggaggtgggtctcatccatttacgcagtagcaggtggtacactataatacttaacgctaagactacgaggtcggaaacgggccctacttacaaactactcctaccgagaacgaaccaaacggaccaaagaacctcaacttacgtacttaactaaacctaaaagtcgaaaactacgtacctaggaacgacggacccggaacggaaccgaccggtcgttacgttttaccgtacttacggtaaccgagttacgagaggtaacttaagtaaggttcgtttagagttggttcgggtaacgggg

SEQ ID NO: 420574 - DNA, 525 bp, Homo sapiens
  misc_feature: GZ8MTXP01DRYTC.45.84.H07.1.454.CMB.2.raw
  modified_base (300)..(300): a, c, t, g, unknown or other
  modified_base (392)..(392): a, c, t, g, unknown or other
  modified_base (450)..(450): a, c, t, g, unknown or other
  modified_base (458)..(458): a, c, t, g, unknown or other
  modified_base (501)..(501): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcgggggagcctggtcaagccgtggggggtccctgagactctcctgtgcagcctctggatcgacttcagtatttatagtgtgaaatgggtccncaggctccgaggggaagggggctgggagtggggtctcgatccattagcagtagcagtgtcaacatatattacgcagactcagtgaagggccnttcaaacatctccagagacaacgaccaaagaactcactgtaatctaacaaatgaaacngtctgagngaaccgaggacacggctagtttacttacgttgttacgaagacngagcttagtaaggttcttttaagg

SEQ ID NO: 420575 - DNA, 552 bp, Homo sapiens
  misc_feature: GZ8MTXP01ARQFF.45.84.H07.1.454.CMB.2.raw
  modified_base (514)..(514): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggagcctggtcaagccgtgggggtccctgagactctcctgtgcagcctctggattcgacttcagtatttatagtgtgaaatgggtccgccaggctccgagggaagggggctggagtgggtctcgatccattagcagtagccaggtgtcacataatattcgcagactcagtgaaacgggcccgcttacaacatcctccaagacgacaaacgcccaaagactacactagtactactaaacaaataggaactagttcagacgagacccgaggaccagggtcttaggtttactaccgttggtaaccgaggacngagctagtaaggttctttagagtggttggtaacggggg

SEQ ID NO: 420576 - DNA, 635 bp, Homo sapiens
  misc_feature: GZ8MTXP01CRM32.45.84.H07.1.454.CMB.2.raw
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttccttttgctattgtagaaggtgtccactgtgaggtgcagctggtgggagtcgggggaggcctggtcaagccgtggggggtccctgagactctcctgtgcagcctctggatcgacttcagtatttatagtgtgaatgggtccgccaggctccgaggggagggctgggagtgggtctcgatccattacgcagtgcagtggcaacatatattacgcagactcaggttgaaacggggccgtacttaccaaactagttcctaccgaaggaacgaaccaaaccgacccaaaaggaaaccttacgaaccttaggtaaactacccttaaaacaaaacgttacgaaaacctaggttaccagggaacgaacggcccggaaagggaccgtaaaccgggttcgtttacggtttaacttaccgttaggttaaaccggaagggtaaccaagggtaacgtaccgttaaacgttaagggttcgtttttaaggg

SEQ ID NO: 420577 - DNA, 620 bp, Homo sapiens
  misc_feature: GZ8MTXP01DDJ1O.45.84.H07.1.454.CMB.2.raw
  modified_base (506)..(506): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttcctttttgctattgtagaaggtgtccactgtgaggtgcagctgggtgggaggtcggggggaggcctggtcaaggccgtggggggtccctgagactctcctgtgcagcctctggattcgacttcagtatttatagtgtagaaagtgggtcccgcgaggcctccgaggggaaggggctggagtggggtctcgatcctattagacgagtagcccaggttacggttcaactataaacttaatttaacggcaagaccttagaggtacggaaacgggggccccactttacaaaccattccaccgaagaacgaacaaccgacccaaagaacctcatacgtatactaacaaatacgaaacngttcaggaagacgccggaggacgacggtaacttagtttactacgttacgtaaccgagaccgttaggacgtcttaaagtaaggttcttttggaattgggttcggggtaacggggg

SEQ ID NO: 420578 - DNA, 520 bp, Homo sapiens
  misc_feature: GZ8MTXP01EYMYA.45.84.H07.1.454.CMB.2.raw
  modified_base (384)..(384): a, c, t, g, unknown or other
  modified_base (392)..(392): a, c, t, g, unknown or other
  modified_base (395)..(395): a, c, t, g, unknown or other
  modified_base (488)..(488): a, c, t, g, unknown or other
  modified_base (492)..(492): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggagcctggtcaagcctggggggtccctgagactctcctgtgcagcctctggattcgacttcagtatttatagtgtgaaatgggtccgccaggctccgagggaaggggctggagtgggtctcatccattagcagtagccaggtgtcacataatattaacgcagactcagtgaagggccncttcaacntcnccagacgacaacgccaaagacctcaactgtatactaacaaatcgaaacagtctagagagccgaggacacggctgtttacacttgtacgagacngagntagtaaggctttgatggttcgtaagggg

SEQ ID NO: 420579 - DNA, 556 bp, Homo sapiens
  misc_feature: GZ8MTXP01AL8FC.45.84.H07.1.454.CMB.2.raw
  modified_base (306)..(306): a, c, t, g, unknown or other
  modified_base (365)..(365): a, c, t, g, unknown or other
  modified_base (506)..(506): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggttttcctttttgctattgtagaaggtgtccactgtgaggtgcagctggtggaggtcggggggagcctggtcaaggccgtggggggtccctgagactctcctgtgcagcctctggatcgacttcagttatttatagtgtagaagtgggtccncaggctccgaggggagggctgggaggtggtctcatccattacgcagtagcagtggtacncatatatacgctagactacgagtggaacgggcctacttacaaactatcctaccaaggaccgaaccaaaccgaccaaagtactcattgtaactactaacaatagaaacctgttcaggagacggcccgtaagaccgacggttnttacgtttacacgttgaaccgaagacaagatcttagtaagttctttaagg

SEQ ID NO: 420580 - DNA, 748 bp, Homo sapiens
  misc_feature: GZ8MTXP01CRCI1.45.84.H07.1.454.CMB.2.raw
  modified_base (286)..(286): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttccttttgctattgtagaaggtgtccactgtgaggtgcagcgtggtggaggtcgggggagcctggtcaaggtccgtgggggtccctgacgactctccgtgtcgcagcctcgtggtattcgacttcagtatttanagtgtagaagtcggtccgcaggctaccggaggggtaagggctaggagtcgggtctacgactaccgtagttacgacgtagtacgaccgtaggttacgtactaacctagttaaacgttacgttaaccggacgtaaacggtaacccgttcggaaggtacggggtaaccggggtccccttacgtttaaccgaaaccgttacgtacccgttaacccgaaagggtaaacctaaacccggtaaacccgtaccccgtaaaacggttacccttaaccgtaacgtttaacggttaaccttaacccgtaaaacgtaaaacgtcggtaaaaccgttcggtttacccgaggtaaacggaccggttaaccgaacggtaccgtacgtcgtttaacgttacgtacgttacgtaaacgcgaaaccgttgacgttaacgttagtaacgtttcgttagacggtttggttcgggtaaccggg

SEQ ID NO: 420581 - DNA, 603 bp, Homo sapiens
  misc_feature: GZ8MTXP01AZ5LQ.45.84.H07.1.454.CMB.2.raw
  modified_base (376)..(376): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttcctttttgctattgtagaaggtgtccactgtgaggtgcagctggtgggaggtcggggggaggcctggtcaaggccgtggggggtccctgagactctcctgtgcagcctctggatcgacttcagtatttatagtgtagaagtgggtccgcaggctccgaggggaaggggctgggagtgggtctcatccattcgcagtagcagtgtcaacatatatacgnagactcagtgaacgggccgcttacaactaactcctaccagaacgaaccgaaaccggaccaaacggaacctactaaccgttaggttaaactaccttaaaccaaaaagtcgtaaaacacggttacctaggaacggaacggaacccgaagggaccaacgggttcgttaggttttaaccttacgttggttacgaagacgaagagtacttaaagttaaggttcgttttaagg

SEQ ID NO: 420582 - DNA, 526 bp, Homo sapiens
  misc_feature: GZ8MTXP01DTYUW.45.84.H07.1.454.CMB.2.raw
  modified_base (327)..(327): a, c, t, g, unknown or other
  modified_base (395)..(395): a, c, t, g, unknown or other
  modified_base (430)..(430): a, c, t, g, unknown or other
  modified_base (492)..(492): a, c, t, g, unknown or other
tcagacgcgatcgacacgaccggtgctcgatttagcagacgtctgtcgcgggggagagaggagccttagccctggattccaaggcctatccacttggtgttcagcactgagcaccgaggattcaccatggcactggggctccgctgggttttccttttgctattgtagaaggtgtccactgtgaggtgcagctggtggagtcggggggaggcctggtcaagcctggggggtccctgagactctcctgtgcagcctctggattcgacttcagtattatagtgtgaaatgggtccgccaggctccaggggaagggctggagtgggtctnatccattagcagtagcagtggtcacatataattacgcagactcagtgaagggccgcttcaaacattcnccaagacgaacaacgccaaagaacttcaactgtanactaaacaaatagaaacagtctgagagccgaggactacggctgtttacactgttaagagaanagagataatagtgttgtagttgtggttgggaacg

SEQ ID NO: 420583 - DNA, 596 bp, Homo sapiens
  misc_feature: GZ8MTXP01AGMTM.45.84.H07.1.454.CMB.2.raw
  modified_base (513)..(513): a, c, t, g, unknown or other
  modified_base (554)..(554): a, c, t, g, unknown or other
  modified_base (573)..(573): a, c, t, g, unknown or other
  modified_base (585)..(585): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttccttttgctattgtagaggtgtccatgtgaggtgcagctggtgggaggtcggggggaggccgtggtcaaggccgtgggggtccctgagactctcctgtgcagcctcgtggattcgacttcagtatttatagtgtagaaagtgggtccgcgaggctaccggaggggaggggcgtggaggtgggtctcatccattagctagtagccagtgtacacataattacttaacgacagactcgaggtaggaaacggggccctcttacaactactctaccaagacgaaccgaacgccaaaagacctacacttagtaacttactaaactaaatacgaaacctagtcaggacgacggaccggaggaaccnccgggtctttacgtttacgtacgttacgtacgaagcgaagngtaacttagtaacgggttntttggagttggngggtaacgggg

SEQ ID NO: 420584 - DNA, 532 bp, Homo sapiens
  misc_feature: GZ8MTXP01BZ73I.45.84.H07.1.454.CMB.2.raw
  modified_base (385)..(385): a, c, t, g, unknown or other
  modified_base (392)..(392): a, c, t, g, unknown or other
  modified_base (432)..(432): a, c, t, g, unknown or other
  modified_base (441)..(441): a, c, t, g, unknown or other
  modified_base (497)..(497): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcgggggaggcctggtcaagcctggggggtccctgagactctcctgtgcagcctctggattcgacttcagtatttatagtgtgaaatgggtccgccaggctccgagggaggggctggagtgggtctcatccattagcagtagccagtggtcacataatattcgcagactcagtgaacgggccgnttcaacntctccagacgacaacgaccaagaactcactagtatctaanaatgaaacngtctagaagacgccggaggacacgggcttacggtttacacgttagtaccgagacgngagctaagtaaggtcttttgattggttcggtgggg

SEQ ID NO: 420585 - DNA, 555 bp, Homo sapiens
  misc_feature: GZ8MTXP01CWTIA.45.84.H07.1.454.CMB.2.raw
  modified_base (362)..(362): a, c, t, g, unknown or other
  modified_base (528)..(528): a, c, t, g, unknown or other
  modified_base (548)..(548): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggttttccttttgctattgtagaaggtgtccactgtgaggtgcagcgtgggtgggaggtcggggggagcctggtcaaggccgtgggggtccctgagctctcctgtgcagcctctggatcgacttcagtatttatagtgtgaaatgggtccgcaggctccgagggaggggctgggagtgggtctcgatccattacgcagtagcagtgtcncatactattacgcagactcagttgaacgggcccgtattacaacatcctaccgaagacgaacaaccgtaccaaagtaactcacgtgtaactactaaacaaatgaaacagtctagacggacgaaccgtaagacgtacgggcttacggttacttacgttgaccgaaganaagagtcttaagtaacgttntttaagg

SEQ ID NO: 420586 - DNA, 581 bp, Homo sapiens
  misc_feature: GZ8MTXP01A6SCZ.45.84.H07.1.454.CMB.2.raw
  modified_base (446)..(446): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcgggggaggcctggtcaagccgtgggggtccctgagactctcctgtgcagcctctggattcgacttcagtatttatagtgtagaagtgggtccgcaggctccgagggagggctggagtgggtctcatccattagcagtagccagtggtcacataatattcgcagactcgagtgaacgggcctcttcaacagtctaccagacgacaacgaccaaagactcactgtatactaacaaatacgaaacngtctaggaacgagcccggaaggaccgacggtcttacggttttacctacgttaggtaaccgaaggaaccgaggttacgtaaccgttaagttaaagggttccgtttttaggaagtttcgggttggggtaaccggggg

SEQ ID NO: 420587 - DNA, 530 bp, Homo sapiens
  misc_feature: GZ8MTXP01BBVDS.45.84.H07.1.454.CMB.2.raw
  modified_base (361)..(361): a, c, t, g, unknown or other
  modified_base (414)..(414): a, c, t, g, unknown or other
  modified_base (420)..(420): a, c, t, g, unknown or other
  modified_base (448)..(448): a, c, t, g, unknown or other
  modified_base (454)..(454): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggtttttcctttttgcttattgtagaaggtgtccactgtgaggtgcagcgtgggtggaggtcggggggagccgtggtcagccgtgggggtccctgagctctcctgtgcagcctctggatcgacttcagtatttatagtgtgaaatggtccgcaggctccgagggagggctggagtgggtctcatccattacgcagtagcagtggtacncgatatacttacgacagactcagtgaaggccgtcttacgaacatcctacaganacaacnccaaagaactcactgtatactaacaaangaaacntcctagagagccgaaggcacggcgtacgttattaccgttgttacgaagtaccaagacattagtaagttctttaagg

SEQ ID NO: 420588 - DNA, 593 bp, Homo sapiens
  misc_feature: GZ8MTXP01BADZL.45.84.H07.1.454.CMB.2.raw
  modified_base (493)..(493): a, c, t, g, unknown or other
  modified_base (539)..(539): a, c, t, g, unknown or other
  modified_base (546)..(546): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttcctttttgctattgtagaaggtgtccatgtgaggtgcagcgtggtggaggtcgggggagcctggtcaaggccgtgggggtccctgagactctcctgtgcagcctcgtggattcgacttcagtatttatagtgtagaaagtcggtccgcaggctcggagggagggctggagtggtctcatccattagctagtagccaggtgtcactattaataattaacgctaagacctcgaagtacgggaaacgggcccgtacttacaaactactcctaccaagtaacgaacaacgacaaagaactcaacttgaatactaaacgaaatacgaaactagtcgtaggaacgngacccggaagaccacgggtcttacggtttacacgttacgtaaacgngaaccgngacgtaactaagtaaggttctttaggacgttgggttggtaaccgggg

SEQ ID NO: 420589 - DNA, 568 bp, Homo sapiens
  misc_feature: GZ8MTXP01BFBZY.45.84.H07.1.454.CMB.2.raw
  modified_base (443)..(443): a, c, t, g, unknown or other
  modified_base (453)..(453): a, c, t, g, unknown or other
  modified_base (515)..(515): a, c, t, g, unknown or other
  modified_base (539)..(539): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttccttttgctattgtagaaggtgtccatgtgaggtgcagctggtggaggtcgggggaggcctggtcaaggccgtgggggtccctgagactctcctgtgcagcctctggattcgacttcagtatttatagtgtagaaagtcgggtaccgcaagctccgaggggagggctggagtgggtctcatccattgcagtagcagtgcacataatacttcgcagactcgagtggaacgggcccgcttacaactatcctaccaagacgaacaaacgccaaagaactcactgtatactaanaaatgaaacngtctaggaacgacgaccggaggacgacggctttcgtttaacctacgttagtaacgagaacgngttagaacgttaagtaacgggttnttttagagttgggttgggttaaccggggg

SEQ ID NO: 420590 - DNA, 554 bp, Homo sapiens
  misc_feature: GZ8MTXP01BVNYQ.45.84.H07.1.454.CMB.2.raw
  modified_base (211)..(211): a, c, t, g, unknown or other
  modified_base (252)..(252): a, c, t, g, unknown or other
  modified_base (265)..(265): a, c, t, g, unknown or other
  modified_base (299)..(299): a, c, t, g, unknown or other
  modified_base (352)..(352): a, c, t, g, unknown or other
tcagacgcgatcgacacgaccggtgctcgatttagcagacgtctgtcgcgggcgtagactttgtgtttctcgtagtctgctttgctcagcgtcagggtgctgctctggctcccaggtgccaaatgtgacatccagatgacccaatctccttctaccctgtctgcatctgtaggagacagagtcaccatcacttgccgggccagtcaaagtnttagtgactggttggcctggtatcagcagaaaccggggaancccctaaggtccngatctacagggcgtctagtctagaaagtggggtnccacaaggttcagcggcagtggatctgggacagaacttcactctcaccaatcngcagccctgcaggcctgatgtatttgctaacttactctgaccaagaactgtagttttatcggtacggttcggaccgtaagggacgtaaaggtggaaattacaaaacgtacgtagtcgggtctggctacccattcccttgttcctttcactttcccttaccccggcctacttccttggtacttccgtaacgttccggtccggg

SEQ ID NO: 420591 - DNA, 718 bp, Homo sapiens
  misc_feature: GZ8MTXP01CYJXU.45.84.H07.1.454.CMB.2.raw
  modified_base (312)..(312): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggtttttcctttttgctattgtagaaggtgtccatgtgaggtgcagcgtgggtgggaggtcggggggagccgtggtcaaggccgtgggggtccctgacgactctcctgtgcagcctctggtatcgacttcagttatttatagtgtagaaagtgggtccncgagggcctaccggaagggggagggctgggagtgggtctcatcattacgcagtgcagtcgtcaactatatattacgcagtactcgagtaggaacgggccctacttacaaacagttcctaccaaaggaacggaaaccaaaccggacccaaaacggtaacccttacaaaccgtttagtaaacctttacctaaaaaccgaaaagtttcggaaaaacccgtaggtttaaccctagggaaacgggacccgggtaaacccggaaggggaaacccttaacccgggggttccttttaaacgggttttaaccttaaacccggggttttggttaaaacccgggaaaggaaaacccgtaagggtaaacgggttacccgtttaaaagggtttaaccgggttcgtttttttaaaggggg

SEQ ID NO: 420592 - DNA, 591 bp, Homo sapiens
  misc_feature: GZ8MTXP01AJZKP.45.84.H07.1.454.CMB.2.raw
  modified_base (175)..(175): a, c, t, g, unknown or other
  modified_base (208)..(208): a, c, t, g, unknown or other
  modified_base (249)..(249): a, c, t, g, unknown or other
  modified_base (308)..(308): a, c, t, g, unknown or other
  modified_base (382)..(382): a, c, t, g, unknown or other
tcagacgcgatcgacacgaccggtgctcgatttagcagacgtctgtcgcgggcgtagactttgtgtttctcgtagtctgctttgctcagcgtcagggtgctgctctggctcccaggtgccaaatgtgacatccagatgaaccaatctccttctaccctgtctgcatctgtagganacagagtcacatcacttgccggcagtcaaagtntagtgactggtgctggtatcagcgaaggaaaccggggaacncccctaaggtccaggactacgtacgagggcgtctagtcgtaaggaaaggtcgggggtanaccccgaacgtaaggttcaggcggcgaggtgggatcgtaggggactagtaaccttcgactcgtacaccaatcgngcacgcctgccagtcctgattgtatttcgacttaacttcttcacgtacctaagtacgttagttagttttagttcgggtacgggttacgggacgtaaaggacgaaggttagaaacgtacgtaaaccgtagtgtacggtctcggctaaccttgtccttagttcctacttaccttccttccccgtcacttctgacttcgtaacgttcgtccg

SEQ ID NO: 420593 - DNA, 617 bp, Homo sapiens
  misc_feature: GZ8MTXP01CWJV1.45.84.H07.1.454.CMB.2.raw
  modified_base (189)..(189): a, c, t, g, unknown or other
  modified_base (260)..(260): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttccttttgctattgtagaaggtgtccactgtgaggtncagctggtggaggtcggggggaggcctggtcaaggccgtggggggtccctgagactctcctgtgcagcctntggattcgacttcagtattatagtgtgaaagtggtccgcaggctcgagggaaggggctggagtgggtctcatccattagcagtagcctaggtggtcacgtataaattacgttaacgacagtactacgaggtacgaaacggggcccgtactttacaaaccacttactacccaagaacggaaccaaacgacccaaagaaacctacactagtatactaaacaaatacgaaacctagtacgtagaacggacgacccggaggaacctacgggtcttacggttactacgttcgttaacgaagttaacgaggacgtaacgttaagtaaacgggttctttaggagttgggttgggtaaccggggg

SEQ ID NO: 420594 - DNA, 549 bp, Homo sapiens
  misc_feature: GZ8MTXP01CP57B.45.84.H07.1.454.CMB.2.raw
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttccttttgctattgtagaaggtgtccactgtgaggtgcagctgggtgggaggtcggggggaggcctggtcaagccgtggggggtccctggagactctcctgtgcagcctctggatcgacttcagtatttatagtgtgaaatgggtccgcaggctccgagggaaggggctgggagtgggtctcgatccattagcagtagcagtgtacaacatatattacgcagactcagtagaacggggccacttcaaacattccaccaagacgaacaacgaccctaaagactacgacttgtaatacctaacaaatagaacagtactagagagaacgacggacgacggcgtagttacttacgttcgttacgaagacgaagagacgttagtaagttgtttaagg

SEQ ID NO: 420595 - DNA, 575 bp, Homo sapiens
  misc_feature: GZ8MTXP01AVXH4.45.84.H07.1.454.CMB.2.raw
  modified_base (397)..(397): a, c, t, g, unknown or other
  modified_base (474)..(474): a, c, t, g, unknown or other
  modified_base (552)..(552): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggtttttcctttttgctattgtagaaggtgtccactgtgaggtgcagctggtggaggtcggggggagcctggtcaagccgtggggggtccctgagactctcctgtgcagcctctggattcgacttcagtatttatagtgtagaaatgggtccgccaggctccgaggggaaggggctgggagtgggtctcgatccattagcagtagccaggtggtcacataatattcgcagactcgagtgaaacggggcccncttacaactatcctaccaaggaacgaaccaaaccggaccaaagaacctcaacttgtaatactaacaaatcgaaaccngtcagacgagcccgaaggaccaacgggtcttaggttactacttggtaaccgagacgagataactaagtaacgggtttnttaggagtgggttgggtaacggg

SEQ ID NO: 420596 - DNA, 553 bp, Homo sapiens
  misc_feature: GZ8MTXP01DQZKJ.45.84.H07.1.454.CMB.2.raw
  modified_base (481)..(481): a, c, t, g, unknown or other
  modified_base (513)..(513): a, c, t, g, unknown or other
  modified_base (530)..(530): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttcctttttgctattgtagaaggtgtccactgtgaggtgcagctggtggaggtcggggggagcctggtcaagccgtggggggtccctgagactctcctgtgcagcctctggattcgacttcagtatttatagtgtagaaagtgggtccgcaggctccgagggaaggggctggagtgggtctcgatccattagcagtagccagtggtacacataatatcgcagactcagtgaacgggccgtacttacaacatctaccaagacgaacaacgaccaaagactcactgtaactactaaacaaatagaaacagtctagaacgagccgaggaaccncgggtcttcgttactacgttgtaacgagaacngacgtctaagtaacgtntttgagttggttgggtaacgggg

SEQ ID NO: 420597 - DNA, 518 bp, Homo sapiens
  misc_feature: GZ8MTXP01A5YRI.45.84.H07.1.454.CMB.2.raw
  modified_base (295)..(295): a, c, t, g, unknown or other
  modified_base (381)..(381): a, c, t, g, unknown or other
  modified_base (389)..(389): a, c, t, g, unknown or other
  modified_base (439)..(439): a, c, t, g, unknown or other
  modified_base (484)..(484): a, c, t, g, unknown or other
  modified_base (500)..(500): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggagcctggtcaagccgtggggggtccctgagactctcctgtgcagcctctggattcgacttcagtatttatagtgtagaaatgggtccncaggctccgagggaggggctggagtgggtctcatccattagcagtagccagtggtcacataatatcgcagactcagtgaagggccncttcaacntctccagacgacaacgaccaaagactcactgtactctaacaaatcgaacngtctgagagccgaggacacggctggttacacgttgtacgagacgngagctagtaacggttntttagagtggttggtggg

SEQ ID NO: 420598 - DNA, 606 bp, Homo sapiens
  misc_feature: GZ8MTXP01BSGGG.45.84.H07.1.454.CMB.2.raw
  modified_base (557)..(557): a, c, t, g, unknown or other
  modified_base (581)..(581): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcacatggcactgggctccgcttgggttttccttttgctattgtagaaggtgtccatgtgaggtgcagcgtggtggaggtcgggggagccgtggtcaaggccgtgggggtccctgagactctctgtgcagcctcgtggattcgattcagtattatagtgtagaaagtggtccgcgaggctcggagggaagggcgtagggagtgggtctacgactccgagttagctaagtagaccaggtagtacaactataaattaataaccgacacgtacgtacgaggtacggacggtcctactacaactactactacgaacgaacgaaccgaaccgaacaaacgtaactactaacgttagtaactaactaaataaacgtacgaaacgtgtacgagaacggacgacgaacgacgtacgtaacttacgttactacgttagtaacganacgagacgtaataagttaacgttnttaggttagtggttcgggtaacggg

SEQ ID NO: 420599 - DNA, 559 bp, Homo sapiens
  misc_feature: GZ8MTXP01D7WH9.45.84.H07.1.454.CMB.2.raw
  modified_base (312)..(312): a, c, t, g, unknown or other
  modified_base (478)..(478): a, c, t, g, unknown or other
  modified_base (531)..(531): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggttttcctttttgctattgtagaaggtgtccactgtgaggtgcagctgggtgggaggtcggggggaggccgtggtcaaggccgtggggggtccctggagctctcctgtgcagcctctggatcgacttcagttatttatagtgtagaaagtgggtcccncaggctccgaaggggaaggggctgggaggtgggtctcatccattacgcagtgcagtgcaacatatattacgcagactacagtagaagggcccgtacttacaaactactcctaccagacgaaccaacgaccaaagactacactagtactactaaacaaatgaaaccngtcagacgacgaacggaagacgacggcttagttaccttagttcgttaacgaanacaagagacttataacggttctttaagg

SEQ ID NO: 420600 - DNA, 560 bp, Homo sapiens
  misc_feature: GZ8MTXP01DCMU7.45.84.H07.1.454.CMB.2.raw
  modified_base (303)..(303): a, c, t, g, unknown or other
  modified_base (531)..(531): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttcctttttgctattgtagaaggtgtccactgtgaggtgcagctggtggaggtcgggggagcctggtcaagccgtggggggtccctgagactctcctgtgcagcctgtggatcgacttcagtatttatagtgtagaaatggggtccnccgaggcctccgaggggagggggctgggagtgggtctcgatccatttcgctaggtagctaggtcggtacaactatataacttacgcagtactcaggtcggaacgggccgcttacaacatcctacagacaccaacgaccaaagactacacttagtactactaacaaattcgaaactgtctagacgagaacccgaggctacggttcttagtttaacacgttgttaaccgnaacaagagcttagtaacgttcttttaagg

SEQ ID NO: 420601 - DNA, 526 bp, Homo sapiens
  misc_feature: GZ8MTXP01AWWW4.45.84.H07.1.454.CMB.2.raw
  modified_base (387)..(387): a, c, t, g, unknown or other
  modified_base (391)..(391): a, c, t, g, unknown or other
  modified_base (394)..(394): a, c, t, g, unknown or other
  modified_base (495)..(495): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggagcctggtcaagcctggggggtccctgagactctcctgtgcagcctctggattcgacttcagtatttatagtgtgaaatgggtccgccaggctccgagggaaggggctggagtgggtctcgatccattagcagtagccagtggtcacataatattaacgcagactcagtgaaggcgcttnaacntcnccagagacaacgcaaagactcactgtactactacaaatgaaacagtctagagacgccgaaggacacggcttagttactacgttgtaaccgagacgagacgntagtaacgtcttttgatggttggtaacgggg

SEQ ID NO: 420602 - DNA, 684 bp, Homo sapiens
  misc_feature: GZ8MTXP01C8JVF.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttcctttttgctattgtagaaggtgtccactgtgaggtgcagcgtggtgggaggtcggggggagcctggtcaaggccgtggggggtccctgagactctcctgtgcagcctctggattcgacttcagtatttatagtgtagaaagtgggtccgcgaggctccgagggaaggggctggagtgggtctcatccattagcagtagccgaggtggtacaacgattaaatatttaacggctaaggtaacctcgaaggtagggaaacggggccctactttacaaactactcctccaagaacgacaaccgaccaaagactacacttagtaactacctaaacgtaaatacggaaacagtaccgtaggaaacgacggaccggaacgggaacctaaccgggggtaactttacggttttaaacccgttaaacgttacgggttaaacgaacggttaaaccgttaaggaacggttaaccgttaaaagttaaaccgggttttacgttttagggttacggtttggggttaacggggttaaccggggggg

SEQ ID NO: 420603 - DNA, 603 bp, Homo sapiens
  misc_feature: GZ8MTXP01BXFT5.45.84.H07.1.454.CMB.2.raw
  modified_base (518)..(518): a, c, t, g, unknown or other
  modified_base (554)..(554): a, c, t, g, unknown or other
  modified_base (578)..(578): a, c, t, g, unknown or other
  modified_base (585)..(585): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttcctttttgctattgtagaaggtgtccattgtgaggtgcagctggtggaggtcggggggagcctggtcaagccgtggggggtccctgagactctcctgtgcagcctctggattcgacttcagtatttatagtgtagaaagtgggtccgcaggctcgagggaggggctggagtgggtctcgatccattagcagtagccaggtgtacacataatatcgcagactcaggtaggaacggggccctacttacaaactatcctaccgaaggaacgaaccgaaaccggacccaaagaaaccctcaaccttaggttaactactaaacaaaagttacggaaacctagttccgagaacggacgacccggaaggaccncgggtcctttagtttactacgttgtaacgattacgnggagtaacttaagtaacgggtttntttaggngttgggttcgggtaaggg

SEQ ID NO: 420604 - DNA, 603 bp, Homo sapiens
  misc_feature: GZ8MTXP01BFFBO.45.84.H07.1.454.CMB.2.raw
  modified_base (478)..(478): a, c, t, g, unknown or other
  modified_base (553)..(553): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggtttttcctttttgctattgtagaaggtgtccactgtgaggtgcagctgggtgggaggtcggggggaggccgtggtcaaggccgtggggggtccctgagactctcctgtgcagcctctggattcgacttcagtatttatagtgtagaaagtcgggtccgcgaggctcgaggggaggggctgggagtggtctcatccattacgctagtagccaggtgtacactataatatcgcagactgaggtcggaacggggtccctacttacaactactaccaccgaagaacgaaccaaacggaaccaaacgtaacctacaacttcgtaactactaaanaaactacgaaactcgtactaggaacgacgccggaagaccgtacggtctttagtttactacgttacggtaacgaanacgagacgtaacttaagtaacgttagtttgagttggttgggtaaccgggg

SEQ ID NO: 420605 - DNA, 649 bp, Homo sapiens
  misc_feature: GZ8MTXP01AYVOK.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcggggggaggcctggtcaagccgtgggggtccctgagactctcctgtgcagcctctggattcgacttcagtatttatagtgtagaaagtcgggtcccgcaggcctccgaggggaaggggctgggagtgggtctcatccattagcagtagccagtggtcacataataattcgactacgacttacgaggttacgggaaacggggtcccgtactttacaaactactccgtacccaaggaacgaaccaaaccgacccaaaacgaaccttaccaacgttacggttaacttacctaaacaaaacgttacgaaactacggtacctaggaacggacggaccggaagggaaccgacgggtctttaacgtttaccgtaacgttcggtaaacggaagttaccgagacgtaaccgttaagtaacggttcgttttagaggttgttcggggtaaccggggg

SEQ ID NO: 420606 - DNA, 597 bp, Homo sapiens
  misc_feature: GZ8MTXP01AOCOM.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttcctttttgctattgtagaaggtgtccactgtgaggtgcagctggtgggaggtcggggggaggcctggtcaagccgtgggggtccctgagactctcctgtgcagcctctggtattcgacttcagtatttatagtgtgaaatgggtccgccaggctccgaggggaaggggctgggagtgggtctcatccattagctagtagccaggtggtacacattaatacttcgcagactacgagttacgggaaacggggcctaccttacaaacactctacccaaggaacgaaccaaaccgacccaaagtaaccctacaacttacgtaactactaaacaaatacgaaactagtcctaggaacggacggacccggaagggaccacgggtcttagttactaacttggtaacgagacgagacgaactataaggttctttagatggttgggtaacggg

SEQ ID NO: 420607 - DNA, 554 bp, Homo sapiens
  misc_feature: GZ8MTXP01DHUWJ.45.84.H07.1.454.CMB.2.raw
  modified_base (440)..(440): a, c, t, g, unknown or other
  modified_base (479)..(479): a, c, t, g, unknown or other
  modified_base (519)..(519): a, c, t, g, unknown or other
  modified_base (531)..(531): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttcctttttgctattgtagaaggtgtccattgtgaggtgcagctggtgggaggtcggggggaggcctggtcaaggccgtgggggtccctgagactctcctgtgcagcctctggattcgacttcagtatttatagtgtagaaagtgggtcccgcaggctccgagggaagggggctgggagtgggtctcgatccattagcagtagccaggtgtacacataatatcgcagactcagtgaaacgggcccacttacaactatctaccagaacgacaacgccaaagaactcactntatactaacaaatgaacagtcagaacgacgaccgagacncgggtcttgttactacgttagtaacgaggttacagacgtntaagtaacggtntttagagttggttggtaacgggg

SEQ ID NO: 420608 - DNA, 653 bp, Homo sapiens
  misc_feature: GZ8MTXP01EG6G0.45.84.H07.1.454.CMB.2.raw
  modified_base (279)..(279): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggtttttccttttgctattgtagaaggtgtccactgtgaggtgcagctggtggaggtcggggggagcctggtcagccgtgggggtccctgagactctcctgtgcagcctctggattcgacttcagtatttanagtgtagaagtggtccgcaggctcggagggagggctggagtggtctcatccattagcagtagcaggtgtacactattaatacttaacgcaagtactctagggtacgggaacggggtccctacttaccaaactcttaccacccgaaagaacgaaccaaaccgaccaaacgaacctctaacgttactaatactaaacaaattacggaaactagtacgtaggaaacgcggtaaccggaagggaaccgtaccgggtcttttaacgtttaaaccgtaaccgtttagggtaaaccgtaacggaaaccgttaggaaacgtaacgtttaaaggtaacggtttcgtttttaggacgtttggggttaacggggttaaccggggg

SEQ ID NO: 420609 - DNA, 515 bp, Homo sapiens
  misc_feature: GZ8MTXP01BS02D.45.84.H07.1.454.CMB.2.raw
  modified_base (298)..(298): a, c, t, g, unknown or other
  modified_base (333)..(333): a, c, t, g, unknown or other
  modified_base (441)..(441): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggagcctggtcaagccgtgggggtccctgagactctcctgtgcagcctctggatcgacttcagtatttatagtgtgaaatgggtccnccaggctccgagggaaggggctgggagtgggtctnatccattacgcagtagcagtgtcaacatatattacgcagactcagtgaagggccgcttcaacatctaccagagacaacgcaagactcactgtatctacaaatgaaacngtctgagagccgaaggacacgggctagtttaacagttgttacgaagacaagagtcttataagggttcttttaag

SEQ ID NO: 420610 - DNA, 537 bp, Homo sapiens
  misc_feature: GZ8MTXP01AYXOD.45.84.H07.1.454.CMB.2.raw
  modified_base (397)..(397): a, c, t, g, unknown or other
  modified_base (495)..(495): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttccttttgctattgtagaaggtgtccactgtgaggtgcagctggtggagtcggggggaggcctggtcaagccgtggggggtccctgagactctcctgtgcagcctctggatcgacttcagttatttatagtgtagaagtgggtccgccaggctccgaggggagggggctgggagtgggtctcgatccattacgcagtagcagtgtcaacatatatacgcagactcgagtggaacgggccncttacaatatctccaagacgaacaacgccaaagactacacttgaactctaacaaatgaaactgtcctagagacgccgaggaccacggcttagttaccngttgaccggaagacaaggagtattaagtaaggttctttaagg

SEQ ID NO: 420611 - DNA, 621 bp, Homo sapiens
  misc_feature: GZ8MTXP01DGMJX.45.84.H07.1.454.CMB.2.raw
  modified_base (389)..(389): a, c, t, g, unknown or other
  modified_base (403)..(403): a, c, t, g, unknown or other
  modified_base (594)..(594): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagcgtggtggaggttggggggaggcctggtcaagccgtgggggtccctgagactctcctgtgcagcctctggattcgacttcagtatttatagtgtagaaagtgggtcccgccaggcctaccgagggggaaggggccgtagggaggtgggggtctcgaatccattagcagtagcagtggtcacataatattcgcagactnagtgaacgggcccncttacaacatcctaccagaacaaccaacgaccaaagaactcaactgtaactactaaacaaaagtcgaaaccgtagtaccgtagaaacgacggtacccggaaggtaaccgtaccgggtaactttaacggtttttaaaccgtacgttacggtaaacggaacgttaacgagacgtaacgttaaagtaacggttntttagagtttggttcgggtaacggggg

SEQ ID NO: 420612 - DNA, 581 bp, Homo sapiens
  misc_feature: GZ8MTXP01A4M6D.45.84.H07.1.454.CMB.2.raw
  modified_base (366)..(366): a, c, t, g, unknown or other
  modified_base (480)..(480): a, c, t, g, unknown or other
  modified_base (491)..(491): a, c, t, g, unknown or other
  modified_base (573)..(573): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactgggctccgctgggttttcctttttgctattgtagaaggtgtccactgtgaggtgcagctggtggaggtcgggggagcctggtcaagccgtgggggtccctgagactctcctgtgcagcctcgtggatcgacttcagttatttagtagtgtagaaagtcgggtccgcgaggctccgagggggagggctgggagtgggtctcgatccattacgctagtagcagtcgtnaacgtatatatacgcacgactcagtagaacgggccagttacaactactccgtaccaacgacaacgaaccgacaaacgaaccgtacacgttatactactaaacaaatcggaaacngttccagaacncggaacccggaaggacgtacggttcgttacgtttaaccgacgttggttacgaagacaaggtacgtacgttaagtaacggttntttaaggg

SEQ ID NO: 420613 - DNA, 694 bp, Homo sapiens
  misc_feature: GZ8MTXP01AREY8.45.84.H07.1.454.CMB.2.raw
  modified_base (585)..(585): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggtttttcctttttgcttattgtagaaggtgtccactgtgaggtgcagcgtggtgggaggtcggggggagccgtggtcaagccgtgggggtccctgagactctcctgtgcagcctcgtggtatcgacttcagttatttagtagtgtagtaaagtcgggtccgaccgaggcctaccggaagggggaacggggtcgtgggtaggttcgggggttcctcgaattcccgtaaagtttaccggaccgtaaggtacgcccgtaggttacgggtacctaacgtaatttaacgttaaacgtttaaccggactaacggtaccttaccgtaagggttacgggaaacggggtcccgtactttaccaaactacgtcctacccgaagaacgaacaaaccggaccaaagacctacacttagtaactactaaacaaagtacgaaacncgttacagacgacgaaccggaacggaccgtacggttacgtttacgtttaaccttacgttcgttaacgaacgacgaagtacgtattaacgttaaggtttcgttttaaggg

SEQ ID NO: 420614 - DNA, 649 bp, Homo sapiens
  misc_feature: GZ8MTXP01B16DE.45.84.H07.1.454.CMB.2.raw
  modified_base (618)..(618): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcggggggaggcctggtcagccgtggggggtccctgagactctctgtgcacgcctctggtacttcgacttcagtattatagtgtagaagtcggtccgcgaggctcgaggggagggcgtggagtgggtctcactcctattagcagtacgccgtaggtgtacactataaactactaacgctaacggactacgaggtacgggaacgggtccctacttacaaactctccaccgaagaacgaaccaaccgacccaaagaaccctacacgttagttaactaacctaaataaacgtacgaaacctggttaccgtagggaacggaccggacccgggaaacggtaccgtaccggggttctttaacgttttaaaccgacgttacggtaaaccggagaacgttaggacgtaattaaggtaacggtttntttaggacgttggggttcggggtaacggggg

SEQ ID NO: 420615 - DNA, 631 bp, Homo sapiens
  misc_feature: GZ8MTXP01EWD5Z.45.84.H07.1.454.CMB.2.raw
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggttttcctttttgctattgtagaaggtgtccactgtgaggtgcagcgtgggtgggaggtcggggggagccgtggtcaagccgtgggggtccctgagactctcctgtgcagcctctggatcgacttcagtatttatagtgtagaaagtgggtcccgccgaggccgtccgaagggggaagggggctgggaggtggggtctcatcccaattacgcgagtagcaggttggtacaacatattacttacgcaagactacaagtcggaaagggcccgtacttaccaaactaatcctaccagaacgaccaaaccgaccaaagaaccgtcaaccttagtaactacctaaaccaaaagtcgaaactagtaccgtaggaacacggaaccggaaacggacgacgggttacttagtttaaccttacgttcgggttaaaccgaagaaccgaaggtaagtccgttaaagttaaccgggttgtttttaagggg

SEQ ID NO: 420616 - DNA, 540 bp, Homo sapiens
  misc_feature: GZ8MTXP01BB1B8.45.84.H07.1.454.CMB.2.raw
  modified_base (361)..(361): a, c, t, g, unknown or other
  modified_base (378)..(378): a, c, t, g, unknown or other
  modified_base (385)..(385): a, c, t, g, unknown or other
  modified_base (431)..(431): a, c, t, g, unknown or other
  modified_base (441)..(441): a, c, t, g, unknown or other
  modified_base (488)..(488): a, c, t, g, unknown or other
tcagacgcgatcgacacgaccggtgctcgatttagcagacgtctgtcgcggggagagaggagccttagccctggattccaaggcctatccacttggtgatcagcactgagcaccgaggattcaccatggcactggggctccgctgggttttccttttgctattgtagaagtgtccatgtgaggtgcagctggtggagtcgggggagcctggtcaagccgtgggggtccctgagactctcctgtgcagcctctggattcgacttcagtattatagtgtagaaagtggtccgcaggcctccgaagggaaggggctggaggtgggtctcatccattagcagtagcagtgtcacataatattcgnagctcagtgaaggcccntacaacntcacagacgacaacgcaagactcactgtatactaacaaatcgaacngtcagaacgngacccgagaccaggtccttgttaactccgttagtaaccgagaaccgngttaacgcgttaaagtaagggtcttttggaagttcggttgggtaaccggggg

SEQ ID NO: 420617 - DNA, 514 bp, Homo sapiens
  misc_feature: GZ8MTXP01EWFCS.45.84.H07.1.454.CMB.2.raw
  modified_base (338)..(338): a, c, t, g, unknown or other
  modified_base (441)..(441): a, c, t, g, unknown or other
  modified_base (480)..(480): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggagcctggtcaagccgtgggggtccctgagactctcctgtgcagcctctggattcgacttcagtattatagtgtgaaatgggtccgcaggctccaggaaggggctggagtgggtctcatccattagcagtanccagtggtcacataatattcgcagactcagtgaagggccgcttcaacatctccagagacaacgccaaagactcactgtatctaacaaatgaacagtctagagngccgaggacacgggcttgtttacacgttgacgaagacgngagtctagtaaggcttttgatgttggtaacgggg

SEQ ID NO: 420618 - DNA, 591 bp, Homo sapiens
  misc_feature: GZ8MTXP01DCK9Y.45.84.H07.1.454.CMB.2.raw
  modified_base (298)..(298): a, c, t, g, unknown or other
  modified_base (390)..(390): a, c, t, g, unknown or other
  modified_base (403)..(403): a, c, t, g, unknown or other
  modified_base (540)..(540): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttcctttttgctattgtagaaggtgtccactgtgaggtgcagctggtggaggtcggggggaggcctggtcaagccgtgggggtccctgagactctcctgtgcagcctctggattcgacttcagtatttatagtgtagaagtgggtccncaggctccgagggaggggcgtggagtgggtctcgatccgattagcagtagccagtggtcacataatattcgcagactcgagtgaagggcccncttacaacattcnccgaagagaaccaacgaccaaagaacctcaactgtaactacttaaacaaattacggaaacctagtcctagaacgacggtaccggaaggaccacgggtccttacggttttaacctacgttggtaaccgagttaaccgnggaacgtctaaagtaagggttcttttggagttcgggttgggtaaccggggg

SEQ ID NO: 420619 - DNA, 545 bp, Homo sapiens
  misc_feature: GZ8MTXP01EGCI6.45.84.H07.1.454.CMB.2.raw
  modified_base (248)..(248): a, c, t, g, unknown or other
  modified_base (253)..(253): a, c, t, g, unknown or other
  modified_base (273)..(273): a, c, t, g, unknown or other
  modified_base (281)..(281): a, c, t, g, unknown or other
  modified_base (293)..(293): a, c, t, g, unknown or other
  modified_base (296)..(296): a, c, t, g, unknown or other
  modified_base (308)..(308): a, c, t, g, unknown or other
  modified_base (313)..(313): a, c, t, g, unknown or other
  modified_base (331)..(331): a, c, t, g, unknown or other
  modified_base (346)..(346): a, c, t, g, unknown or other
  modified_base (434)..(434): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttccttttgctattgtagaaggtgtccatgtgaggtgcagctggtgggaggtcggggggagcctggtcaaggcctcggggtcctgatcgtctctggngcggngtcgtcaggctcgacttagntatatagngtagaatggccncgngcgcgaggaggngtggngtgtctcactctataganagagacgagtgacanataatatcacagactagagtaggacggtcgtactacacactacacgacgaacaacaacaacaacactacactatacgtaactaataanacacagagagagacgacgacgacgacgtaacgttacgttactacgttacgtacgaagacgacgttacgtaagtagtaagttagttacgttagtaacggttcgggtaacggg

SEQ ID NO: 420620 - DNA, 541 bp, Homo sapiens
  misc_feature: GZ8MTXP01E3BW3.45.84.H07.1.454.CMB.2.raw
  modified_base (419)..(419): a, c, t, g, unknown or other
  modified_base (534)..(534): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggttttcctttttgctattgtagaaggtgtccatgtgaggtgcagcgtgggtgggaggtcggggggaggccgtggtcaaggccgtggggggtccctgagactctcctgtgcagcctctggatcgacttcagtatttatagtgtgaaatgggtccgccaggctccgaggggaaggggctgggagtggggtctcatccattacgcagtagcagtggcaacatatattacgcagactcagtgaagggcgcttacaacatctaccagaanacaacgaccaaagaactcactgtaatctaaacaaatagaaaccagtctagagagcccggaaggacacggcgttagtttaaccagttcgacgaagacaagagcttaagtaaggttntttaagg

SEQ ID NO: 420621 - DNA, 529 bp, Homo sapiens
  misc_feature: GZ8MTXP01AYW0Y.45.84.H07.1.454.CMB.2.raw
  modified_base (304)..(304): a, c, t, g, unknown or other
  modified_base (333)..(333): a, c, t, g, unknown or other
  modified_base (357)..(357): a, c, t, g, unknown or other
  modified_base (387)..(387): a, c, t, g, unknown or other
  modified_base (392)..(392): a, c, t, g, unknown or other
  modified_base (417)..(417): a, c, t, g, unknown or other
  modified_base (445)..(445): a, c, t, g, unknown or other
  modified_base (509)..(509): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggttttccttttgctattgtagaaggtgtccactgtgaggtgcagctggtgggaggtcggggggagcctggtcaagccgtggggggtccctgacgactctcctgtgcagcctctggatcgacttcagtatttatagtgtgaaatgggtccncaggctcgagggaggggctgggagtgggntcatcattacgcagtagcagtgcncatatattacgcagactcagtgaagggccncttanaacatcaccagacacaacgccaaanactcaactgtactacgaacaatgaaacngtctagacgagccgaggacacgggttcttagtttaaccacgttcggaccgaagaccaagacgtnttaagtaagttcgtttaagg

SEQ ID NO: 420622 - DNA, 599 bp, Homo sapiens
  misc_feature: GZ8MTXP01A4WB9.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggagtcggggggagcctggtcaagccgtgggggtccctgagactctcctgtgcagcctctggattcgacttcagtatttatagtgtagaagtgggtcccgcgaggctccggagggaaggggctggagtgggtctcgatccattagcagtagccaggtgtcacataatactcgcagacctcgagtaggaacgggccgtcttcaactagtcctaccagaacgaccaacgccaaagaacctcaacttagacttacctaaataaaactcgaaactacgtctacgaacggacgtacccggaggtaccaccgggtaacttaggtttaacctacgttacggtaacgaacgaccgagacgtaacttaagtaacggttacctttttaggacgttggttggggtaaccggggg

SEQ ID NO: 420623 - DNA, 673 bp, Homo sapiens
  misc_feature: GZ8MTXP01CANL0.45.84.H07.1.454.CMB.2.raw
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggttttcctttttgctattgtagaaggtgtccactgtgaggtgcagcgtgggtgggaggtcggggggagccgtggtcaaggccgtggggggtccctggacgactctcctgtgcacgcctcgtggacttcgacttcagttatttatagtgtagtaagtcgggtcccgcgaggctaccggaggggagggcgtgggaggtgggtctcactcctagttacgctagtagcgaggtgtacaacgtattattattacgactagactcgagggtagaacgggtccctacttacaaactacttaccaccgaaagggaacaaaccgaaaccggacccaaaaacgtacgtacccctaagttcgttaaactaccttaaaaccaaagttcggaaacctagttaccgtaggaacgaccggaacccggaaggaaccgtacccgggttacttttaacgggttttaacccaacggttcgaaacgggaacgaactaacggtaagtaccgtttaaacgttaagggtttcgttttaaggg

SEQ ID NO: 420624 - DNA, 561 bp, Homo sapiens
  misc_feature: GZ8MTXP01C2HF8.45.84.H07.1.454.CMB.2.raw
  modified_base (144)..(144): a, c, t, g, unknown or other
  modified_base (304)..(304): a, c, t, g, unknown or other
  modified_base (458)..(458): a, c, t, g, unknown or other
  modified_base (479)..(479): a, c, t, g, unknown or other
  modified_base (513)..(513): a, c, t, g, unknown or other
  modified_base (525)..(525): a, c, t, g, unknown or other
  modified_base (541)..(541): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgnttgggtttttcctttttgctattgtagaaggtgtccatgtgaggtgcagcgtggtgggaggtcggggggaggcctggtcaaggccgtgggggtccctgagactctcctgtgcagcctcgtggattcgacttcagtatttatagtgtagaaatgggtcccncaggctccgagggaaggggctggagtgggtctcgatccattagcagtagcccaggtggtcacataaataattcgcaaggaccctgaaggtggaaacgggccctatttacaaacattccaccgaagaacaaccaaacgccaaaagaactcaactntaatcctaaagaaatgaaacngtcagaagacgacgagacaggtctagttactacnggtaacgagacngagtaataagtaagtntttgagtggttggaacgggg

SEQ ID NO: 420625 - DNA, 568 bp, Homo sapiens
  misc_feature: GZ8MTXP01EL2IN.45.84.H07.1.454.CMB.2.raw
  modified_base (303)..(303): a, c, t, g, unknown or other
  modified_base (518)..(518): a, c, t, g, unknown or other
  modified_base (547)..(547): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggttttcctttttgctattgtagaaggtgtccactgtgaggtgcagctgggtgggaggtcggggggagcctggtcaagccgtgggggtccctgagactctcctgtgcagcctctggatcgacttcagtatttatagtgtgaatgggtccncaggctccgaggggagggctgggagtgggtctctatccattacgctagtagcagtggtcaacgtattatattacgcaagacttcaggtgaacggggcctacttacaactatcctacccgaagagaccaaacggacctaaagaacctcaacttaggtaacttactaaaccaaagttgaaaccgtagttccgagaggacgccgaaggacacgggttntagtttaccacgttgttacaagacaaganacttagtaacggttgtttaag

SEQ ID NO: 420626 - DNA, 516 bp, Homo sapiens
  misc_feature: GZ8MTXP01AWBLB.45.84.H07.1.454.CMB.2.raw
  modified_base (362)..(362): a, c, t, g, unknown or other
  modified_base (391)..(391): a, c, t, g, unknown or other
  modified_base (457)..(457): a, c, t, g, unknown or other
  modified_base (484)..(484): a, c, t, g, unknown or other
  modified_base (496)..(496): a, c, t, g, unknown or other
  modified_base (502)..(502): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttcctttttgctattgtagaaggtgtccactgtgaggtgcagctggtggagtcggggggagcctggtcaagcctggggggtccctgagactctcctgtgcagcctctggatcgacttcagtatttatagtgtgaaatggggtccgccaggctccagggaagggggctgggagtgggtctcatccattagcagtagcagtggtcaanatatattacgcagactcagtgaagggccnttcaaacatctaccagagacaaacgccaaagaactcactgtatctaacaaatgaaaccagtctagngagccgaggacacggctgtttaacagngttacgaagaanaagatnttagtaagttgttg

SEQ ID NO: 420627 - DNA, 534 bp, Homo sapiens
  misc_feature: GZ8MTXP01EZOKV.45.84.H07.1.454.CMB.2.raw
  modified_base (366)..(366): a, c, t, g, unknown or other
  modified_base (383)..(383): a, c, t, g, unknown or other
  modified_base (392)..(392): a, c, t, g, unknown or other
  modified_base (394)..(394): a, c, t, g, unknown or other
  modified_base (438)..(438): a, c, t, g, unknown or other
  modified_base (513)..(513): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttcctttttgctattgtagaaggtgtccactgtgaggtgcagctggtggaggtcggggggaggcctggtcaagccgtgggggtccctgagactctcctgtgcagcctctggattcgacttcagtatttatagtgtagaaatcgggtccgcaggctccgagggaggggctggagtgggtctcatccattagcagtgccaggtgtcacataatatcgnagctcagtggaaggccncttacaacncnctaccagacgacaacgacaaagactcactgatactaaacaatanaacagttcagacgacgccgaggacacggtcttagtttacacgttgtaccgaattacgagagtaatacgtaaggtntttagagtgttcgggaacggg

SEQ ID NO: 420628 - DNA, 557 bp, Homo sapiens
  misc_feature: GZ8MTXP01BRQIG.45.84.H07.1.454.CMB.2.raw
  modified_base (492)..(492): a, c, t, g, unknown or other
  modified_base (522)..(522): a, c, t, g, unknown or other
  modified_base (525)..(525): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttccttttgctattgtagaaggtgtccactgtgaggtgcagctggtggaggtcgggggagcctggtcaagccgtgggggtccctgagactctcctgtgcagcctctggattcgacttcagtatttatagtgtagaaatgggtccgccaggctccgagggaggggctggagtgggtctcatccattagcagtagccagtggtcacataatattcgcagactcgagtggaacgggcccgtcttacaactatcctaccaagaacgaaccaaacgacccaaagaacctctaactagtactactaaacaaatacgaaacctagtctaggaagacgaccggaggacncgggtcttagttacacgttgtaacgagacnganctagtaagtctttgagttgttgggtaacgggg

SEQ ID NO: 420629 - DNA, 661 bp, Homo sapiens
  misc_feature: GZ8MTXP01DRK4B.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttccttttgctattgtagaaggtgtccactgtgaggtgcagcgtgggtgggaggtcggggggagcctggtcaacggccgtggggggtccctgacgactctcctgtgcagcctcgtggtacttcgtacttcagtattatagtgtagaagtcggtccgccgtaggcgtaccggaggggaaggggcgtaggagtcgggtctcgactccgtattacgacagtacgcgtaggtaggtacaactataaactacttaacgactaacgactcgtaacggtacgggaaacgggtccctacttaacaaactacgtacctaccgaaaggaacgaaaccgaaaccgacccgaaaacgtacctactaacttagtaacttaacaaacgtaaatacgaactagtactagacgacgtaccgagaccgtacgtcttacgttaacgtacgttagaacggacgttaacgaggttattaaccttaaggttaacggttcgtttaggttagttgggttcggggtaaccgggg

SEQ ID NO: 420630 - DNA, 600 bp, Homo sapiens
  misc_feature: GZ8MTXP01A9SSQ.45.84.H07.1.454.CMB.2.raw
  modified_base (317)..(317): a, c, t, g, unknown or other
  modified_base (427)..(427): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcacgtggggctccgcttgggttttcctttttgctattgtagaaggtgtccactgtgaggtgcagcgtgggtgggaggtcggggggagccgtggtcaaggtccgtggggggtccctgacgtactctcctgtgcacgcctgtggatcgacttcagttatttagtagtgtagaagtcgggtccncgaggctcggaggggaggggctgggaggtcgggtctctatcctagttacgctagtagctaggtacgtacaacgtattatagttacgacagactgagtaggaacgggtccncttacgaactactcctacgaagacgaaccaacgaccaaagtactactacgttataactactaaacaagtacgaaactgtacgtgaacgacgaacggaacgacggtacgttcgttacgttaacttcgttcgttacgaagtacaagacgtacgttagttaacggtttcgtttaag

SEQ ID NO: 420631 - DNA, 633 bp, Homo sapiens
  misc_feature: GZ8MTXP01D60A2.45.84.H07.1.454.CMB.2.raw
  modified_base (296)..(296): a, c, t, g, unknown or other
  modified_base (530)..(530): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggtttttcctttttgctattgtagaaggtgtccactgtgaggtgcagctggtggaggtcgggggagcctggtcagccgtgggggtccctgagctctcctgtgcagcctcgtggattcgacttcagtatttatagtgtagaagtggtccncgaggctcgaggggaggggctggagtgggtctcatccattagcagtagccaggtgtacacattaaataattcgactagacttcgaaggttcgggaaacggggtccctactttaccaaactacttcctaccgaaggaaaccgaccaaaccggacccaaagaacctacgtaacttacgttaattaaccttaaacaaatacgaaactagtctaggaacggacgaccggtaggaaccnccgggtctttacgtttaactacgttacggaacgtaacgaccgaggttagtaaccgttaagttaagggtttccttttaggaagttgggttcggggtaacggggg

SEQ ID NO: 420632 - DNA, 596 bp, Homo sapiens
  misc_feature: GZ8MTXP01C8SJN.45.84.H07.1.454.CMB.2.raw
  modified_base (264)..(264): a, c, t, g, unknown or other
  modified_base (308)..(308): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggtttttcctttttgcttattgtagaaggtgtccactgtgaggtgcagctgggtgggaggtcggggggaggcctggtcaaggccgtgggggtccctgagactctcctgtgcagcctntggattcgacttcagtatttatagtgtagaaagtcgggtccgcnggctccgagggaaggggctggagtggggtctcatccattagcagtagccaggtggtcacataattattaacgcaagactcaggtggaacgggcccgtacttacaactactcctaccagaagaaccaacgacccaaaggacctacaacttagtaactacgtaaacaaatacggaaactagtcctaggaacgacggtacccggaaggaccacgggtcttacgtttactacgttagtaacgaagaccgagagtaacttagtaaggttctttagagttggttggtaacgggg

SEQ ID NO: 420633 - DNA, 658 bp, Homo sapiens
  misc_feature: GZ8MTXP01DG3ZE.45.84.H07.1.454.CMB.2.raw
  modified_base (490)..(490): a, c, t, g, unknown or other
  modified_base (540)..(540): a, c, t, g, unknown or other
  modified_base (586)..(586): a, c, t, g, unknown or other
  modified_base (608)..(608): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcacgtggggcctccgtcgttgggtttttcctttttgcttattgtagaaggtgtccactgtggaggtgcagcgtgggtggagggtcggggggagccgtggtcacggccggtgggggtccctgacgactctccgtgtgcgcgtcctgtagtcgtcgtactgtattattagtgtgtaagtaggtcggccgacgacgtccgacgggagggggacggtggtgggtaggtcgtctactactactagtccgacgtagtacgcgtagtacgacaagttattaacgttaacgtaccgacgtactacgtaggtaggtacggggtaaccggtcccttacctaaaccaacgttaccttccccgaanacgggaacccaaaaccgaacccgaaacgtaacgtaacctactagtttaanaaacctacaaaactagtaaccagtacgtgagagggcccgaaggacncgacgtttcgttaattacccgngttacgacggtaactaaggcgtacgtagtttaaggtaagttttcggtaag

SEQ ID NO: 420634 - DNA, 672 bp, Homo sapiens
  misc_feature: GZ8MTXP01AUC4D.45.84.H07.1.454.CMB.2.raw
  modified_base (648)..(648): a, c, t, g, unknown or other
tcagacgcgatcgacacgaccggtgctcgatttagcagacgtctgtcgcgggggagagaggagccttagccctggattccaaggcctatccacttggtgatcagcactgagcaccgagtattcaccatggcactggggctccgctgggttttccttttgctattgtagaaggtgtccactgtgaggtgcagctggtgggaggtcggggggaggcctggtcaaggccgtgggggtccctgagactctcctgtgcacgcctcgtggattcgacttcagtatttagtagttgtagaaagtcgggtccgccaggcctccgaagggggaaggggctgggtaggtcggggtctacgacttacccagtttacggctaaggtaacggcccgtaaggtcgggttacaacgtaattaaattaacgttaaccgcaagaccttcgaacggttagggaaacggggtcccacctttacaaacctcttaccgcccgaaaggaaaccggaaccaaaaccggacctaaaggaaacctctaaacgttacgtaactaaccctaaagaaagttcgaaacgtacgtcgtaaggacgaaggccccgaaggtacacgggtcttatttacacgttgtaacgagacgaggttactaacgttagtaacggtttnttagacgttgggttcgggaacggg

SEQ ID NO: 420635 - DNA, 598 bp, Homo sapiens
  misc_feature: GZ8MTXP01B3W8E.45.84.H07.1.454.CMB.2.raw
  modified_base (499)..(499): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttccttttgctattgtagaaggtgtccactgtgaggtgcagctggtgggaggtcggggggaggcctggtcaaggccgtggggggtccctgagactctcctgtgcagcctctggatcgacttcagtatttatagtgtgaaagtgggtccgccgaggctccgagggggaaggggctgggaggtgggtctcgatccattacgcagtgcgtagtggtacaacgataatatttacgctagactacgagtaggaaacgggtcccgctttaccgaataacgtcctacccgaagacgaaccaacgacccaaagaacctcaacgttagtactaccttaacgaaatcgaaacngtacctaggaacgagaacccggaggacacgggttcttagtttaacttccgttaggaccggtaagacgaagtagtcgttaataacgggttgtttttaagg

SEQ ID NO: 420636 - DNA, 526 bp, Homo sapiens
  misc_feature: GZ8MTXP01E0ZG8.45.84.H07.1.454.CMB.2.raw
  modified_base (296)..(296): a, c, t, g, unknown or other
  modified_base (360)..(360): a, c, t, g, unknown or other
  modified_base (378)..(378): a, c, t, g, unknown or other
  modified_base (385)..(385): a, c, t, g, unknown or other
  modified_base (414)..(414): a, c, t, g, unknown or other
  modified_base (423)..(423): a, c, t, g, unknown or other
  modified_base (433)..(433): a, c, t, g, unknown or other
  modified_base (490)..(490): a, c, t, g, unknown or other
  modified_base (503)..(503): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggtttttccttttgctattgtagaaggtgtccactgtgaggtgcagctggtggaggtcggggggagcctggtcaaggccgtgggggtccctgagctctcctgtgcagcctctggattcgacttcagtattatagtgtgaaatgggtccncaggctccgagggagggctggagtgggtctcatccattgcagtgccaggtgcacataatatcgnagactcagtgagggcccnttacaanatctccagagacaacgccaaagactcatntaatctaanaaatcgaacngtcgtagacgcgccgaaggccaacgggcttgttaacctattgaacgagacgagacgnttaagtaacgttntttagagtggttgtaaccggggg

SEQ ID NO: 420637 - DNA, 567 bp, Homo sapiens
  misc_feature: GZ8MTXP01B36XQ.45.84.H07.1.454.CMB.2.raw
  modified_base (466)..(466): a, c, t, g, unknown or other
  modified_base (490)..(490): a, c, t, g, unknown or other
  modified_base (526)..(526): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttcctttttgctattgtagaaggtgtccactgtgaggtgcagctggtggaggtcggggggaggcctggtcaagccgtggggggtccctgagactctcctgtgcagcctctggtattcgacttcagtatttatagtgtagaaagtgggtccgcaggctccgagggaggggctggagtgggtctcatccattagcagtagccaggtggtcacataatacttcgacagacttcaggtggaaacggggccctactttacaaactctctaccagaacgacaacgacccaagactcactgtactctaaacaaatacgaacngttcaggagacgaccgaaggaccncgggttcttgtttaactacgttgtaacgagttacgngagtctaagtaaggttctttagattggttcgggtaacgggg

SEQ ID NO: 420638 - DNA, 595 bp, Homo sapiens
  misc_feature: GZ8MTXP01AGDUV.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttcctttttgctattgtagaaggtgtccactgtgaggtgcagctggtggaggtcggggggagcctggtcaagccgtgggggtccctgagactctcctgtgcagcctctggattcgacttcagtatttatagtgtagaagtcgggtccgcgaggctccggaggggaggggctggagtgggtctcatccattagcagtagccaggtgacactataatactcgcagactgaggtaggaacgggccctacttacaactatccaccgaagacgaacaacgaccaaagacctcacttgtaactactaaacaaatcgaaactagtctaggaacgacggacccggaaggacccgaacggtcttacgttttacctaacgttaggtaaacgacgacgaggttacgtaacttaagttaacgggttctttaggacgttgggttcgggtaacggggg

SEQ ID NO: 420639 - DNA, 643 bp, Homo sapiens
  misc_feature: GZ8MTXP01D1ZGZ.45.84.H07.1.454.CMB.2.raw
  modified_base (414)..(414): a, c, t, g, unknown or other
  modified_base (486)..(486): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggttttccttttgctattgtagaaggtgtccactgtgaggtgcagcgtgggtggagggtcggggggagcctggtcaaggccgtggggggtccctgacgtactctcctgtgcagcctcgtggatcgacttcagttatttatagtgtagaagtgggtccgcaggctaccgaaggggagggctgggagtgggtctcatccattacgcagtagcaggtaggtacaacgtatataacttacgcagtactcgaggtagaacgggccncttacaaactacttccaccgaagacgaaccgaacggtacccaaagtaaccgtcaacttagtactacctaaanaaacgttacgaaacctgttaccaggaaacgcgaacccggaaggaccgtaaccggggttctttaaacggttttaaccgttaaccgttggttaaacccggtaagaaaccgtaagggtaacggtaccttaaaggtttaaccgggttcgttttttaagggg

SEQ ID NO: 420640 - DNA, 649 bp, Homo sapiens
  misc_feature: GZ8MTXP01BF4CS.45.84.H07.1.454.CMB.2.raw
  modified_base (281)..(281): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttcctttttgctattgtagaaggtgtccactgtgaggtgcagctggtggaggtcggggggagcctggtcaagccgtggggggtccctgagactctcctgtgcagcctctggattcgacttcagtatttanagtgtagaaagtgggtccgcaggctccggagggaggggctgggagtgggtctcatccattagcagtagccaggtgtacaactagtaactattaacgctaagactctaaggtgggaaacggggtccctcttacaaacctatcctaccgaagaacggaaccaaacggacccaaagaaacctctaacgttagtaacgtaacccttaaagaaacgttagaaaccctagtaccgtagggaaagacgggccccggaaagggacctaacgggtctttacggtttaacctacgtttacggaaccgaagaaccgttaggaacggttaactaaaggttaaggtttcgttttaggacgttgggttcgggtaaccggggg

SEQ ID NO: 420641 - DNA, 620 bp, Homo sapiens
  misc_feature: GZ8MTXP01C2OAL.45.84.H07.1.454.CMB.2.raw
  modified_base (398)..(398): a, c, t, g, unknown or other
  modified_base (470)..(470): a, c, t, g, unknown or other
  modified_base (573)..(573): a, c, t, g, unknown or other
  modified_base (593)..(593): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttcctttttgctattgtagaaggtgtccactgtgaggtgcagcgtggtgggaggtcggggggaggcctggtcaaggccgtggggggtccctgagactctcctgtgcagcctctggattcgacttcagtatttatagtgtagaaagtcgggtcccgcaggcctccgaaggggaagggggctggggaggtggggtctacactccattacgcaggtagcccgagtggtcaactattaaattattaacggnaagactcgaggtaggaaacggggccctacttacaaactactcctaccgaagacgaaccaaaccgaccgaaanaacctcaactgttaaactacctaaagaaattcgaaactagtaccaggaaagcgaccggaaggaccacgggtctttagttaactacgagttaaaccgagaacgngaagtctaaagttaaggttnttttaggattgggttgggtaacggggg

SEQ ID NO: 420642 - DNA, 684 bp, Homo sapiens
  misc_feature: GZ8MTXP01ESAZZ.45.84.H07.1.454.CMB.2.raw
tcagacgcgatcgacacgaccggtgctcgatttagcagacgtctgtcgcggggagctctgagagaggagccttagccctggattccaaggcctatccacttggtgatcagcactgagcaccgaggattcaccatggcacgtggggctccgtcttgggtttttccttttgctattgtagaggtgtccagtgtgaggtgcagcgtggtgggagggtcgggggagccgtggtcaaggccgtgggggtccctgacgtctctcctgtcgcacgcctcgtggatcgacttcagttatttagtagtgtagtaaagtgggtcccgcgaggcctccggaagggggagggcgtgggtaggtgggtctacatcctagttacgctagtagcgtaggttacggtacaactaataagttacttacgactaacggacttcgagtcggaaacggggtccctacttacgaaactaccttacccgaacgaacgaaccgaaaccgtaaccgaaaccgtaaacgtaacctacgttaactaacgttacccaactaaaacaacgtacgaaacgttcgtacggaaggacggaaccggaaccgggtaaacggttacccggtacgtttaaccgtttacgtttaaaccgttacgttaacggaccggaacaaggtaacgagttaaccttagggtaacgtttttggttaagg

SEQ ID NO: 420643 - DNA, 536 bp, Homo sapiens
  misc_feature: GZ8MTXP01CCPTS.45.84.H07.1.454.CMB.2.raw
  modified_base (298)..(298): a, c, t, g, unknown or other
  modified_base (396)..(396): a, c, t, g, unknown or other
  modified_base (423)..(423): a, c, t, g, unknown or other
  modified_base (495)..(495): a, c, t, g, unknown or other
  modified_base (501)..(501): a, c, t, g, unknown or other
  modified_base (526)..(526): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttcctttttgctattgtagaaggtgtccactgtgaggtgcagctggtggaggtcgggggagcctggtcaagccgtgggggtccctgagactctcctgtgcagcctctggattcgacttcagtatttatagtgtagaaatgggtcccncaggctccgagggaaggggctggagtgggtctcagtccattagcagtagccagtggtcacataatattcgcagactcagtgaaggccgacttcaaacntcaccgagacgacaacgccaaagactnactgtatctaacaaatgaaacagtcagacgagcccgaagcacggtctgtttacacgttgtaaacgagaacgngacgtntaagtaacggtcttttagagttggnggtaacgggg

SEQ ID NO: 420644 - DNA, 604 bp, Homo sapiens
  misc_feature: GZ8MTXP01BRMEQ.45.84.H07.1.454.CMB.2.raw
  modified_base (258)..(258): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggtttttcctttttgctattgtagaaggtgtccactgtgaggtgcagctggtggaggtcgggggagcctggtcaggccgtgggggtccctgagactctcctgtgcagcctntggattcggacttcagtatttatagttgtagaaagtcggggtcccgcaggcctaccgaggggaaggggctgggagtggggtctcgatccattacgcagtagcccaggtggtcaactattaaataacttcggacaacgactcgaaggttacgggaaacgggggtccctactttacaaactactaccgtacccgaagaacgaaccaaacccggaccaaagaaacctcaacttgtaactacgtaaacaaatgaaacctagtctaggagcgacggagccgcgtcttagttactacgttgtaacgagacgagacgtaattaagtaagttctttgagtgttgggtaacgggg

SEQ ID NO: 420645 - DNA, 808 bp, Homo sapiens
  misc_feature: GZ8MTXP01DUTV5.45.84.H07.1.454.CMB.2.raw
  modified_base (296)..(296): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttccttttgctattgtagaaggtgtccatgtgaggtgcagcgtggtggaggtcgggggagcctggtcaagccgtgggggtccctgagtactctctgtgcagtcctctggattcgacttcagtattatagtgtagaagtcggtccncgaggctcgagggagggctggagtgggtctcgactaccgagttacgactaggtagaccccgtaggtaggtaccaactagttaaattaacgttaaccggacgtaaacgtaacccgttcgaacgggttacgggaaaccgggggtccccgtacgtttaccgaaaccttacgtacccttaaccccgtaaagggaaacccggtaaacccaaaccgggtaacccctaaaaaacgggaaaccccgttaaacccgtaaccctttaaggttaaacgtttaaacccgtaaaacccgtaaaaactttagaaaaccgtacgtaaccgttaggaaaccgggtacggtaacccgggaaacgggtacccgtaacggggttccttttaacggtttaaccggttaaacccgttagggttaaacccgtaagggaaacccgacgggttaaagttaacccgttaaaggttaaacccggggtttacgttttttagggaaacgtttggggtttaacggggttaaacccgggggg

SEQ ID NO: 420646 - DNA, 761 bp, Homo sapiens
  misc_feature: GZ8MTXP01AC9V8.45.84.H07.1.454.CMB.2.raw
  modified_base (731)..(731): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcacgtggggctccgcttgggttttccttttgctattgtagaaggtgtccactgtgaggtgcagcgtgggtgggaggtcgggggagccgtggtcaaggccgtgggggtccctggacgtctctcctgtcgcacgtcctgtggtactcgtacttctagttattagtagtgtagtaagtcgggtcccgcgaggccgtaccggaagggggacgggtcgtagggaggttcgggtctacgtacttaccgtagttacggacgtaaggtacggtaccgtaggttaacgggtaccctaacgtaagttaacgttaacgttaaccggacgtaacgtaccgttaccgggtagggttacggggaaaccggggttccccttacttaaacccgaaactaccttacccgtaaccgaaacggggtaacaaaccccgtaaaccggaacccgtaaaacgtaaccttacgtaaactttacgtaaaccttaaaccgaaaacctaagtacggtaaactacggtccgtaagaacggtaccggaacggaaacgggttccgtaacccggttgtttaaaccgttacttaaccggttgaaaccggaagacgtaagaccggttntttaaacggttaacggttttctttaagggg

SEQ ID NO: 420647 - DNA, 632 bp, Homo sapiens
  misc_feature: GZ8MTXP01CYGWT.45.84.H07.1.454.CMB.2.raw
  modified_base (586)..(586): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttccttttgctattgtagaaggtgtccactgtgaggtgcagctggtggaggtcgggggagccgtggtcaaggccgtgggggtccctgagactctcctgtgcagcctctggattcgacttcagtatttatagtgtagaaagtggtccgcaggctccgagggaaggggctggagtcgggtctcatccgtattacgcagtacgcctaggtggtacacgtataataattaacgcaggacttagaggttacggaaacgggcccgtactttacgaaactaacttccaccgaaagaacgaaaccaaacgacccaaagaaacctcaaacgttcgtaacttaaccgtaaactaaaactacggtaaacacgttacgtagaaacggacgaacccggtaggacccgtaggtaaccttaggttacttacgacgttaagacgttaacgngttagaacgttaataacggttcgtttgacttgggttggtaacgggg

SEQ ID NO: 420648 - DNA, 590 bp, Homo sapiens
  misc_feature: GZ8MTXP01BLE5H.45.84.H07.1.454.CMB.2.raw
  modified_base (271)..(271): a, c, t, g, unknown or other
  modified_base (307)..(307): a, c, t, g, unknown or other
  modified_base (335)..(335): a, c, t, g, unknown or other
  modified_base (339)..(339): a, c, t, g, unknown or other
  modified_base (361)..(361): a, c, t, g, unknown or other
  modified_base (403)..(403): a, c, t, g, unknown or other
tcagacgcgatcgacacgaccggtgctcgatttagcagacgtctgtcgcgggcgtagactttgtgtttctcgtagtctgctttgctcagcgtcagggtgctgctctggctcccaggtgccaaatgtgacatccagatgacccaatctccttctaccctgtctgcatctgtaggagacagagtcaccatcacttgccgggccagtacaaagtattagtgactggttggcctggtatcagacgaggaaaccggggaaagccccgtaaggtccngatctacgagggcgtctagtctaggaaaggtggggnccacgaggttcagtcggcagtggatcgngganagtaactcactctcaccaatcngcagcctgcagctgattgtatttgactaactttacttcgtanaccgtaagtactgttagttttagtcgggtacggttcggacgtaagggacgtaaaggtacggaaatacggaaaacgtacgtggtacggtactcggaacctaaccgttacttacgttcggttccttcgttaaccttcccttcccccggaactacgtcgtcgtacgttccgtaacgttcggttaacccgg

SEQ ID NO: 420649 - DNA, 654 bp, Homo sapiens
  misc_feature: GZ8MTXP01DTB0J.45.84.H07.1.454.CMB.2.raw
  modified_base (258)..(258): a, c, t, g, unknown or other
  modified_base (355)..(355): a, c, t, g, unknown or other
  modified_base (379)..(379): a, c, t, g, unknown or other
  modified_base (576)..(576): a, c, t, g, unknown or other
  modified_base (622)..(622): a, c, t, g, unknown or other
tcagacgcgatcgacacgaccggtgctcgatttagcagacgtctgtcgcggggggagagaggagccttagccctggattccaaggcctatccacttggtgatcagcactgagcaccgaggattcaccatggcacgtggggctccgtcttgggtttttcctttttgctattgtagaaggtgtccatgtgaggtgcagcgtggtgggaggtcggggggagcctggtcaaggccgtgggggtcctgagactctcctgtgcngcctctggattcgacttcagtatttatagtgtagaagtcgggtccacaagccgtaccggaggggaggggctggagtgggtctcatccattagcagtncagtgcaactataaatattcgcanactcgagtggaaacggggtccctacttacaactatacctacgaagaacgaaccaaacgaccaaagtaacctcaaacttacgtaattaaccgtaaacaaaagttacgaaacgtagttaccgaggaaacggacggtacccggaaaggaccgtaaccgggtaactttaacggtttaaccgtacgttacggtaaacggaanaaacccggttaggttaaccgtaagttaaagttaaaccggggttttntttaggaggttcgggttaacggggtaacgggg

SEQ ID NO: 420650 - DNA, 559 bp, Homo sapiens
  misc_feature: GZ8MTXP01B5IGJ.45.84.H07.1.454.CMB.2.raw
  modified_base (257)..(257): a, c, t, g, unknown or other
  modified_base (408)..(408): a, c, t, g, unknown or other
  modified_base (412)..(412): a, c, t, g, unknown or other
  modified_base (444)..(444): a, c, t, g, unknown or other
  modified_base (476)..(476): a, c, t, g, unknown or other
  modified_base (510)..(510): a, c, t, g, unknown or other
  modified_base (538)..(538): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttcctttttgctattgtagaaggtgtccactgtgaggtgcagctggtggaggtcgggggagcctggtcaagccgtgggggtccctgagactctcctgtgcagcctntggattcgacttcagtatttatagttgtagaaagtcgggtcccgccaggctccggaggggaagggggctgggagtgggtctcatccattagcagtagccaggtgtcactataaatattcgcagactcgagtcggaacgggccacttcaacntccncagacacacgaccaagactcatgaactctaanaaatgaactgtccgagacgacgccgaggaacncggtcttgtttactacgttagtaaccgagaacgnggacgtcttaagttaaggttcgttttanaggttcggttgggtaacgggg

SEQ ID NO: 420651 - DNA, 565 bp, Homo sapiens
  misc_feature: GZ8MTXP01D35GG.45.84.H07.1.454.CMB.2.raw
  modified_base (404)..(404): a, c, t, g, unknown or other
  modified_base (501)..(501): a, c, t, g, unknown or other
  modified_base (525)..(525): a, c, t, g, unknown or other
  modified_base (544)..(544): a, c, t, g, unknown or other
  modified_base (551)..(551): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttccttttgctattgtagaaggtgtccactgtgaggtgcagctggtggaggtcgggggaggcctggtcaagccgtgggggtccctgagactctcctgtgcagcctctggattcgacttcagtatttatagtgtagaaagtggtccgcaggctaccgagggaggggctggagtgggtctcatccattagcagtagccaggtgtcacataattattaacgcaagtactcaggtacggaaaggggtcccgtcttanaaacctatcgtacccagaacgaacaacgacccgaaagaacctacactataacttactaaactaaatacgaaacagtctagagcgacgaggacacggnttacggttactacgttgtaacganacgagagaactataacgtntttaggngtggttggtaacgg

SEQ ID NO: 420652 - DNA, 599 bp, Homo sapiens
  misc_feature: GZ8MTXP01CT6GL.45.84.H07.1.454.CMB.2.raw
  modified_base (263)..(263): a, c, t, g, unknown or other
  modified_base (271)..(271): a, c, t, g, unknown or other
  modified_base (591)..(591): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggtttttcctttttgcttattgtagaaggtgtccatgtgaggtgcagcgtgggtgggaggtcggggggagcctggtcaaggccgtggggggtccctggagactctcctgngcagcctntggatcgacttcagttatttatagtgtagaaagtcgggtcccgccaggcctccggaggggaagggggctgggagtgggtctcatccattacgcagtagcagtggtacaacgtatatattacgcaacgtactcgaggtaggaacgggcccgtacttaccaaactattcccgtaccaagaacgaaccaacggaccaaacgaacctcaacttagtaactacctaaacaaatcgaaacctgtaccaggaagacggaaccgaaggacctacgggctttagttacttacgttgttacgaagtacaagagtacttaagtaacggttnttttaagg

SEQ ID NO: 420653 - DNA, 541 bp, Homo sapiens
  misc_feature: GZ8MTXP01EYS21.45.84.H07.1.454.CMB.2.raw
  modified_base (347)..(347): a, c, t, g, unknown or other
  modified_base (361)..(361): a, c, t, g, unknown or other
  modified_base (371)..(371): a, c, t, g, unknown or other
  modified_base (377)..(377): a, c, t, g, unknown or other
  modified_base (388)..(388): a, c, t, g, unknown or other
  modified_base (394)..(394): a, c, t, g, unknown or other
  modified_base (397)..(397): a, c, t, g, unknown or other
  modified_base (454)..(454): a, c, t, g, unknown or other
  modified_base (472)..(472): a, c, t, g, unknown or other
  modified_base (499)..(499): a, c, t, g, unknown or other
  modified_base (505)..(505): a, c, t, g, unknown or other
  modified_base (531)..(531): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcgggggaggcctggtcaagccgtgggggtccctgagactctcctgtgcagcctctggattcgacttcagtatttatagtgtagaagtcgggtccgccgaggcctaccggaggggaagggggctggaggtgggtctcatccattgntagtgccagtgcanataatatcgnagactnagtgacgggcntacacntcncagacgacacgacaagactcaactgtactactaacaaatacgaaactgtctaggaancgacccgagacaacggtnttacgtttacacgttagacgaagacgnggttancttaagtaaggttctttagagttggnggtaacgggg

SEQ ID NO: 420654 - DNA, 728 bp, Homo sapiens
  misc_feature: GZ8MTXP01EGITX.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggtttttcctttttgcttattgtagaaggtgtccatgtgaggtgcagcgtgggtgggaggtcggggggagcctggtcaggccgtgggggtccctgagactctcctgtgcagtcctcgtggtacttcgtacttctagtatttatagttagtagaagtcgggtccgccgaggcctaccggaggggaaggggtcgtgggaggttcgggtctacgattacctagttacgacgtaagtacgcccgaggttcggtacacgtaattaaattacttaacggactaacgtaactcggaagttacggggaacgggtccctacttaccaacacttccgacaaggaaacgaaccaaaccggaccaaaacgtaaccttacgtaacttacgtaaacgttaactaaacctaaaagtacgtaaacctaggttacgtaacggaacggaacggtaccgggaaacgggtaccgtaacggggttaaccttttacggtttaaacctacggttacgggtaaaccgaaggaaccgaggttaacgtaaccgttaaagttaacgggtttgtttaggttacggttgggttaacggggtaaccggggg

SEQ ID NO: 420655 - DNA, 694 bp, Homo sapiens
  misc_feature: GZ8MTXP01AET57.45.84.H07.1.454.CMB.2.raw
tcagacgcgatcgacacgaccggtgctcgatttagcagacgtctgtcgcggggagctctgagagaggagccttagccctggattccaaggcctatccacttggtgatcagcactgagcaccgaggattcaccatggcacgtggggctccgtcgttgggtttttccttttgctattgtagaggtgtccatggtgaggtgcagcgtgggtgggagggtcggggggagcgtggtacgacggtccggtcgggggtccctgacgtcctctccgtgtcgcacgtccttgtggtactcgtacttctagttatttagtagtaggtagtaacggtcgggtccgccgacggccgtacgggaagggggacggggtcgtaggggaggttcgggtcctacgacttacgtagttaccgacgtaggtacgacgtacggtacgtacaacgtaatactagttaccgacgtaacgtacgtacgagggtacggaaccgggtccctacttaacaactactacctacgaacgaaccaaccaaccgactaaagtacctctaacgttactaactaactaaacgaattacgaaacgtgtacggaagaccggtcggaacgaacggttaccgtacggttacgtttacgttaccttacggacgttaaccggaagaacgtaacgggtaacttacgttaacggttaacggtttcgtttaaggg

SEQ ID NO: 420656 - DNA, 829 bp, Homo sapiens
  misc_feature: GZ8MTXP01BA6A0.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcacgtggggctccgcttgggtttttccttttgctattgtagaaggtgtccatgtgaggtgcagcgtgggtgggaggtcgggggagccgtggtacaaggccgtgggggtccctgacgtactctccgtgtcgcacgtcctcgtggtacttcgtacttcagtatttagtagtgtagaaagtcgggtccgcgaggcgtccggaagggggaaggggtctaggggaggttcggggtctacgtaacgttccgtaaagtttacgaccgtaaggtaacgtacccgtaagggttacggtaaccaaaccgtaatttaaaacgttaaacgtttaaccggacgtaaacggtaccttaccggaaggttacgggaaacggggtcccctactttacgaaactacgtaccgtacccgaaaggaaccggaaaccaaaccggaacccaaaacggtaaccctaccggtaactttaacggttaacttaaccttaaaacgtaaaacgttacgaaaacgtacggtacgttaacggaaacggaccggaacccgggtaacggtaacccgtaaccgggttaaccttttaacggttttaaacccggtaacgtttaccgggtaaacggaacggttaaaccgttaagggttacgttaaaccgtttaaagggttaaaccggtttcggttttaaggagggtttcgggttaacgggggttaaacccggggg

SEQ ID NO: 420657 - DNA, 592 bp, Homo sapiens
  misc_feature: GZ8MTXP01AR48V.45.84.H07.1.454.CMB.2.raw
tcagacgcgatcgacacgaccggtgctcgatttagcagacgtctgtcgcggggagctctgagagaggagccttagccctggattccaaggcctatccacttggtgatcagcactgagcaccgaggattcaccatggcacgtggggctccgtcttgggtttttcctttttgcttattgtagaaggtgtccactgtgaggtgcagcgtggtggaggtcgggggagcctggtcaagccgtgggggtccctgagactctccgtgtcgcagcctctggtatcgacttcagttatttagtagtgtagaagtcgggtccgcaggctcgagggggagggctgggaggtgggtctcatccattacgcagtagcagtcggtacaactatatattacgcagactcagtcggaacgggcctcttacaaactagtcctacgaagacgaaccaacgacccaaagacctcgaacttgtaactactaaacaaattggaaacctgtacctagaacggacggcccgtaaggacctaacgggttcttacggttttaacacgttgaaccgtaacactaaggatccgtttaataaccggggttttgtttaagg

SEQ ID NO: 420658 - DNA, 760 bp, Homo sapiens
  misc_feature: GZ8MTXP01DY2UP.45.84.H07.1.454.CMB.2.raw
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggtttttcctttttgctattgtagaaggtgtccactgtgaggtgcagcgtgggtgggagggtcggggggagccgtggtcgaaggccggtgggggtccctgacgtactctccgtgtgcacgcctcgtggactcgacttcagttatttatagtgtagaagtcgggtccgcgaggcctacggaggggagggtctgggtaggttgggtctcgtatccgtagttacgccgtagtacgcgtaaggtcggtacaacgtaattacttaacttaccgactaacgtacgttcgaagggttacggaacggggtccctactttaccgaaactacgttcccaaccgaaggaaaccgaaacccgaaaacccggaccctaaaacggaaacccgttcttaaacccggttagttaaacctaaccgtaaaaacctaaaagttaacggaaaaaccgtggtttaacgtaaccgggaaaggaccggggaaacccggtacggggaaacccgttaaaccggggttactttaaacggttttaacccgttaacggtttacgggaaaccggaaacgtaaaccgaagggtaacccgtacgttaaacggtttaaagggtttccgtttttaagggg

SEQ ID NO: 420659 - DNA, 692 bp, Homo sapiens
  misc_feature: GZ8MTXP01DCF3G.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcacgtggggctccgcttgggttttcctttttgctattgtagaaggtgtccactgtgaggtgcagcgtgggtggagggtcggggggagccgtggtcaaggccgtgggggtccctgagactctcctgtgcagcctctggattcgacttcagtatttatagtgtagaagtggtccgccaggcctcgaggggaaggggctgggaggtgggtctctatcctagtttagcagtagcctaggtggtcaacataaacttatttaacgctaagactacgaggtaggaaacggggcccacttacaacctacgtacctacccgaaggaaacgaaccgaaaccgacccaaaagtaaacctacctaaccgttagttaacgttaaacgttaaaccaaaaagttacgaaaaccctaggttacccgtaagggaacggtaacggtaaccccggagggaaaccgtaccgggttaacgtttacgttttaaacgtaaccgttacgggttaaaccgaagttaacgaagacgaacctttaagtaaaggtttctttaggaggtttcggttcggggtaaccggggg

SEQ ID NO: 420660 - DNA, 651 bp, Homo sapiens
  misc_feature: GZ8MTXP01DNW3W.45.84.H07.1.454.CMB.2.raw
  modified_base (544)..(544): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggttttccttttgctattgtagaaggtgtccactgtgaggtgcagctgggtggagggtcggggggacgtcgtggtacaacggccgtggggggtccctggagactctcctgtgcagcctcgtggtatcgacttctaagttatttatagtttacgaagtacggtccgcgacgcgtccgtaggggaagggggcggtaggtaggttagggtccgtataccgtacctacgttagtaccccgagtagaccgtagtaggtaccgtaactaagtaattacgtaacgtacacgtaacgtccgtaaggtacggtaaagggggccgtacctttacaaactaactccgtaccaagaacggaacaaccgacttaaacgaactactacgtattactaacctaaanaaactacggaaacaccgttggtaccgagaacggccggaaacgtagcccggtattacggtacttacgacgttaggactgaagtcgtacagttaagtcgtttaagtaag

SEQ ID NO: 420661 - DNA, 736 bp, Homo sapiens
  misc_feature: GZ8MTXP01CSXU2.45.84.H07.1.454.CMB.2.raw
  modified_base (179)..(179): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggttttccttttgctattgtagagtntccatgtgaggtgcagcgtgggtgggaggtcggggggagcctggtcaaggccggtgggggtccctgacgtctctccgtgtcgcagtcctgtggatcgacttcagttattagtagtgtagaagtcgggtccgccgtaggcctaccggaagggggaacggggtcttaggggaggtcgggtctacgactccaagttacgcgtaagtgactaggttacggtaccaacgtaatacttaaacgttcgaccaagtactacgaaggtacggaaacgggtccctacgttaccaaacgtacttcccgtaacccgaaaggaccgttaaaccgaaaccggtaaccctaaaacggtaaccttacccgtaacccggtttaagttaaaccttaaaccgttaaacctaaaacgtttacgaaaacccgtagttcccgaaagggaaacggacccggtaacccggaaaggttacccgtaaccgggttcttttaaaccgtttaacgttaaccgttaggttaacccgaagtaaaccgaaggtaacgtaccgtttaaagttaaggttccgttttaaggg

SEQ ID NO: 420662 - DNA, 731 bp, Homo sapiens
  misc_feature: GZ8MTXP01A4WGE.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttccttttgctattgtagaaggtgtccactgtgaggtgcagcgtggtggaggtcgggggagccgtggtcaaggccgtgggggtccctgagtactctctgtgcacgcctcgtggtactcgtacttcagtatttatagtgtagaagtggtcccgcgaggacctccggaaggggaacggggtcgtacgggaggttcgggtcctacgacgtaccgtaagtttacggacctaaggtagcccccgtaggtaggtaccaaactagttaaacttaacgttaaccggcaaacggtacgtacgtaagggttacgggaaacgggcccgtacttaacaaacctacgtacccgtaccgaaggtaaaccgaacccgaacgaaccccgaaaagaaccctactaacgttacgtaaacttaaccgtaaacgtaaaacttacggaaacgtacgtaccgtaaggaacgcgggaaccgtacgggaccacgggtaactttaggttaaccctaagttcggaaacgcgttaaacgcgttaacgtaaccttaaaggttaaggtttccgtttaagttaggtttcgggttcggggttaaaccgggg

SEQ ID NO: 420663 - DNA, 677 bp, Homo sapiens
  misc_feature: GZ8MTXP01D9FXZ.45.84.H07.1.454.CMB.2.raw
  modified_base (631)..(631): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttccttttgctattgtagaaggtgtccactgtgaggtgcagcgtgggtgggagggtcgggggaggccgtggtcaaggccgtgggggtccctgagactctctgtgcagcctcgtggtacttcgtacttctagtattatagtgtagaagtcggtccgcgaggctccggaggggaggggcgtgggaggtcgggtctcatacctagttacgacgtagtacgaccgtaggttacggtactaactaattaaacttaacgtttaaccggactaaacggtacccgtacgaacgggttacggggaacgggggtccctacctttaacaaactacttacccgaccgaaaggaaaccgaaaccaaaccggaaccaaaacgtaacctacctaacgtttacgtaaacttaacctaaactaaagtacgaaacgtgtacgtaggaacgacggacgaaggaccgtcgtcttacgttactacgttagtacgaagacgngacgtcgtaagtaacgttcgttagacggttggttgggtaaccgggg

SEQ ID NO: 420664 - DNA, 665 bp, Homo sapiens
  misc_feature: GZ8MTXP01BT6Q7.45.84.H07.1.454.CMB.2.raw
  modified_base (258)..(258): a, c, t, g, unknown or other
  modified_base (520)..(520): a, c, t, g, unknown or other
  modified_base (527)..(527): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggtttttccttttgctattgtagaaggtgtccactgtgaggtgcagcgtggtgggaggtcggggggagcctggtcaagccgtgggggtcctgagactctctgtgcagcctntggtattcgacttcagtatttagtacgtgtagtaagtcgggtccgaccgaggccgtaccggaggggaacgggggtcgtgggtaggttgggtcctcgtacgttacctagtttacgcgtaggttacgccgtaggttcgtacaacgtaattaaacttacgttaacgacaacgtacttaccgaggtacgggaacgggccctacttacaactgtccaccgagaaaccgacaacggacctaaagactcaatcgtaactactaacaaancgtaacngttcgaggaacgcggtaccgacggtaccgccgggttaattacggtttaaaccgtacggttacgtaaaccgaagttaacggacgttagtaacgttaggttaacgggtttctttagggcggttgggttaacgggaacggg

SEQ ID NO: 420665 - DNA, 679 bp, Homo sapiens
  misc_feature: GZ8MTXP01EEI1P.45.84.H07.1.454.CMB.2.raw
  modified_base (633)..(633): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggtttttcctttttgctattgtagaaggtgtccactgtgaggtgcagcgtgggtgggagggtcggggggaggccgtggtcgaagccgtggggggtccctgagactctctgtgcacgcctcgtggactcgacttcagttatttatagtgtagaagtcgggtccgaccgaggcctaccggaagggggaacgggggtctagggtaggttggggtctacgataccctaattacggcaagtagcgtaggttacggtacaacgtaattaagttaacttaccgactaaggactacgaaagtagggaaacggggccctactttaacaaactacttaccgtacccaaggaacgaaacccgaaacgacccgtaaaacgtaaccgttacctaacgtttacgttaacttaaccgtaaacctaaaagtacggaaaacctagttaccgaggaacggacggaaccggaaggaccgtacggttcttagtttaaccngttcgttacgaacgagtaacgagtacttagttaaggttcgtttaag

SEQ ID NO: 420666 - DNA, 557 bp, Homo sapiens
  misc_feature: GZ8MTXP01EI2H2.45.84.H07.1.454.CMB.2.raw
  modified_base (344)..(344): a, c, t, g, unknown or other
  modified_base (428)..(428): a, c, t, g, unknown or other
  modified_base (517)..(517): a, c, t, g, unknown or other
  modified_base (536)..(536): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttcctttttgctattgtagaaggtgtccactgtgaggtgcagctggtggaggtcggggggagcctggtcaagccgtgggggtccctgagctctcctgtgcagcctctggattcgacttcagtatttatagtgtagaaatgggtccgcaggctccgagggaaggggctggagtgggtctcatccattagcagtanccagtgtcacataatatcgcaagactcagtggaacgggccacttacaacatctaccagaacgacaacgccaaagtaactcactntactactaacaaatgaaacctaggtactaggaacgacgacccggaaggaccacgggtcttacgtttactaccgttagtaacgagaacgngaggtaactaagtaaggtntttgatggttggtaacggggg

SEQ ID NO: 420667 - DNA, 895 bp, Homo sapiens
  misc_feature: GZ8MTXP01BUAE6.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttcctttttgctattgtagaaggtgtccatgtgaggtgcagctggtggaggtcgggggagcctggtcaagccgtgggggtccctgagactctccgtgtgcagcctcgtggtacttcgacttctagtatttatagttgtagaaagtcggggtcccgccgtaggccgtacccggaggggtaagggggctagggagtcgggggttactcgagttcccgtaagtttacgacgtaaggttacggccccgtagggtttacggtccgaaacctaagttaaacttaacgtttaaccggactaaacggggtaaccctttaccggaaagggttacgggggtaaaacgggggtcccccggtaccttttaccgaaaacctacggtacccttacccgaaagggtaaaaccgggaaacccaaaccggaaaccccgtaaaaaggaaaccccgttacccgtaaacctttaaccggttaaacgtttaaactttaaaacccgaaaaagttaacgggtaaaacctaaacggtttcccgttaaaggaaacgggtaaaccgggtaccccggggtaaagggaaccccggtaaaccggggttccgttttaaacgggttttttaaccccgtaaaccgggtttacggttaaaaccgggtacgttaaaaccccggagggttaaaccggttaaccgttaaaagggtttaacgggttttaacccgttttttgggaagggttttccggggtttaaggggttaaacccgggggg

SEQ ID NO: 420668 - DNA, 757 bp, Homo sapiens
  misc_feature: GZ8MTXP01E15VX.45.84.H07.1.454.CMB.2.raw
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggtttttcctttttgctattgtagaaggtgtccactgtgaggtgcagcgtgggtgggaggtcgggggggaggccgtggtcaaggccggttgggggggtccctggagacttctcctggtgcagcctgtggtatcgacttacagttatttagtagtgtagtaaagtcgggtcccgccgaggccgtaccggaagggggaacgggggtcgtagggggtaggtcgggggtcctacacgtacctagtttaaccgccgagtacgcgaggttcgggtaccaacctaagtaacttaacgtttaccgacaacgtactacgtaagggtacgggaaaccggggtcccgtactttaccgaaacgtactcccgtaaccaacgggaacgaaaccccgaaaccgacccaaacggtaacccttccgtaacgttaggttaacctaacctaaacctaaagtacgaaaccgtaggtaccgtaggtaacgggaccggaacccgggaacggacccggtaccgggttacgtttaacggttttaaacccacggttacggttaaccggaaggtaacgtaaacgggtacgtacggtttaaacggtttaacgggtttccgtttttaagggg

SEQ ID NO: 420669 - DNA, 684 bp, Homo sapiens
  misc_feature: GZ8MTXP01AC76U.45.84.H07.1.454.CMB.2.raw
  modified_base (431)..(431): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcacgtggggctccgtcttgggtttttcctttttgctattgtagaagtgtccatgtgaggtgcagcgtgggtgggaggtcggggggagccgtggtcgaacggtccggtggggggtccctggacgtacttccgtcctgtcgcgacgtccctgtggacttccgtacttcgtagttaattttagtacgtgtagaaagtcgggtccgccgaggcctaccggaagggggaggggctgggtagtcgggtctcactccgtattacgcgtagtacgactaggtcgtacaagtattatattacgnacgtacgtacaggtcgaacgggtctacttacaacgtctacgacaagaacaccgaacgaccaaacgacgttcaacttagttaactaacgtaaacaaacgtacgtaaactacggttaccaggaacggaaccggtaacccggaaacggttaacccggtacgttccgttttaaaccgtttaacgttacccgttaggttaaccggaaggacccgtaaggtacgtaccgtttaaaacgtgggttttaaccgtttaaggg

SEQ ID NO: 420670 - DNA, 652 bp, Homo sapiens
  misc_feature: GZ8MTXP01DFVIC.45.84.H07.1.454.CMB.2.raw
  modified_base (641)..(641): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggtttttcctttttgctattgtagaaggtgtccactgtgaggtgcagctgggtgggaggtcgggggagctggtcaaggccgtgggggtcctgagtactctcctgtgcagcctctggatcgacttcagttatttatagtgtagaagtcgggtccgacgaggctaccggaagggggaacggggcgtgggaggtgggtctcactcattacgctagtgctaggtcgacaactataattattacgacagtactcaggtaggaacgggcctacttacgaaactacgttccacgaggaacgaaccgaaaccgaccaaacgaaccttactaacgttagtaaccttaactaaacaaattacggaaactaggttacgtacggaagggtaccgaaccggaacggaacccgtacggccgttttaacggtttaccttaaacggttggaaaccggtaaggaaaaccgtaaggttaacgacgtttaaagttaaccggggtttntttttaagggg

SEQ ID NO: 420671 - DNA, 584 bp, Homo sapiens
  misc_feature: GZ8MTXP01ELUA5.45.84.H07.1.454.CMB.2.raw
  modified_base (269)..(269): a, c, t, g, unknown or other
  modified_base (413)..(413): a, c, t, g, unknown or other
  modified_base (418)..(418): a, c, t, g, unknown or other
  modified_base (465)..(465): a, c, t, g, unknown or other
tcagacgcgatcgacacgaccggtgctcgatttagcagacgtctgtcgcgggggagagaggagccttagccctggattccaaggcctatccacttggtgatcggagcactgagcaccgaggattcaccatggcactggggctccgctgggttttccttttgctattgtagaaggtgtccactgtgaggtgcagctggtggagtcgggggagcctggtcaagccgtgggggtccctgagactctcctgtgcagcctctggattcgacttnagtattatagtgtagaaatgggtcccgcaggctccgaggggaaggggctggagtgggtctcatccattagctagtagcaggtggtacactataactattaacgcaagactcgaagtggaaacgggcccgtacttcaaacatccnccaanaacggaacaaacgcccaaagaaacctcaacttgaattaccttaaaanaaactacgaacgaagtacgtagaacgacggaccggacggacgacggtcgttagtttacgttacttagtaacgtaacgacgagagtaactagtaaggttgttgttagtggttgggtgggg

SEQ ID NO: 420672 - DNA, 667 bp, Homo sapiens
  misc_feature: GZ8MTXP01BARGY.45.84.H07.1.454.CMB.2.raw
  modified_base (497)..(497): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactgggctccgctgggttttccttttgctattgtagaaggtgtccactgtgaggtgcagctggtggaggtcgggggagcctggtcaaggccgtgggggtccctgagactctcctgtgcagcctgtggacttcgacttcagtattatagtgtagaaagtcggtccgccgaggcctccgaaggggaaggggtctaggacggttgggtacctcgtacttccgtagttacgccgtaaggtcgacccgtaggtggtactaactattaaagttacttaacggactaaagtacctcgaagggttacggaaacggggccctacgtttacaacattcccgaccaagtacgaacctaacgaacccaaagaaccctntaacctagtaacgtacttaaacgaaacttcgaaaacgtcgtaccgtagaacgggacgtaccccggaaggtaccgtacgtcttacggtttacaccgttggaacgtaacgacgacggttacgtaaccgttagtaaccggttgttttaggacgtttgggttcgggtaacgggg

SEQ ID NO: 420673 - DNA, 702 bp, Homo sapiens
  misc_feature: GZ8MTXP01CN8QK.45.84.H07.1.454.CMB.2.raw
  modified_base (264)..(264): a, c, t, g, unknown or other
tcagacgcgatcgacacgaccggtgctcgatttagcagacgtctgtcgcggggagagaggagccttagccctggattccaaggcctatccacttggtgatcagcactgagcaccgaggattcacatggcacgtgggctccgcgttgggttttccttttgctattgtagaaggtgtccatgtgaggtgcagcgtggtggaggtcgggggagcctggtcgaaggccgtgggggtccctaggagactcgtcctgtgcagccgttcgnggtacttacggacttactagtattatagttgtagaaagtcggtccgcaggtcctaccgaagggtacggcgtaggagtcgggtactaccgagtaccgtaagttagaccgtaagtacgacccgtaggtacgtaccaacgtaattaaagttaacgttaacgaccgtaagtacgtacgagggttacggaaacgggccctacttccgaaactcgttacctcgaacgtaagaccgtaaaccgacgttaaacgaaacctccgtaagttccgtaagtaacccttaaaaggtaacaacgtaaacgaaactccggttacgaacggacgtacccggaaaggtaccgacgtgttacggttaacctacgttaacgtaccggaaacgttcgaaacgttagtaaccttaagtaaacgttccgttagttaacggttgttcggggtaacccgggg

SEQ ID NO: 420674 - DNA, 513 bp, Homo sapiens
  misc_feature: GZ8MTXP02GYK8C.45.84.H07.1.454.CMB.2.raw
  modified_base (397)..(397): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttcctttttgctattgtagaaggtgtccactgtgaggtgcagctggtggagtcgggggaggcctggtcaagcctgggggtccctgagactctcctgtgcagcctctggattcgacttcagtatttatagtgtgaaatgggtccgccaggctccgagggaaggggctgggagtgggtctcgatccattagcagtagcagtggtcacatatattacgcagactcagtgaaggccgcttacaanatctccagagacaacgaccaaagaactcactgtatactaacgaaatgaacagtctagagagccgaggacacggctacgttactactgtaacgaagacagagctaataagtctttag

SEQ ID NO: 420675 - DNA, 533 bp, Homo sapiens
  misc_feature: GZ8MTXP02IV8LY.45.84.H07.1.454.CMB.2.raw
  modified_base (429)..(429): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggaggcctggtcaagcctgggggtccctgagactctcctgtgcagcctctggattcgacttcagtattatagtgtgaaatgggtccgccaggctccgagggaggggctggagtgggtctcatccattagcagtagcagtgtcacatatatcgcagactcagtgaagggccgacttcaacatctccaagagaccaacgccaaagaactcaactgtactacttaanaaatgaaaccagtctaggaagacgcccgaaggacacggtcttggtttactacgtagtaaccgagaacagagctaagtaaggtctttagattcggtggtacgggg

SEQ ID NO: 420676 - DNA, 515 bp, Homo sapiens
  misc_feature: GZ8MTXP02GLIHP.45.84.H07.1.454.CMB.2.raw
  modified_base (393)..(393): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggaggcctggtcaagcctggggggtccctgagactctcctgtgcagcctctggattcgacttcagtatttatagtgtgaaatgggtccgccaggctccgaggggaaggggctgggagtggggtctcatccattacgcagtagcagtggtcacatatattacgcagactcagtgaaggggccnttcaacatctaccagagacaacgccaaagactcatgtatactaacaaatcgaacagtctagagagccgagacacggtctgtttaacactagtacgaagacagagctaagtacggtcttttag

SEQ ID NO: 420677 - DNA, 507 bp, Homo sapiens
  misc_feature: GZ8MTXP02FV2UB.45.84.H07.1.454.CMB.2.raw
  modified_base (387)..(387): a, c, t, g, unknown or other
  modified_base (480)..(480): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggaggcctggtcaagcctgggggtccctgagactctcctgtgcagcctctggattcgacttcagtatttatagtgtgaaatgggtccgcaggctccgagggaaggggctggagtgggtctcatccattagcagtagccagtggtcacatatattcgcagactcagtgaagggcgcttcaacntctccagacgacaacgccaagaactcactgtactctacaaatgaacagtctgagagccgaggacacggctgtttactactgtacgagacaganctataaggtctttagatgtgtacgggg

SEQ ID NO: 420678 - DNA, 526 bp, Homo sapiens
  misc_feature: GZ8MTXP02HH2DH.45.84.H07.1.454.CMB.2.raw
  modified_base (359)..(359): a, c, t, g, unknown or other
  modified_base (370)..(370): a, c, t, g, unknown or other
  modified_base (388)..(388): a, c, t, g, unknown or other
  modified_base (395)..(395): a, c, t, g, unknown or other
  modified_base (398)..(398): a, c, t, g, unknown or other
  modified_base (509)..(509): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggaggcctggtcaagccgtggggggtccctgagactctcctgtgcagcctctggattcgacttcagtattatagtgtagaaagtgggtccgccgaggctaccgaggggaaggggctggagtgggtctacatccattagcagtagccagtgtcanatatattacgnagactcagtgaagggccntacaacntcncagagacaaacgccaaagactacactgtaatctaaacaaatagaacagtacagagagccgagacacggtctacgtttacactagtaacgagacagacgaataagtaacgtntttagatggtacgcggg

SEQ ID NO: 420679 - DNA, 520 bp, Homo sapiens
  misc_feature: GZ8MTXP02F7S3G.45.84.H07.1.454.CMB.2.raw
  modified_base (390)..(390): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggaggcctggtcaagccgtgggggtccctgagactctcctgtgcagcctctggattcgacttcagtatttatagtgtgaaatggtccgccaggctccgagggaaggggctgggagtggggtctcatccattagcagtagcagtggtcacatatattacgcagactcagtgaagggccgnttacaacatctccaagagacaacgcccaaagaactcactgtaatctaaacaaatgaaacagtctagagagccgaggacacgggcttagtttactactgtaacgaagacagacgctaagtaaggcttttag

SEQ ID NO: 420680 - DNA, 582 bp, Homo sapiens
  misc_feature: GZ8MTXP02GV8ZX.45.84.H07.1.454.CMB.2.raw
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcggggggaggcctggtcaagccgtgggggtccctgagactctcctgtgcagcctctggattcgacttcagttatttatagtgtagaaatgggtccgccgaggctccgaggggaaggggctgggagtgggtctcatccattacgcagtagcagtggtcacatatattacgcagactcagtggaacgggcccgtacttacgaaactattccctaccgaagacgaaccaaacgaccaaagaacctcactagtaatacctaaacaaatacgaaactagtactagaacgacggacccggaggacctaccgggtcttacggtttaaccacgttagtaaccgaagaaccgagtacgacttaagtaacgggtttacgtttag

SEQ ID NO: 420681 - DNA, 522 bp, Homo sapiens
  misc_feature: GZ8MTXP02HL54E.45.84.H07.1.454.CMB.2.raw
  modified_base (491)..(491): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggaggcctggtcaagcctggggggtccctgagactctcctgtgcagcctctggattcgacttcagtatttatagtgtgaaatgggtccgccaggctccgagggaaggggctggagtggggtctcatccattagcagtagccagtgtcacatatattcgcagactcagtgaagggccgcttcaacatctcagagacaacgccaaagactcactgtatactaacaaatgaaactagtactaggaagagaccgagacgacggtctagtttactactgtacgagacaganaactagtaaggtctttagactgtaggtcggg

SEQ ID NO: 420682 - DNA, 532 bp, Homo sapiens
  misc_feature: GZ8MTXP02I79MC.45.84.H07.1.454.CMB.2.raw
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggaggcctggtcaagcctgggggtccctgagactctcctgtgcagcctctggattcgacttcagtatttatagtgtgaaatgggtccgccaggctccgagggaaggggctgggagtggggtctcgatccattacgcagtagcagtggtcacatatattacgcagactcagtggaaggccgcttacaacatctcagagacaacgacaaagactcactgtatctaacaaatgaacagtctagagagaccggaggacacgggacttacggtttactaactcggttaacgaagaacaaggacgactaataaagggtctttttagg

SEQ ID NO: 420683 - DNA, 539 bp, Homo sapiens
  misc_feature: GZ8MTXP02JGULH.45.84.H07.1.454.CMB.2.raw
  modified_base (327)..(327): a, c, t, g, unknown or other
  modified_base (513)..(513): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggagtcggggggaggcctggtcaagcctggggggtccctgagactctcctgtgcagcctctggattcgacttcagtatttatagtgtgaaatgggtccgccaggctccgagggaggggctggagtgggtcncatccattagcagtagccagtggtcacatatattcgcagactcgagtgaagggcccgcttcaacatcctccaagagaccaacggacccaaagaacctcactgtactactaacaaatagaaacagtactagacgagcccgaaggaccgacggtactgtttacacgtagtacgagacagagtcgtaanaacggtctttagattggtgtacgggg

SEQ ID NO: 420684 - DNA, 542 bp, Homo sapiens
  misc_feature: GZ8MTXP02GEK46.45.84.H07.1.454.CMB.2.raw
  modified_base (363)..(363): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttcctttttgctattgtagaaggtgtccactgtgaggtgcagctggtggagtcgggggaggcctggtcaagcctgggggtccctgagactctcctgtgcagcctctggattcgacttcagtatttatagtgtgaaatgggtccgccaggctccgagggaaggggctggagtgggtctcatccattagcagtagccagtgtcacatatattcgnagactcgagtgaagggcccgattcaacatctccaagacgaccaacgaccaaagaacctcactgaatctaacaaatagaaacagtctagaacgacgaccgaaggacacgggtcttagtttaactactaggtacgacgacagagtaagtaagtaaggtcttttagattggtggtacggggg

SEQ ID NO: 420685 - DNA, 555 bp, Homo sapiens
  misc_feature: GZ8MTXP02I5RY7.45.84.H07.1.454.CMB.2.raw
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttccttttgctattgtagaaggtgtccactgtgaggtgcagctggtggagtcggggggaggcctggtcaagccgtgggggtccctgagactctcctgtgcagcctctggattcgacttcagtatttatagtgtagaaagtgggtccgccaggctccgaggggaaggggcgtgggagtgggtctcgatccattacgcagtagcagtggtcacgatatattacgctagactcagtgaacgggccgacttacaaacatcctaccaagaacgaccaaacgaccaaagaacctacactagtactactaaacgaaatagaacagtctagacgagaccggaaggacacgggtcttacggtttaacctacgtgtacgaagacagacgataagtaacggtttctttag

SEQ ID NO: 420686 - DNA, 527 bp, Homo sapiens
  misc_feature: GZ8MTXP02HUV78.45.84.H07.1.454.CMB.2.raw
  modified_base (356)..(356): a, c, t, g, unknown or other
  modified_base (368)..(368): a, c, t, g, unknown or other
  modified_base (388)..(388): a, c, t, g, unknown or other
  modified_base (398)..(398): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttcccttttgctattgtagaaggtgtccactgtgaggtgcagctggtggagtcgggggagcctggtcaagcctggggggtccctgagactctcctgtgcagcctctggattcgacttcagtatttatagtgtgaaatggtccgcaggctccgagggaaggggctgggagtgggtctcatccattagcagtagcagtggcncatatattacgnagactcagtgaaggggcccnttacaaactntcctaccagacgacaacgaccaaagaacctcactgtactactaacaaaatgaaactagtactagagacgccgaggaccacggtctagtttacacgtgtaacgaagacagacgactagtaacgtctttag

SEQ ID NO: 420687 - DNA, 505 bp, Homo sapiens
  misc_feature: GZ8MTXP02IW4ER.45.84.H07.1.454.CMB.2.raw
  modified_base (376)..(376): a, c, t, g, unknown or other
  modified_base (380)..(380): a, c, t, g, unknown or other
  modified_base (387)..(387): a, c, t, g, unknown or other
  modified_base (392)..(392): a, c, t, g, unknown or other
  modified_base (405)..(405): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggagcctggtcaagcctgggggtccctgagactctcctgtgcagcctctggattcgacttcagtattatagtgtgaaatgggtccgccaggctccgagggaggggctggagtgggtctcatccattagcagtagccagtgtcacatatatcgcagactcagtgaacgggcncttnaacatcncaganacaacgcaagacncactgtaatctaacaaatgaaacagtctagagagccggagacacggcttgttactacgtgtacgagacagagctagtaaggtctttgatggtagtcgggg

SEQ ID NO: 420688 - DNA, 509 bp, Homo sapiens
  misc_feature: GZ8MTXP02G7ZP8.45.84.H07.1.454.CMB.2.raw
  modified_base (361)..(361): a, c, t, g, unknown or other
  modified_base (373)..(373): a, c, t, g, unknown or other
  modified_base (390)..(390): a, c, t, g, unknown or other
  modified_base (396)..(396): a, c, t, g, unknown or other
  modified_base (400)..(400): a, c, t, g, unknown or other
  modified_base (467)..(467): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggaggcctggtcaagcctgggggtccctgagactctcctgtgcagcctctggattcgacttcagtatttatagtgtgaaatgggtccgccaggctccgaggggaaggggctgggagtggggtctcatccattacgcagtagcagtggtcncatatattacgnagactcagtgaaggccnttcaanatcncagagacaacgcaaagaactcactgtatctaacgaaatgaaacagtctagagagccgaggacacggntacgttacacgtgacgaagacagacgctagtaaggtctttag

SEQ ID NO: 420689 - DNA, 524 bp, Homo sapiens
  misc_feature: GZ8MTXP02FJVXS.45.84.H07.1.454.CMB.2.raw
  modified_base (391)..(391): a, c, t, g, unknown or other
  modified_base (407)..(407): a, c, t, g, unknown or other
  modified_base (445)..(445): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggaggcctggtcaagccgtggggggtccctgagactctcctgtgcagcctctggattcgacttcagtatttatagtgtgaaatgggtccgccaggctccgagggaaggggctgggagtgggtctcgatccattagcagtagcagtggtcacatatattacgcagactcagtgaagggccnttcaacatctccaganacaacgccaaagactcactgtatctaacaaatgaaacngtctagagacgccggaggaccacgggcttacggtttactaactgtaacgaagacagacgctaagtaacggtcttttagg

SEQ ID NO: 420690 - DNA, 533 bp, Homo sapiens
  misc_feature: GZ8MTXP02HE6WM.45.84.H07.1.454.CMB.2.raw
  modified_base (305)..(305): a, c, t, g, unknown or other
  modified_base (371)..(371): a, c, t, g, unknown or other
  modified_base (403)..(403): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcgggggaggcctggtcaagccgtgggggtccctgagactctcctgtgcagcctcgtggattcgacttcagttatttatagtgtagaaagtgggtccnccgaggctaccgaggggaagggctgggagtggtctcatccattacgctagtagctagtggtaccanatattattacgcagactcagtgaaacgggccncttacaatatccacagacgacaacgacctaaagaactctaactgtactactaacaaatgaacagtcagagacgacgagacacggtctagtttacacgtgtacgaagacagacgctaagtaggtctttagg

SEQ ID NO: 420691 - DNA, 566 bp, Homo sapiens
  misc_feature: GZ8MTXP02GRHBF.45.84.H07.1.454.CMB.2.raw
  modified_base (281)..(281): a, c, t, g, unknown or other
  modified_base (336)..(336): a, c, t, g, unknown or other
  modified_base (360)..(360): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttcctttttgctattgtagaaggtgtccactgtgaggtgcagctggtggaggtcggggggaggcctggtcaagccgtgggggtccctgagactctcctgtgcagcctctggattcgacttcagttatttanagtgtagaaagtcgggtccgcaggctccgaaggggaggggctggaggtgggtctnatccattagcagtagccagtgcanatatattcgcagactcgagtaggaagggccgtactacaaacatcaccaagacgaaccaaccgacaaagaactcaactagtaatactaaacaaatagaaactagtgtagagaacgcggaagacacgggtacttaggttaactactaggtaacgaacgacaagagaacgttaagaacgggttctttagaagttcgtaggggtaacggg

SEQ ID NO: 420692 - DNA, 715 bp, Homo sapiens
  misc_feature: GZ8MTXP02J5ELY.45.84.H07.1.454.CMB.2.raw
  modified_base (213)..(213): a, c, t, g, unknown or other
  modified_base (218)..(218): a, c, t, g, unknown or other
  modified_base (249)..(249): a, c, t, g, unknown or other
  modified_base (267)..(267): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggtttaccttttgctattgtagaaggtgtccactgtgaggtgcagctggtggaggtcgggntcggngccaggtccgtaggggtcccctggggtaccngtacgtccttgtcgtagngcctcgtccgtattcggacttcacgttattagttattgtagtaagtcggtaccgcggtcggcccgtacggcgggtaaacgggcggtaagggggtcgttggggttaccgtcggtacctaccaatttaccccgagtttaaggccaaggttaaggtcgttacgtcgtaacttaaacttctaacgtaactcgaacgtacgtaacgtacgaacggggtaccgtccgggttcccgaaaccttactaacctacaaccgaccgaaaaccgaaacggacccaaaaccgttaaacccaactaaccttacgtaacttacgttaactaaaacttaacgaaactaaacggtaccttaggagtaacgggaccgaacgggtaccgaacggtacggtacgtttaccgttactttacgttaccgtaacgtacgacgaacgacggtctaaacgttacgtttaacgg

SEQ ID NO: 420693 - DNA, 503 bp, Homo sapiens
  misc_feature: GZ8MTXP02H1BC5.45.84.H07.1.454.CMB.2.raw
  modified_base (297)..(297): a, c, t, g, unknown or other
  modified_base (487)..(487): a, c, t, g, unknown or other
  modified_base (501)..(501): a, c, t, g, unknown or other
tcagacgcgatcgacacgaccggtgctcgatttagcagacgtctgtcgcgggcgtagactttgtgtttctcgtagtctgctttgctcagcgtcagggtgctgctctggctcccaggtgccaaatgtgacatccagatgacccaatctccttctaccctgtctgcatctgtaggagacagagtcaccatcacttgccgggccagtcaaagtattagtgactggttgcctggtatcagcagaaaccgggaaagcccctaaggcctgatctacagggcgtctagtctagaaagtggggtnccaccaaggtcagcggcagtggatctgggacagaattcactctcacatcagcagcctgcagcctgatgattttgctaactacttctgcctaaagaactgagtttttataggacgtttacgggccaaaggggacgaaaggtggaaaatcgaaaacgactggtaggctagcaccatctagcttcatcttccnccatctgatcatcncg

SEQ ID NO: 420694 - DNA, 547 bp, Homo sapiens
  misc_feature: GZ8MTXP02FRI80.45.84.H07.1.454.CMB.2.raw
  modified_base (296)..(296): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcgggggagcctggtcaagccgtgggggtccctgagactctcctgtgcagcctctggattcgacttcagtatttatagtgtagaaagtgggtccncaggctccgaggggagggctggagtgggtctcgatccattagcagtagccagtgtcacatatattacgcagactcagtagaaggggcctcgttacaaacatcctaccaagacgaaccaacgaccaaagaactcaactagtatactaaacaaattacgaactagtcagagacgaccgaggacacggtctagtttactactagtacgagacagacgaattaagtaacggtttcttagacgtggtacggtacgg

SEQ ID NO: 420695 - DNA, 542 bp, Homo sapiens
  misc_feature: GZ8MTXP02IGD0C.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcgggggaggcctggtcaagccgtgggggtccctgagactctcctgtgcagcctctggattcgacttcagtattatagtgtgaaatgggtccgccaggctccgaggggaagggcgtggagtgggtctcatccattagcagtagccagtggtcacatatatcgcagactcagtgaaagggccgcttacaaacatcctacccaagacgaaccaaacgaccaaagaacctcactagtactactaacaaactgaaacagtcagacgacgaccgagacgacggcttaggttactacgtagtaaccgagacagaggtctaagtaagtctttagatggttagacgggg

SEQ ID NO: 420696 - DNA, 524 bp, Homo sapiens
  misc_feature: GZ8MTXP02IHLTO.45.84.H07.1.454.CMB.2.raw
  modified_base (389)..(389): a, c, t, g, unknown or other
  modified_base (432)..(432): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttcctttttgctattgtagaaggtgtccactgtgaggtgcagctggtggagtcgggggaggcctggtcaagcctgggggtccctgagactctcctgtgcagcctctggattcgacttcagtatttatagtgtgaatgggtccgccaggctccgagggaaggggctgggagtgggtctcatccattacgcagtagcagtggtcacatatattacgcagactcagtgaagggccncttacaacatcctccagagacaacgccaaagaactcactgtanactaacaaatgaacagtctagagacgaccgaggaccacgggtctacgtttacacgtgtaacgaagtacagacgactagtaaggtcttttagg

SEQ ID NO: 420697 - DNA, 540 bp, Homo sapiens
  misc_feature: GZ8MTXP02GXLOV.45.84.H07.1.454.CMB.2.raw
  modified_base (327)..(327): a, c, t, g, unknown or other
  modified_base (364)..(364): a, c, t, g, unknown or other
  modified_base (436)..(436): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggagcctggtcaagcctgggggtccctgagactctcctgtgcagcctctggattcgacttcagtatttatagtgtgaaatgggtccgccaggctccgaggggaaggggctggagtgggtctnatccattagcagtagccagtcggtcacatatattcgnagactcagtgaagggcccgcttacaaacatctaccagacacaacgaccaaagaacctcactgtaatactaanaaatagaacagtctagagacgaccgagtacgacgtctagttactacgtacgtacgacgacagagaacgttaagtaaggtcttttagacgttagtaggtacgggg

SEQ ID NO: 420698 - DNA, 535 bp, Homo sapiens
  misc_feature: GZ8MTXP02HCH1R.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggagtcggggggagcctggtcaagcctgggggtccctgagactctcctgtgcagcctctggattcgacttcagtattatagtgtgaaatgggtccgccaggctccgaggggaaggggctggagtgggtctcatccattagcagtagccagtggtcacatatattacgctagactcgagtgaaggggcccattcaaactatctaccagacgaccaaacgacccaaagaacctcaactgtaatctaacaaatagaaacagtctagagacgccgaaggacacggacttagttactacgtagtacgagacagagctagtaacgtctttagagtgtggtacggg

SEQ ID NO: 420699 - DNA, 535 bp, Homo sapiens
  misc_feature: GZ8MTXP02I8Q0J.45.84.H07.1.454.CMB.2.raw
  modified_base (440)..(440): a, c, t, g, unknown or other
  modified_base (499)..(499): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcggggggagcctggtcaagccgtggggggtccctgagactctcctgtgcagcctctggattcgacttcagttatttatagtgtgaaatgggtccgccaggctccgaggggaaggggctggagtgggtctcatccattagcagtagccagtggtcacatatattcgcagactcagtggaaacgggccgacttcaaacatctcccaagacgaccaacgacccaaagaacctcaactgtanactaacaaatgaacagtcagagagccgagacacggctagttacactgtacgagacagancgtaagtaacggtctttagattcggtaggtacgggg

SEQ ID NO: 420700 - DNA, 529 bp, Homo sapiens
  misc_feature: GZ8MTXP02IED95.45.84.H07.1.454.CMB.2.raw
  modified_base (294)..(294): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcggggggagcctggtcaagccgtgggggtccctgagactctcctgtgcagcctctggattcgacttcagtatttatagtgtgaatgggtccnccaggctccgagggaagggctggagtgggtctcgatccattagcagtagccagtgtcacatatattcgcagactcagtgaaagggccgcttacaactatctccgaagacgaccaacgaccaaagactcaactgtatactaacaaatgaacagtactagagacgaccgaggacacggtctagtttacactagtacgacgactagagtaactagtaagtctttagatgtgtacgggg

SEQ ID NO: 420701 - DNA, 555 bp, Homo sapiens
  misc_feature: GZ8MTXP02JCKGR.45.84.H07.1.454.CMB.2.raw
  modified_base (373)..(373): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttcctttttgctattgtagaaggtgtccactgtgaggtgcagctggtggaggtcggggggagccgtggtcaagccgtgggggtccctgagactctcctgtgcagcctctggattcgacttcagtatttatagtgtgaaatgggtccgcaggctccgaggggagggctgggagtgggtctcatccattacgcagtagcagtgtcactatatattacgnagactcgagtggaaggccgtacttacaacactcctaccgaagacgaaccaaccgaccaaagaacctcaacgttgtaactactaaaccaaatcgaaacctagttacagaagcgaccgaggaccgacggtcttagtttaccacgttcgaacgaagactaggactactagtaacggtcttttagg

SEQ ID NO: 420702 - DNA, 524 bp, Homo sapiens
  misc_feature: GZ8MTXP02F5UR8.45.84.H07.1.454.CMB.2.raw
  modified_base (359)..(359): a, c, t, g, unknown or other
  modified_base (378)..(378): a, c, t, g, unknown or other
  modified_base (388)..(388): a, c, t, g, unknown or other
  modified_base (433)..(433): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggagcctggtcaagcctgggggtccctgagactctcctgtgcagcctctggattcgacttcagtatttatagtgtgaaatgggtccgcaggctccgagggaggggctggagtgggtctcatccattagcagtagccagtgtcacatatattcgnagactcagtgaacgggccncttcaaactntacctccgaagacgaccaacgccaaagacctcactgtatacctanaaatagaaaccagtctagagagcccgaaggacacggtctagtttactactgtaacgagacagagctaagtacgtctttgatgtgtacgggg

SEQ ID NO: 420703 - DNA, 550 bp, Homo sapiens
  misc_feature: GZ8MTXP02IERL9.45.84.H07.1.454.CMB.2.raw
  modified_base (283)..(283): a, c, t, g, unknown or other
  modified_base (388)..(388): a, c, t, g, unknown or other
  modified_base (398)..(398): a, c, t, g, unknown or other
  modified_base (426)..(426): a, c, t, g, unknown or other
  modified_base (431)..(431): a, c, t, g, unknown or other
  modified_base (444)..(444): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttcctttttgctattgtagaaggtgtccactgtgaggtgcagctggtggagtcgggggagcctggtcaagccgtgggggtccctgagactctcctgtgcagcctctggattcgacttcagtatttanagtgtagaatgggtccgcaggctccgaggggagggctgggagtgggtctcatccattagcagtagcagtgcacattatattacgcagactcgagtgaacgggccnttacaaactntcctcagacgacaacgaccaaagacctnacttntactacctaaaanaatacgaactagtagagacgacgaccggaaggaccgtacggtacttacgtttaccacgttagaaacgaagtaacgaagtacgtacttaaggttacgtttcgtttag

SEQ ID NO: 420704 - DNA, 518 bp, Homo sapiens
  misc_feature: GZ8MTXP02HR6DS.45.84.H07.1.454.CMB.2.raw
  modified_base (266)..(266): a, c, t, g, unknown or other
  modified_base (352)..(352): a, c, t, g, unknown or other
  modified_base (359)..(359): a, c, t, g, unknown or other
  modified_base (370)..(370): a, c, t, g, unknown or other
  modified_base (375)..(375): a, c, t, g, unknown or other
  modified_base (413)..(413): a, c, t, g, unknown or other
  modified_base (437)..(437): a, c, t, g, unknown or other
  modified_base (445)..(445): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggttttcctttttgctattgtagaaggtgtccactgtgaggtgcagctggtgggagtcggggggagcctggtcaagcctgtgggggtccctgagactctcctgtgcagcctcnggatcgacttcagtattatagtgtgaaatgggtccgcaggctcgaggggagggctggagtgggtctcgattccattagcagtagcngtgtcanatatattacgnagacnagtgagctctacaacactcacagacaacacgaccaaanactacatataactactaacaatanaacagtanagagacgacgacgacgacgtacgtacgttactacgtacgtaacgacgaacgacgagtacgtaacgtaagtacg

SEQ ID NO: 420705 - DNA, 513 bp, Homo sapiens
  misc_feature: GZ8MTXP02HCX3P.45.84.H07.1.454.CMB.2.raw
  modified_base (379)..(379): a, c, t, g, unknown or other
  modified_base (414)..(414): a, c, t, g, unknown or other
  modified_base (425)..(425): a, c, t, g, unknown or other
  modified_base (489)..(489): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggagcctggtcaagcctgggggtccctgagactctcctgtgcagcctctggattcgacttcagtatttatagtgtgaaatgggtccgccaggctccagggaagggctggagtgggtctcatccattagcagtagccagtggtcacatatattcgcagactcagtgaagggcccnttcaacatctccagagacaacgccaaagactcacngtaactctaanaaactgaaacagtctagaagagtccgaaggacacggctagtttacactgacgagacagagctanaacggtctttagatgtgtacgggg

SEQ ID NO: 420706 - DNA, 634 bp, Homo sapiens
  misc_feature: GZ8MTXP02HZ9DM.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactgggctccgctgggttttccttttgctattgtagaggtgtccactgtgaggtgcagctgggtggaggtcgggggagccgtggtcaagccgtgggggtccctggacgtactctcgtgtgcacgcctcgtggatcgacttcagttattatagtgtagaaagtcggtccgccaggcctaccggaggggaacgggcgtggaggttgggtctcagtaccagttacgcgtagtacgaccgagttcggtcaagtattaactagttacgcgaagtaaccttcgaagttaggaaacgggtcccgactttaccaaactacgtcctaccgaaagaacgaacaaaccggacccaaaagacctcaaacctgtactacttaaacaaatacgaaacagttacgacgaacgacggacccggaaggacccgaacgggttcttacgtttaacgtaccgtaggtaccgaacgacgacgagtaacgtaataacggtttcttaggtacgtaggtacggacgg

SEQ ID NO: 420707 - DNA, 514 bp, Homo sapiens
  misc_feature: GZ8MTXP02FNSOI.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggaggcctggtcaagcctgggggtccctgagactctcctgtgcagcctctggattcgacttcagtatttatagtgtgaaatgggtccgccaggctccgagggaaggggctggagtggggtctcatccattagcagtagccagtgtcacatatattcgcagactcagtgaagggccgcttcaacatctcggagacaacgcaaagactcactagtatctacaaatgaacagtctagagagcgaggacacggctacgtttactactgtacgagacagagactaagtaaggctttagatgtggaggggtaccg

SEQ ID NO: 420708 - DNA, 533 bp, Homo sapiens
  misc_feature: GZ8MTXP02HJ3AE.45.84.H07.1.454.CMB.2.raw
  modified_base (365)..(365): a, c, t, g, unknown or other
  modified_base (448)..(448): a, c, t, g, unknown or other
  modified_base (457)..(457): a, c, t, g, unknown or other
  modified_base (499)..(499): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggaggcctggtcaagccgtgggggtccctgagactctcctgtgcagcctctggattcgacttcagttattatagtgtgaaatgggtccgccaggctccgagggaaggggctggagtgggtctcatccattagcagtagccagtggtcacatatattacgnagactcagtgaaagggcccgcttacaaacatcctccgaagacgaacaacgaccaagaactcaatgtatctaacaaatgaaacngttacaganagaccgaggacacgggtctagtttacactgtaaccagacaanagctaagaacggtctttagactgttaggacgggg

SEQ ID NO: 420709 - DNA, 559 bp, Homo sapiens
  misc_feature: GZ8MTXP02JYOR0.45.84.H07.1.454.CMB.2.raw
tcagacgcgatcgacacgaccggtgctcgatttagcagacgtctgtcgcgggcgtagactttgtgtttctcgtagtctgctttgctcagcgtcagggtgctgctctggctcccaggtgccaaatgtgacatccagatgaaccaatctccttctaccctgtctgcatctgtaggagacagagtcaccatcacttgccgggcagtcaaagtattagtgactggttgcctggtatcagcaaggaaaccggggaacgcccctaaggtcctgactctacgagggcgtctagtctaggaaaggtggggtcaccgaacgaaggttcaggcggcaggtggatcgtaggggacagtaactcactctacaccatcagcagcctgcacgctgatgttatttgacttaacttctctcgacctaagtacttgttagttttagtcggtacgttcggacgaagggacgaaaggtagaaactagaaacgtactggtacgggctacggacctactagttcttacgtccttacaccttcccttccgaacctacttccgtgacgtcgacgtcgtccgg

SEQ ID NO: 420710 - DNA, 525 bp, Homo sapiens
  misc_feature: GZ8MTXP02HR9KT.45.84.H07.1.454.CMB.2.raw
  modified_base (387)..(387): a, c, t, g, unknown or other
  modified_base (436)..(436): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttcctttttgctattgtagaaggtgtccactgtgaggtgcagctggtggagtcgggggaggcctggtcaagcctgggggtccctgagactctcctgtgcagcctctggattcgacttcagtatttatagtgtgaaatgggtccgcaggctccgagggaagggctgggagtgggtctcgatccattagcagtagcagtggtcacatatattacgcagactcagtgaaggcgnttcaacattccacagagacaacgactaaagactcactgtatacctaaanaatagaactagtacgagacgacgaccggaggacacgtcttacgttacgtactacgacgaagacgacgactacgtaagtacgttctttag

SEQ ID NO: 420711 - DNA, 544 bp, Homo sapiens
  misc_feature: GZ8MTXP02F5SAO.45.84.H07.1.454.CMB.2.raw
  modified_base (369)..(369): a, c, t, g, unknown or other
  modified_base (460)..(460): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggtttccttttgctatgtagaaggtgtccactgtgaggtgcagctggtggagtcgggggagcctggtcaagccgtgggggtccctgagactctcctgtgcagcctctggattcgacttcagtatttatagtgtgaaatggtccgcaggctccgaggggaaggggctgggagtggggtctcgatccattagcagtagcagtggtcacgatatattacncagactcagtgaaacggccgtcttacaacatcctaccagacgaacaacgccaaagaactcactgtactacaacaaatgaaactagtcaganagccgaaggacgacgacgttacgtttacctaacgtcgttaaacgaagaacgaagtaacgacctaagtaaaccgggtttctttag

SEQ ID NO: 420712 - DNA, 551 bp, Homo sapiens
  misc_feature: GZ8MTXP02GJSIU.45.84.H07.1.454.CMB.2.raw
  modified_base (387)..(387): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcggggggaggcctggtcaagccgtggggggtccctgagactctcctgtgcagcctctggattcgacttcagtatttatagtgtgaaatgggtccgccaggctccgagggaggggctggagtgggtctcatccattagcagtagccagtggtcacatatattacgcagactcagtgaagggcccgnttacaaacatcctacagacgaccaacgaccaaagacctacgactgtaactactaacaaattgaaacagtactaggaacgacgaccgaggacacgggtcttagtttactactagtacgacgtacagacgctaagtaacggtctttagacttggtacggtacgggg

SEQ ID NO: 420713 - DNA, 549 bp, Homo sapiens
  misc_feature: GZ8MTXP02HOUH2.45.84.H07.1.454.CMB.2.raw
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggaggcctggtcaagcctggggggtccctgagactctcctgtgcagcctctggattcgacttcagtatttatagtgtgaatgggtccgccaggctccgaggggaaggggctgggagtgggtctcgatccattacgcagtagcagtggtcacatatattacgcagactcagtgaagggccacttcaactatcctaccagacgacaaccgaccaaagaactcaactgtaactactaacaaaattgaaacagtactggaagaggcccgaagggaccacgggtcttacggtttaactacgtagtaccgaagactaagacgtataacgtaacggtcttttagg

SEQ ID NO: 420714 - DNA, 545 bp, Homo sapiens
  misc_feature: GZ8MTXP02FSDBN.45.84.H07.1.454.CMB.2.raw
  modified_base (279)..(279): a, c, t, g, unknown or other
  modified_base (388)..(388): a, c, t, g, unknown or other
  modified_base (396)..(396): a, c, t, g, unknown or other
  modified_base (428)..(428): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcggggggagcctggtcaagccgtggggggtccctgagactctcctgtgcagcctctggattcgacttcagtatttanagtgtgaaatgggtccgcgaggctccgaggggaaggggctggagtgggtctcatccattagcagtagccagtggtacacatatatcgcagactcagtggaacgggcccnttcaaacntcctaccaagacgaccaaacgccaaagaaacnctaactgtaactactaacaaatagaacagtcagagagccggagacacggtcttagtttactactgtaacgagacagagaactaagtaaacgggttctttagagttggtacggtcggg

SEQ ID NO: 420715 - DNA, 546 bp, Homo sapiens
  misc_feature: GZ8MTXP02G9W5Z.45.84.H07.1.454.CMB.2.raw
  modified_base (401)..(401): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctgggtggaggtcggggggaggccgtggtcaaggccgtggggggtccctggagactctcctgtgcagcctctggattcgacttcagtatttatagtgtgaaagtgggtccgccaggctccgaggggaaggggctggagtgggtctcgatccattagcagtagccagtgtcacatatattacgcagactcagtgaaagggccgctcaaacntctaccagacgacaacgaccaaagaactcgactagtatactaacaaatgaaaccagtactagagacgccgaaggacgacggtcttaggtttactacgtgtaacgacgacagagaacgtagaacgtctttgatggtaggtacgggg

SEQ ID NO: 420716 - DNA, 546 bp, Homo sapiens
  misc_feature: GZ8MTXP02GLUGB.45.84.H07.1.454.CMB.2.raw
  modified_base (541)..(541): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttcctttttgctattgtagaaggtgtccactgtgaggtgcagctggtggagtcggggggaggcctggtcaagcctggggggtccctgagactctcctgtgcagcctctggatcgactcagtatttatagtgtagaaatggtccgcaggctccgagggaaggggctgggagtggggtctcgatccattagcagtagcagtggtcacatatattacgcagactcaagtgaaagggcccacttacaaactatcctaccaagaagaaccaaacgaccaaaagaacctcactagtatacctaaacaaaatcgaaaacagtctagagagaccgtaaggaccacggtcttagtttacacgttgaacgaagacagagctaaagtaacggtttntttag

SEQ ID NO: 420717 - DNA, 606 bp, Homo sapiens
  misc_feature: GZ8MTXP02GBYWO.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcggggggaggcctggtcaaggccgtggggggtccctgagactctcctgtgcagcctctggattcgacttcagtatttatagtgtagaaatgggtccgccgaggcctccgaggggaaggggctggaggtgggtctcgatccattagcagtagcctagtggtcactattatattcgacagactcgagtgaacgggccgtacttacaaacactcctaccagacaaccaacgacctaaagaactccaaactgtaactactaaacaaattacggaaactacgtactaggaacggacgacccggaaggaccgacggtactacggttttacaaccgttaggtaaccgagtaaccgagtaacgaacgttaaagtacgggttacttttaggacgttgggtacggtaccggggg

SEQ ID NO: 420718 - DNA, 564 bp, Homo sapiens
  misc_feature: GZ8MTXP02JWY9N.45.84.H07.1.454.CMB.2.raw
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttcctttttgctattgtagaaggtgtccactgtgaggtgcagctggtggagtcgggggaggcctggtcaagccgtggggggtccctgagactctcctgtgcagcctctggattcgacttcagtatttatagtgtagaaagtgggtccgccgaggctccgaggggaaggggctgggagtgggtctcatccattacgcagtagcagtggtcacatatattacgcagactcagtggaaagggcccgcttacgaaactatcctaccagaacgacaaccgacccaaagaaccttcaacttagtactactaaacaaatagaaacagtctagagacgccggaggaccacgggcttacggtttacctacgtaggtaacgaacgacgtaggacgtacgtagtaacgggtcttttagg

SEQ ID NO: 420719 - DNA, 602 bp, Homo sapiens
  misc_feature: GZ8MTXP02HUFXO.45.84.H07.1.454.CMB.2.raw
  modified_base (299)..(299): a, c, t, g, unknown or other
  modified_base (324)..(324): a, c, t, g, unknown or other
  modified_base (451)..(451): a, c, t, g, unknown or other
  modified_base (461)..(461): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttcctttttgctattgtagaaggtgtccactgtgaggtgcagctggtggaggtcgggggaggcctggtcaaggccgtggggggtccctggagactctcctgtgcagcctctggattcgacttcagttattatagtgtgaaatgggtccnccgaggcctaccgagggaaggggcnggaggtgggtctcatccattagcaagtagccagtggtcacatatatcgcagactcagtgaaacgggccgcttcaaactatctaccgagagacaacgaccaaagactcactagtactactaacaaatnaaacagtacngaagacgacccggaaggaaccgacggtacttaggtttaacctaaccgttaggtaacccggaagtaaaccaagggaaagaaccgttaaaacggtaaaaggttccgtttttaaggacgtttacgggtaggtaacccggggggg

SEQ ID NO: 420720 - DNA, 538 bp, Homo sapiens
  misc_feature: GZ8MTXP02JO751.45.84.H07.1.454.CMB.2.raw
  modified_base (394)..(394): a, c, t, g, unknown or other
  modified_base (458)..(458): a, c, t, g, unknown or other
  modified_base (488)..(488): a, c, t, g, unknown or other
  modified_base (508)..(508): a, c, t, g, unknown or other
  modified_base (533)..(533): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttcctttttgctattgtagaaggtgtccactgtgaggtgcagctggtggagtcgggggaggcctggtcaagccgtggggggtccctgagactctcctgtgcagcctctggattcgacttcagtatttatagtgtagaatggtccgccaggctccgaggggaaggggctgggagtgggtctcgatccattacgcagtagcagtgtcacatatattacgctagactcagtgaacgggccncttcaacatccaccgagacgacaacgaccaaagaacctcactgtactactaacaaatcgaaacngtacgtgaagacgaccgaaggacacgggtntacgtttacactcgtaacgngacaacgagactaagtaacggtttntttag

SEQ ID NO: 420721 - DNA, 584 bp, Homo sapiens
  misc_feature: GZ8MTXP02HP0QG.45.84.H07.1.454.CMB.2.raw
  modified_base (576)..(576): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttcctttttgctattgtagaaggtgtccactgtgaggtgcagctgggtggaggtcggggggaggcctgggtcaaggccgtggggggtccctgagactctcctgtgcagcctctggattcgacttcagtatttatagtgtgaaagtgggtccgccaggctccgaggggaaggggctgggaggtgggtctcatccattacgcagtagcagtggtcacattatattacgcagactcagtgaacgggccgacgttcaactatcctaccaaggacgaacaaccgaccaaagaacctactacttgtaacttacctaacaaaattcgaaacctagtacctagaacgacgaccggagggaccgacggtccttacgtttaaccgtacgttacgtaaccgaagaccaaggtacgacttaagtaacggttntttttagg

SEQ ID NO: 420722 - DNA, 651 bp, Homo sapiens
  misc_feature: GZ8MTXP02IW9C0.45.84.H07.1.454.CMB.2.raw
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttccttttgctattgtagaaggtgtccactgtgaggtgcagctggtgggaggtcggggggaggcctggtcaaggccgtggggggtccctgagactctcctgtgcagcctctggattcgacttcagttatttatagtgtagaagtcgggtccgcaggctccggaggggaggggctgggagtgggtctcagtccagttacgcagtagcgtagtggtacacgtataattaacgttacgaccgtaagactacgaaggtcgggaaacgggcccgtactttaccaaactattcccgaccgaagaacgaaacgaaaccgaccccaaaaggtaaacctaccctaagttacgtaactaacctaaaacaaaagttacgaaaccaagttactaaggaagaccggaaccgacggaaccaaacgggtctttacggtttaaacctaccgttaggaaaccgaacgaaacgaggtaaacgcctttaaaacggtacgggttactttttaagg

SEQ ID NO: 420723 - DNA, 559 bp, Homo sapiens
  misc_feature: GZ8MTXP02IDH3X.45.84.H07.1.454.CMB.2.raw
  modified_base (365)..(365): a, c, t, g, unknown or other
  modified_base (459)..(459): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcggggggaggcctggtcaagccgtggggggtccctgagactctcctgtgcagcctctggattcgacttcagttatttatagtgtagaaagtgggtccgccaggctccgaggggaaggggctgggagtgggctcatccattacgcagtagcagtggcncattatattaccgcagactcagtgaaacgggcccgcttacaacattccaccaagacgacaaccgtaccaaagaacctcaactagtactactaanaaattcgaaactgtactagaagaacgccggaaggaccacggtcttacgtttaacacgttagtacgaagacgaagacgacgttaagtaacggttctttagg

SEQ ID NO: 420724 - DNA, 623 bp, Homo sapiens
  misc_feature: GZ8MTXP02HWOW8.45.84.H07.1.454.CMB.2.raw
  modified_base (295)..(295): a, c, t, g, unknown or other
  modified_base (350)..(350): a, c, t, g, unknown or other
tcagacgcgatcgacacgaccggtgctcgatttagcagacgtctgtcgcgggcgtagactttgtgtttctcgtagtctgctttgctcagcgtcagggtgctgctctggctcccaggtgccaaatgtgacatccagatgacccaatctccttctaccctgtctgcatctgtaggagacagagtcaccatcacttgccgggcagtcaaagtattagtgactggtgctggtatcagcagaaaccggggaaagcccctaaggtcctgatctacagggcgtctagtctagaagtggggtnccacgaaggtcaggcggcaggtggatcgtgggacagaacttcactctacacatcngcagcctgcagcctgatgtatttgactaacttcttctcgacctaaagtaacttggttaagtttttagttacgggtacggtttcgggaccggtaaagggggtaaccggtaaaggggttaggaaaacttaccgaaaaacggtacgttgggtacgggcttacggacctaaccgtagttccccgttggtttaccctttaccgtaacctttccccgttcccccggtaaccttaacgttcccgttaggaacctttccggtaccgttttccggtcccggg

SEQ ID NO: 420725 - DNA, 552 bp, Homo sapiens
  misc_feature: GZ8MTXP02JUI9A.45.84.H07.1.454.CMB.2.raw
  modified_base (390)..(390): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcgggggaggcctggtcaagccgtgggggtccctgagactctcctgtgcagcctctggattcgacttcagttatttatagtgtgaaatgggtccgccaggctccgagggaaggggctgggagtggggtctcgatccattagcagtagccagtggtcacatatatcgcagactcagtggaagggcccgtnttccgaaacagtctacccagaacgaccaacgccaaagacctcgaacctgtatactaacaaatcgaaactagtcctagacgacgccggaagaccgacggccttaggtttaccacgttagacgtagacctagagtctagtaagtctttagattggagtacgggg

SEQ ID NO: 420726 - DNA, 605 bp, Homo sapiens
  misc_feature: GZ8MTXP02I5FUZ.45.84.H07.1.454.CMB.2.raw
  modified_base (253)..(253): a, c, t, g, unknown or other
  modified_base (293)..(293): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggagcctggtcaagcctgggggtccctgagactctcctgtgcagcctntggattcgacttcagtacttatagtgtagaaatgggtccncaggctccgagggaggctggagtgggtctcgatccgattacgctaggtagccgtagtcggtacactatactattcgctagtactcgagtacggaaacgggccctacttacgaaactactacgtacccgaagacgaccaacgccgaaacgtaacctcgaacgtcgttaactactaacgaacgtacgaaactcgttactaggaacgtacgaccgtaaggacacggtacttacgtttactacgtacgtacgtacgacctaggtaacgaacgttaaacgtacggtaccttttagacgttcggtacggtaaccgggg

SEQ ID NO: 420727 - DNA, 564 bp, Homo sapiens
  misc_feature: GZ8MTXP02IRT16.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttcctttttgctattgtagaaggtgtccactgtgaggtgcagctggtggaggtcggggggaggcctggtcaaggccgtggggggtccctgagactctcctgtgcagcctctggattcgacttcagtatttatagtgtagaaagtgggtccgccgaggctccgaggggaggggctggagtgggtctcgatccattagcagtagccagtgtcacatatatcgcagactcagtgaacgggcccgcttacaacatcctaccaagacacaaaccgaccaaagaacctcaacttagtaactactaacaaatacgaaacagtctagagacgaccggagacacggtcttagtttactactaggtaacgacgacagagtaacgttaagtaacggttctttagacgttggttaggtaacggggg

SEQ ID NO: 420728 - DNA, 586 bp, Homo sapiens
  misc_feature: GZ8MTXP02JUH89.45.84.H07.1.454.CMB.2.raw
  modified_base (261)..(261): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttcctttttgctattgtagaaggtgtccactgtgaggtgcagctggtggaggtcggggggaggcctggtcaaggccgtggggggtccctgagactctcctgtgcagcctntggattcgacttcagtatttatagtgtagaaagtgggtccgccgaggctccgaggggaaggggctggagtgggtctcgatccattagctagtagccgagtggtcactatatattcgcaagacctgagtaggaaacggggccctactttaccaaactactacctaccgaagaacgaaccaaacggaccctaaagaactcaactagtaactctaaactaaaatcgaaaccagttcaggaagacgacccggagaccgacggtctagtttacacgtagtacgagacaagacgtaataagtaacggtctttagagttggacggtacgggg

SEQ ID NO: 420729 - DNA, 517 bp, Homo sapiens
  misc_feature: GZ8MTXP02HNUP2.45.84.H07.1.454.CMB.2.raw
  modified_base (420)..(420): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggaggcctggtcaagcctggggggtccctgagactctcctgtgcagcctctggattcgacttcagtatttatagtgtgaaatgggtccgccaggctccgagggaaggggctggagtgggtctcatccattagcagtagccagtgtcacatatattcgcagactcagtgaagggccgcttcaacatctcagagacaacgccaaagactcactgtanctaacaaatgaacagtctagagacgccgaaggtacacggctagtttacactgtacgacgacagagaactataacggtctttagattggtgtacgggg

SEQ ID NO: 420730 - DNA, 533 bp, Homo sapiens
  misc_feature: GZ8MTXP02JA2ZM.45.84.H07.1.454.CMB.2.raw
  modified_base (379)..(379): a, c, t, g, unknown or other
  modified_base (496)..(496): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggagcctggtcaagccgtgggggtccctgagactctcctgtgcagcctctggattcgacttcagttatttatagtgtgaaatgggtccgccaggctccgaggggaagggctggagtgggtctcgatccattagcagtagcagtgtcacatatatcgcagactcagtgaaggccntcaacatctacagagaccaacgaccaaagactcactgtatctaacaaatgaaacagtctagacgacgaccgaaggacgacggtcttaggtttaacacgttagaccgaagaacagacncgtaagtaacggttctttagacttggtaggtacgggg

SEQ ID NO: 420731 - DNA, 574 bp, Homo sapiens
  misc_feature: GZ8MTXP02INQV0.45.84.H07.1.454.CMB.2.raw
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttcctttttgctattgtagaaggtgtccactgtgaggtgcagctggtgggaggtcgggggaggcctggtcaagccgtgggggtccctgagactctcctgtgcagcctctggattcgacttcagttatttatagtgtagaatgggtccgcgaggctccgaggggaaggggcgtgggaggttgggtctcgatccattacgcagtagcagtggtcacatatattaccgcagactcgagtgaacggggccctacttacaaatactccgtaccagaacgaaccaacgaccaaagactacactgtacactaacaaatcgaaactgtctagaagcggacccgagggacacgggttcttacgtttaccgtacgttaggtaccgaagacgaaggtacgtacttaaggttaaccgggtttacttttag

SEQ ID NO: 420732 - DNA, 547 bp, Homo sapiens
  misc_feature: GZ8MTXP02HNLDN.45.84.H07.1.454.CMB.2.raw
  modified_base (342)..(342): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttccctttttgctattgtagaaggtgtccactgtgaggtgcagctggtggagtcggggggaggcctgggtcaagccgtggggggtccctgagactctcctgtgcagccctctggattcgacttcagtattatagtgtagaaatgggtccgccaggctccgaggggaaggggctgggagtgggtctnatccattacgcagtagcaggtggtcacataatacttacgcagactcagtagaagggcccgcttacaacattccaccaagaacgacaacgaccaaagaactacactgtaactacaacaaaatgaaaccagtcagaagagaccgaggaccacggcttagtttaactactgtaccgaagacaagacgactaagtaacggtattttagg

SEQ ID NO: 420733 - DNA, 558 bp, Homo sapiens
  misc_feature: GZ8MTXP02H8I7P.45.84.H07.1.454.CMB.2.raw
  modified_base (389)..(389): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcggggggaggcctggtcaaggccgtggggggtccctgagactctcctgtgcagcctctggattcgacttcagtatttatagtgtgaaatgggtccgccaggcctccgagggaggggctggagtgggtctcatccattagcagtagccagtggtcacatatattcgcagactcagtggaaagggcccncttcaacatcctaccagacgacaacgaccaaagactcactgtatactaacaaatgaacagtactaggaagacgcccggaaggaccgaacgggtcttaggtttacctacgtacggtacgacgacgtagagtaactagtaacggttcttttagacgttggtaggtacgggg

SEQ ID NO: 420734 - DNA, 569 bp, Homo sapiens
  misc_feature: GZ8MTXP02JL8X7.45.84.H07.1.454.CMB.2.raw
  modified_base (349)..(349): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcgggggagcctggtcaagccgtggggggtccctgagactctcctgtgcagcctctggattcggacttcagttatttatagtgtgaaatgggtccgccaggctccgagggaaggggctggagtgggtctcgatccattagcagtgccngtggtcacattatattcgcaggactcgagtggaaagggccgcttcaaacatctaccaagacacaacgccaaagaacctcactgtatactacgaaattcgaaacacgttcaggaagcgaccggaaggacacggtacttacgttaactacgtacggttacgaacgaccgtaagaagtaacgtaacttaaacgggttactttagacgttcggtacggtacggg

SEQ ID NO: 420735 - DNA, 583 bp, Homo sapiens
  misc_feature: GZ8MTXP02JCYI4.45.84.H07.1.454.CMB.2.raw
  modified_base (351)..(351): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttccttttgctattgtagaaggtgtccactgtgaggtgcagctggtggaggtcggggggaggcctggtcaaggccgtggggggtccctgagactctcctgtgcagcctcgtggattcgacttcagttatttatagtgtagaaagtgggtccgcaggctccgaggggaggggctggagtgggtctcatccattagcagtancagtgtcacatatatcgcagactcgagtagaacgggccacttacaaacactacctaccaagacgaaccaaaccgacccaaagaacctacctaacgtgttaaactactaaacaaatacgaaaccagtcgtagaacgaacgcccgaaggaccgacggtcttagtttacctacgtacgtaaccggagaccaggacgaactaagtaacggttctttaggattcggtaggtacgggg

SEQ ID NO: 420736 - DNA, 526 bp, Homo sapiens
  misc_feature: GZ8MTXP02HSZ2E.45.84.H07.1.454.CMB.2.raw
  modified_base (355)..(355): a, c, t, g, unknown or other
tcagacgcgatcgacacgaccggtgctcgatttagcagacgtctgtcgcgggcgtagactttgtgtttctcgtagtctgctttgctcagcgtcagggtgctgctctggctcccaggtgccaaatgtgacatccagatgacccaatctccttctaccctgtctgcatctgtaggagacagagtcaccatcacttgccgggccagtcaaagtattagtgactggttgcctggtatcagcagaaaccggggaagcccctaaggtcctgatctacaggcgtctagtctaggaaagtggggtgccaccgaaggttcaggcggcaggtggatcgtggggacagaacttcactctcacatcngcagcctgcagctgatgatttgactaactttcttctcgacctaaagtaacttgtaagtttttagtgggtacgtttcgggaccgaaggggtacgaagggttaggaaatcgaaaacgacgtgtggctgactaccatctgtcttcacttcctccgctatctgactcgatcgtcg

SEQ ID NO: 420737 - DNA, 531 bp, Homo sapiens
  misc_feature: GZ8MTXP02GXRGA.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggaggcctggtcaagcctgggggtccctgagactctcctgtgcagcctctggattcgacttcagtattatagtgtgaaatgggtccgccaggctccgagggaaggggctggagtgggtctcatccattagcagtagccagtgtcacatatattcgcagactcagtgaaacgggcgcttcaacatctaccagagacaacgccaaagaactcaactgtatactaacaaatgaacctagtctagagacgccgaagggacaacggtctagtttacacgtagtaaccgagacaagagcgtaagtaacggtttcttagagtggtggtacggg

SEQ ID NO: 420738 - DNA, 523 bp, Homo sapiens
  misc_feature: GZ8MTXP02GPOOS.45.84.H07.1.454.CMB.2.raw
  modified_base (294)..(294): a, c, t, g, unknown or other
  modified_base (381)..(381): a, c, t, g, unknown or other
  modified_base (385)..(385): a, c, t, g, unknown or other
  modified_base (389)..(389): a, c, t, g, unknown or other
  modified_base (436)..(436): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggaggcctggtcaagcctggggggtccctgagactctcctgtgcagcctctggattcgacttcagttattatagtgtgaaatgggtccnccaggctccgagggaaggggctggagtgggtctcgatccattagcagtagccagtgtcacatatatcgcagactcagtgaagggccncttnaacntctcagagaccaacgccaaagaactcaatgtatctaacaaatgaacngtactgagagccgaggacacggtctacgtttacacgttgaacgagaacgagaagctaagtaaggtctttagactggtaggtacgggg

SEQ ID NO: 420739 - DNA, 531 bp, Homo sapiens
  misc_feature: GZ8MTXP02IGLP8.45.84.H07.1.454.CMB.2.raw
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttccttttgctattgtagaaggtgtccactgtgaggtgcagctggtggagtcggggggaggcctggtcaagccgtggggggtccctgagactctcctgtgcagcctctggattcgacttcagtatttatagtgtgaaatgggtccgcaggctccgagggaaggggctgggagtgggctcgatccattacgcagtagcagtgcacatatattacgcagactcagtgaaggtccgcttacaacatcctaccaagacgaacaacgcaaagacctcaactgtatctaacaaagtgaaactagtctagagacgaccgaggtaccacggtactacgtttacacgtgtaaccgaagaacgagaggactagtaagtctttagg

SEQ ID NO: 420740 - DNA, 541 bp, Homo sapiens
  misc_feature: GZ8MTXP02H741O.45.84.H07.1.454.CMB.2.raw
  modified_base (360)..(360): a, c, t, g, unknown or other
  modified_base (369)..(369): a, c, t, g, unknown or other
  modified_base (371)..(371): a, c, t, g, unknown or other
  modified_base (397)..(397): a, c, t, g, unknown or other
  modified_base (400)..(400): a, c, t, g, unknown or other
  modified_base (504)..(504): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatgtcactggggctccgctgggttttccttttgctattgtagaaggtgtccactgtgaggtgcagctggtggaggtcggggggaggcctggtcaagccgtggggggtccctgagactctcctgtgcagcctctggattcgacttcagttattatagtgtagaaagtgggtccgccgaggctccgaggggaaggggcgtggaggtgggtctcatccatagcagtagcagtgtcanatatatcgnanactgagtgaaggcccgacttcaaacntcnccagacgacaacgacaaagactacactagtatactaacaaatgaaacagtacagaagacgaccgagacacggtcttacgttacacgtagaacgagaacaagganaacgtaagtaaggtctttaggacttggtaggacgggg

SEQ ID NO: 420741 - DNA, 588 bp, Homo sapiens
  misc_feature: GZ8MTXP02GOK1K.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttcctttttgctattgtagaaggtgtccactgtgaggtgcagctggtggaggtcggggggaggcctggtcaagccgtggggggtccctgagactctcctgtgcagcctctggattcgacttcagtatttatagtgtgaaatgggtccgccaggctccgagggaggggctggagtgggtctcatccattagcagtagccagtgtcacatatatcgcagactcgagtgaaacgggcccgtcttcaaacatcctaccaagaacgaacccaaacgacccaaaagaacctaccaaccttagtaacttacctaaaccaaaattacggaaacagtcctaggaagacggcccggaaggaaccacggggtacttacggttttactacgtacgtaaccgagaaccgagagaacgtaagtaaggtctttagaacgtggtaggtacgggg

SEQ ID NO: 420742 - DNA, 533 bp, Homo sapiens
  misc_feature: GZ8MTXP02IJ2AA.45.84.H07.1.454.CMB.2.raw
  modified_base (383)..(383): a, c, t, g, unknown or other
  modified_base (410)..(410): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggagcctggtcaagcctgggggtccctgagactctcctgtgcagcctctggattcgacttcagtatttatagtgtgaaatgggtccgccaggctccgagggaaggggctggagtgggtctcatccattgcagtgccagtggtcacatatattacgcagactcagtgaagggccgcttnaacatctccagagacaacgcaaagacncactgtatctacaaatgaacagtactagagacgcgagacacgtcgtacttattacgtacgtacgtaacgaacgtacgaagaacgtagttaacggtacgtttgtttagtacgttggtacggggg

SEQ ID NO: 420743 - DNA, 581 bp, Homo sapiens
  misc_feature: GZ8MTXP02GXUEB.45.84.H07.1.454.CMB.2.raw
  modified_base (295)..(295): a, c, t, g, unknown or other
  modified_base (398)..(398): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggaggcctggtcaagccgtggggggtccctgagactctcctgtgcagcctctggattcgacttcagtatttatagtgtgaaatgggtccnccagctccgaggggaaggggctggagtgggtctcatccattagcagtagccagtgtcacatatattcgcagactcgagtggaacggggcccgtcttcaaactntcctacccgaagacgaacccaaaccggacccaaagaacctacaacgttagttaactacttaacaaaattcggaaactagtcgtagagacgccgaggacacggtctaggtttaccacttggtaacgacgaccagtacgaacttaagtaacggttactttaggtacttgggtacggtaccggggg

SEQ ID NO: 420744 - DNA, 551 bp, Homo sapiens
  misc_feature: GZ8MTXP02GPYB1.45.84.H07.1.454.CMB.2.raw
  modified_base (517)..(517): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcggggggaggcctggtcaagccgtggggggtccctgagactctcctgtgcagcctctggattcgacttcagttatttatagtgtgaaatgggtccgccaggctccgaggggaaggggctggagtgggtctcatccattagcagtagccagtggtacacatatattacgcagactcagtggaaacggggcccgtcttacaaactactcctacccaagaacgaccaaacggacccaaagaactcactagttactactaacaaaatgaaacagtactgagacgccgagacacgctagtttacactgtacgagacaganaacgtagtaagtcttttagagttgtggtacgggg

SEQ ID NO: 420745 - DNA, 621 bp, Homo sapiens
  misc_feature: GZ8MTXP02F37LX.45.84.H07.1.454.CMB.2.raw
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggttttccttttgctattgtagaaggtgtccactgtgaggtgcagctgggtgggaggtcggggggaggcctggtcaaggccgtgggggtccctgagactctcctgtgcagcctcgtggattcgacttcagttatttatagtgtagaaagtgggtccgcaggctccgaggggagggctgggagtggggtctcgatccagttacgctagtagctaggtggtcactatatattacgcaagacctgagtagggaaacggggccctacttacgaaactacttaccctaccaaggaacgaaccaaacccggaaccaaaagtaaaccttcaacgttattaactaacctaaacaaaatcgaaaacacgttacaggaacgacgaccggaaggaccgaccgggtactttaacgtttaccctaagttacggtaacgaacgacgtaagaacgtaccgtaaacgtaaggtttcttttaagg

SEQ ID NO: 420746 - DNA, 566 bp, Homo sapiens
  misc_feature: GZ8MTXP02HZCX7.45.84.H07.1.454.CMB.2.raw
  modified_base (381)..(381): a, c, t, g, unknown or other
  modified_base (400)..(400): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggttttcctttttgctattgtagaaggtgtcactgtgaggtgcagctggtggaggtcggggggaggcctgggtcaagccgtggggggtccctgagactctcctgtgcagcctctggattcgacttcagtatttatagtgtagaaatgggtccgcaggctcgaggggaaggggctgggagtgggtctcgatccattacgcagtagcgagtggtacacaatatattacgnagactcagtgaagggcccntacaacatcacaagagacaaacgccaaagactcaactgtactactaaacaaagtcgaaactaggtctaggaacgagacccggaaaggtaccaacgggtcctttaggtttaaacctactaggtaaacgaagaacgaaggtagacttaagtaacgggtttactttagg

SEQ ID NO: 420747 - DNA, 550 bp, Homo sapiens
  misc_feature: GZ8MTXP02FRDWI.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcggggggaggcctggtcaagccgtggggggtccctgagactctcctgtgcagcctctggattcgacttcagtatttatagtgtgaaatgggtccgccaggctccgaggggaggggctggagtgggtctcgatccattagcagtagccagtgcacatatattcgcagactcagtgaacgggcccacttacaaactatcctaccaagacgaaccaacgacccaaagaaacctcaactgtaattacctaaacaaatagaacagtcagagacgccgaagacacggtacttgtttacactagtacgagacgagagcgttaagtaacggttctttagagtcggtaggtacgggg

SEQ ID NO: 420748 - DNA, 516 bp, Homo sapiens
  misc_feature: GZ8MTXP02GRCL8.45.84.H07.1.454.CMB.2.raw
  modified_base (383)..(383): a, c, t, g, unknown or other
  modified_base (390)..(390): a, c, t, g, unknown or other
  modified_base (398)..(398): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggagtcggggggaggcctggtcaagcctggggggtccctgagactctcctgtgcagcctctggattcgacttcagtatttatagtgtgaaatgggtccgccaggctccgagggaaggggctggagtgggtctcatccattagcagtagccagtggtcacatatattcgcagactcagtgaagggccnttcaacntctcaganacaacgccaaagactcactgtatctaacaaatgaaacagtctagagacgccgaaggacacggctagtttacactgtacgagacagagctagtaacgtctttagattggtcgtacgggg

SEQ ID NO: 420749 - DNA, 575 bp, Homo sapiens
  misc_feature: GZ8MTXP02F3MYI.45.84.H07.1.454.CMB.2.raw
  modified_base (187)..(187): a, c, t, g, unknown or other
  modified_base (409)..(409): a, c, t, g, unknown or other
  modified_base (438)..(438): a, c, t, g, unknown or other
  modified_base (455)..(455): a, c, t, g, unknown or other
  modified_base (524)..(524): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactgggctccgctgggttttccttttgctattgtagaaggtgtccactgtgaggtncagctggtggagtcgggggagcctggtcaagccgtgggggtccctgagactctcctgtgcagcctctggattcgacttcagtatttatagtgtgaagtggtccgccaggctccgagggagggcgtggagtgggtctcactccattagcagtagccagtgtcacatatattacgctagactacgagtaggacgggccgcttacaaactatccgtaccaggganaccaaacgccaaagacctcacgtgtaacnctacgaaatggaaaccnggtctaggaagacgccgtaaggaccacggttctagttttacaccgtaggtaaccgagtaaccaaggtanaacgttaaacgtaagggttcttttagaacgttgggtttaccggtaacgggg

SEQ ID NO: 420750 - DNA, 534 bp, Homo sapiens
  misc_feature: GZ8MTXP02G45SE.45.84.H07.1.454.CMB.2.raw
  modified_base (396)..(396): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcggggggaggcctggtcaagccgtgggggtccctgagactctcctgtgcagcctctggattcgacttcagtatttatagtgtagaaagtggtccgccaggctccgaggggaaggggctgggagtgggtctcatccattacgcagtagcagtcggtacacgatatatacgcagactcagtgaagggccncttacaactatcctaccagacacaacgaccaaagaactcactgtactactaaacaaatacgaacagtcagagacgaccgaggtacacgtcttacgttactactcgtaacgaagacaagacgatactaaggtctttagg

SEQ ID NO: 420751 - DNA, 537 bp, Homo sapiens
  misc_feature: GZ8MTXP02JHBIY.45.84.H07.1.454.CMB.2.raw
  modified_base (381)..(381): a, c, t, g, unknown or other
  modified_base (413)..(413): a, c, t, g, unknown or other
  modified_base (427)..(427): a, c, t, g, unknown or other
  modified_base (502)..(502): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggagtcggggggaggcctggtcaagccgtgggggtccctgagactctcctgtgcagcctctggattcgacttcagttatttatagtgtgaaatgggtccgcaggctccgagggaggggctggagtgggtctcatccattagcagtagccagtgtcacatatattcgcagactcagtgaagggccncttacaacatctccagacacacgacaagactnactgtaactctaanaaatgaaacagtcgtagagacgaccggaaggaccgacgggtcttacgtttaactaccgtagtacgacgaacagancgtaagtaacggtctttagattaggtggtacgggg

SEQ ID NO: 420752 - DNA, 630 bp, Homo sapiens
  misc_feature: GZ8MTXP02JQE83.45.84.H07.1.454.CMB.2.raw
  modified_base (518)..(518): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttcctttttgctattgtagaaggtgtccactgtgaggtgcagctggtggaggtcggggggaggcctggtcaaggccgtgggggtccctgagactctcctgtgcagcctcgtggattcgacttcagttatttatagtgtagtaagtcgggtccgcgaggcctaccggaggggaacgggtcgtgggaggttcgggtctcgtactccgtattacgcgagtacgcgaggtcggttacacgtaattaattacgttaccgacgtaacgacgttcaaggggttcggaaacggggtccctactttacaaacgtattcccaccgaagacaaccaacggacaaagtacctacacgttagtacttaccaaaanaagtacgaactagtacgaagaacgacggaacggacgtacgtacgttactttacgttacgacgttacgaacgaagaacgtaagtacgtacgttaaaggttcgtttagtttagg

SEQ ID NO: 420753 - DNA, 545 bp, Homo sapiens
  misc_feature: GZ8MTXP02FTUYK.45.84.H07.1.454.CMB.2.raw
  modified_base (295)..(295): a, c, t, g, unknown or other
  modified_base (385)..(385): a, c, t, g, unknown or other
  modified_base (447)..(447): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcggggggagcctggtcaagccgtgggggtccctgagactctcctgtgcagcctctggattcgacttcagtatttatagtgtgaaatgggtccnccaggctcgagggaaggggctggaggtgggtctcatccattagcagtagccagtggcacatatattcgcagactcagtgaacgggccgtnttcaacatcctaccagacgacaaccgaccaaagaactcactagtatactaacaaatacgaanacgtctagagacgaccgaggaccacggtctagtttacacgtagtaacgagaacagagaacgttaagtaacggttctttagagttggtaggtacggggg

SEQ ID NO: 420754 - DNA, 548 bp, Homo sapiens
  misc_feature: GZ8MTXP02HYLOG.45.84.H07.1.454.CMB.2.raw
  modified_base (272)..(272): a, c, t, g, unknown or other
  modified_base (346)..(346): a, c, t, g, unknown or other
  modified_base (468)..(468): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcacgtggggctccgcttgggtttttcctttttgcttattgtagaggtgtccatgtgaggtgcaggctggtgggagggtcggggggaggcctggtcaaggccggtggggggtccctgagctctcctgtgcagcctcnggattcgacttcagtatttatagtgtgaaagtgggtccgccgaggctccgagggaaggggctgggaggtggtcncatccattagcagtagctagtggtcacataataattacgctaagacttcagtaggaacggccgcgttcaaacatctacagacgacaacgaccaaagaactacactagtatactaacaaatanaacagtactagagacgcgaggacgacgtcttacgtttactactagtacgaagaacagacactaacgtaagttactttagg

SEQ ID NO: 420755 - DNA, 649 bp, Homo sapiens
  misc_feature: GZ8MTXP02I4SQM.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcacgtggggctccgcttgggttttcctttttgctattgtagaaggtgtccactgtgaggtgcagcgtgggtggaggtcggggggaggcctggtcaaggccgtggggggtccctggagactctcctgtgcagcctcgtggattcgacttcagttatttatagtgtagaaagtcgggtccgccgaggcctccggaaggggaaggggcgtgggagttggggtctcgactccagttagctaagtagccgtagtcggtcaacgtattaatattacgcaagactacgaggtaggaaacgggcccgtacttaccaaacgtactctacccaagacgaaccaaacgaccaaagaacctcaactagtaactacgtaaacaaagtacgaaaacgtagttaccaggaacgaacggaccccgaaagggaccgaacgggtctttacggtttaacctaacgttaggtaaccgagaaccgagaagtaacttaaacgtaacggttcttttagacgttgggttacgggtaacggggg

SEQ ID NO: 420756 - DNA, 530 bp, Homo sapiens
  misc_feature: GZ8MTXP02JX6ZX.45.84.H07.1.454.CMB.2.raw
  modified_base (366)..(366): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggttttcctttttgctattgtagaaggtgtccactgtgaggtgcagctggtgggaggtcggggggaggcctggtcaaggccgtggggggtccctgagactctcctgtgcagcctctggattcgacttcagtatttatagtgtgaaatgggtccgccaggctccgagggaaggggctgggagtgggtctcatccattagcagtagcagtggtcncatatattacgcagactcagtgaaaggccgcttcaacatcaccagagacaacgccaaacgaactcactgtaactactaacaaaatgaaaccagtcagagacgccgaggacacggcttaggtttacactgtacgaagacagacgtactataacggtacttttagg

SEQ ID NO: 420757 - DNA, 584 bp, Homo sapiens
  misc_feature: GZ8MTXP02H19JQ.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttcctttttgctattgtagaaggtgtccactgtgaggtgcagctggtggagtcggggggaggccgtggtcaagccgtggggggtccctggagactctcctggtgcagcctcgtggattcgacttcagttattatagtgtagaaagtgggtccgccaggctccgaggggaagggcgtggagtgggtctgatccattagcagtagcagtgtcacatatattcgcagactcgagtaggaacggcctacttacaaactatcccgtacaagagaaccaaacgacccaaagactacacttagtactactaaacaaatacggaacagtacgagaacgagaccccgaagaccgaacgggtcttaagtttaccctaagttacggaaccgagaacgagtacgtaacgtaaagttaaggtctttaggacgtggttacggacgggg

SEQ ID NO: 420758 - DNA, 547 bp, Homo sapiens
  misc_feature: GZ8MTXP02GTLGG.45.84.H07.1.454.CMB.2.raw
  modified_base (262)..(262): a, c, t, g, unknown or other
  modified_base (397)..(397): a, c, t, g, unknown or other
  modified_base (405)..(405): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggaggcctggtcaagccgtgggggtccctgagactctcctgtgcagcctcnggattcgacttcagtatttatagtgtgaaagtgggtccgccaggctccgaggggaaggggctgggagtgggtctcatcctattacgcagtagcaggtggtcactagtatagttacgcagactcagtgaacggccncttcaacntcctcaagacgacaacgaccaaagaacctcactgtactacctaaacaaactgaaactgtacctagagacgaccggaaggacacgggtcttacggttacctacgtgtaaccgaagtacaagacgtactaagtacggtctttag

SEQ ID NO: 420759 - DNA, 577 bp, Homo sapiens
  misc_feature: GZ8MTXP02HG1YA.45.84.H07.1.454.CMB.2.raw
  modified_base (535)..(535): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctgggtgggaggtcggggggaggcctggtcaaggccgtggggggtccctggagactctcctgtgcagcctctggattcgacttcagttattatagtgtgaaatgggtccgccaggctccgaggggagggctggagtgggtctcatccattagcagtgccgagtgtacactatatattacgcaagactcagtggaaacgggcccgcttacaaactactcctaccaagacgaaccaaacgaccaaagacctacaacgttatatacctaaacaaataggaaacctagtctaggaagacggaccgtaaggacaacggtcttagtttactaacgtgtaacgagtacganagaactaaagtaacggtctttagacttggtacggtacggggg

SEQ ID NO: 420760 - DNA, 623 bp, Homo sapiens
  misc_feature: GZ8MTXP02I0LTS.45.84.H07.1.454.CMB.2.raw
  modified_base (265)..(265): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttccttttgctattgtagaaggtgtccactgtgaggtgcagctggtgggaggtcggggggaggccgtggtcaagccgtgggggtccctgagactctcctgtgcagcctntggattcgacttcagttatttatagtgtagaatgggtccgcgaggctccgagggaggggctggagtggtctcatccattacgctagtagcagtgcacatatattacgctaagactcaggtgaaacggggccctacttacaaactacttccgaaccgaagaacgaaaccgaaccgaccgaaaacgtaacctacctaactacgttaactaacctaaacaaagttacgaaaactagttacctaggaacgacgacccgggaaggaccgaacgggtactttaacgtttacgtaacgttacggtaaacggaacgtaaccgaaaggtaccgtaaccgttaacgttaaagggtttctttttaaggg

SEQ ID NO: 420761 - DNA, 541 bp, Homo sapiens
  misc_feature: GZ8MTXP02I1TU5.45.84.H07.1.454.CMB.2.raw
  modified_base (299)..(299): a, c, t, g, unknown or other
  modified_base (351)..(351): a, c, t, g, unknown or other
tcagacgcgatcgacacgaccggtgctcgatttagcagacgtctgtcgcgggcgtagactttgtgtttctcgtagtctgctttgctcagcgtcagggtgctgctctggctcccaggtgccaaatgtgacatccagatgacccaatctccttctaccctgtctgcatctgtaggagacagagtcaccatcacttgccgggccagtcaaagtattagtgactggttggcctggtatcagcaggaaaccggggaagcccctaaggtcctgatctacagggctctagtctagaaagtggggtnccaccaaggttcagcggcagtggatcgtgggacagattcactctcaccatcngcagcctgcagcctgatgtatttcgactaaacttcttctcgaccaaagtaacttgtagtttttatcgggtaacgttcgggaccgtaaagggggacgtaaagggtaggaaaatacgaaaacggaactggtaggactggacacctagtctagtcttactacttcccttcccgctactctgactcgatcgtcg

SEQ ID NO: 420762 - DNA, 576 bp, Homo sapiens
  misc_feature: GZ8MTXP02H2W9S.45.84.H07.1.454.CMB.2.raw
  modified_base (370)..(370): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctgggtggaggtcgggggagcctggtcaagccgtgggggtccctgagactctcctgtgcagcctctggattcgacttcagttatttatagtgtgaaagtgggtccgccgaggctccgaggggaggggctggagtgggtctcatccattagcagtagccagtggtcactatattattcgnagactcgagtgaagggccgcttacaaactactcctacccgaagaacgaaaccgaacgaccaaaacgacctacaacttagtaacttactaaacaaatacgaaacagttactaggagacgaccggaggacacggtctagtttaacctacgtacgtaacgacgacaggagtaacgtagtaacggtctttagacgttggtcggtacgggg

SEQ ID NO: 420763 - DNA, 680 bp, Homo sapiens
  misc_feature: GZ8MTXP02HY1MC.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctgggtggaggtcggggggagccgtggtcaaggccgtgggggtccctgagactctcctgtgcagcctctggattcgacttcagttatttatagtgtagaaagtgggtccgccaggcctccggaggggaacggggctgggaggttgggtctcatccagttacgcaggtacgccgagttcggtacacgtaattacttaacgttacgactaagtacctacgaagggttggaaacgggtcccgtacttacgaaactactccgtacccgaaagaacgaaccaaaccgacccgaaaacgaacctacaaccgttagttaaactaccttaaaacgaaaagttacgaaaactacgtacctaaggaacggacggaccggaaaggaaccgtacggtacgttacgttttaaacctacgttaacggtaaccgaacgaaccgtaagaacggtaaccttaaaggttaacggttcttttaggacgtttagggtacgggtacgggg

SEQ ID NO: 420764 - DNA, 789 bp, Homo sapiens
  misc_feature: GZ8MTXP02H6OT2.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctgggtggaggtcgggggagcctggtcaaggccgtgggggtccctggagactctcctgtgcagtcctcgtggacttcgacttcagttatttagtagtgtagaaagtcgggtccgaccgtagggcctaccgggaaggggaaggggccgttaggggacggttcggggtccttacgaacttccgtaagttacgacgtaggtaacgccgtacggttcggactaactaattaacgttaacttaccggactaagtaccgtaccgtaaagggttacgggaaaacccgggggtccctaccttaaaccgaaaccgtacttacccgtaacccgaaacgaaacgaaacccgaaaccggaaacccaaaacgtaccttacctaacttaaacgttacttaaacctaaaactaaaacgtaacgtaaaccgtagttaaccggaggaaacgaccggaacccgggaacggaaccgttaacgggttacctttaacgggttttaaccctaaacggtacggttaaacccggaagaacgtaaccggtaagttaaaccgttacggttaaaacggtttcggttttaagacgggtttacggggtttaggggtaaacccggggg

SEQ ID NO: 420765 - DNA, 552 bp, Homo sapiens
  misc_feature: GZ8MTXP02JF1MH.45.84.H07.1.454.CMB.2.raw
  modified_base (492)..(492): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggttttcctttttgctattgtagaggtgtccatgtgaggtgcagcgtggtggaggtcgggggagcctggtcaagcgtgggggtccctgagactctcctgtcgcagcctctggattcgacttcagttatttatagtgtacgaaagtgggtccgcgaggcctaccggagggaaggggctagggagtgggtctcatccatttacgactagtagcgtaggtggtcagtatatattacgcaagactcagtgaaggctcttacaacatccaccagaagacaacgtacccaaagtactcatagtactacaacaatagaacgtagtccagaagacgaccgagaaacncggacttacggtttaccagtacgtacgaagactaagacgactaagtaacggtttattacg

SEQ ID NO: 420766 - DNA, 642 bp, Homo sapiens
  misc_feature: GZ8MTXP02HU3VI.45.84.H07.1.454.CMB.2.raw
  modified_base (538)..(538): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggttttccttttgctattgtagaaggtgtccatgtgaggtgcagcgtgggtgggagggtcggggggaggccgtgggtcaaggccggtggggggtccctggagactctccgtgtcgcagtccctgtggtacttcgtacttctagttatttagtagtgtagaagtcgggtaccgcgaggtctaccggaggggaggggcgtgggtaggtcgggtctactacgtccagttacgcgtaaggtgacgtgtcggtacacgtaattaacttacgttaccgctaacgtacttcggaaggtaggaaccggcctacgttacaactactcctacgaagacgaaccaacgactaaacactacgtatacgttaactactaaacgaaatcggttaaaacncgtacgagacgacggaccggacggtaccgtacgttcgtttacgttaccgtacgtacgaacgaacgtacgaacgtactaagtttaacgttacggtttacgtttag

SEQ ID NO: 420767 - DNA, 688 bp, Homo sapiens
  misc_feature: GZ8MTXP02GJR1Y.45.84.H07.1.454.CMB.2.raw
  modified_base (323)..(323): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcacgtggggctccgcttgggtttttccttttgctattgtagaaggtgtccactgtgaggtgcagcgtgggtgggaggtcggggggagccgtgggtacaacggccggttcggggggtccctggacgtactcctccgtgtgcacgtcctgtggtattcgacttctagttatttagtagtgtagaagtcgggtccncgaggcctacggaggggagggcgtaggaggtgggtctcactcctattagctagtagcgtagtgtacaactattacttagttacgactaggacctacgaggtacggaacgggccctactacaactatcctacagaacaccgaacgaaccgaaatacctactaacgttactaacttacctaaaagaaacgttacgaaacgtacgttacgagggacgaaccggacccggaaaggtaccgtaacggttacgtttacgtttaaaccgtacgttacggtaaacgaacgaaaccgtaagtaaccgttaaacgttaaggtttaaacggtttcgtttttaaggacgtttacggggtttacgggtaaaccggggg

SEQ ID NO: 420768 - DNA, 527 bp, Homo sapiens
  misc_feature: GZ8MTXP02JBI6J.45.84.H07.1.454.CMB.2.raw
  modified_base (363)..(363): a, c, t, g, unknown or other
  modified_base (381)..(381): a, c, t, g, unknown or other
  modified_base (424)..(424): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggagtcggggggagcctggtcaagcctggggggtccctgagactctcctgtgcagcctctggattcgacttcagtattatagtgtgaaatgggtccgccaggctccgagggaaggggctggagtgggtctcgatccattagcagtagccagtgtcacatatattcgnagactcagtgaagggccncttcaacatctccagagacaacgccaagactcactgtatctanaaatgaacagtctggagacgacgacgacgacggtcttagttactacgttacgacgacgacgagactaacgtaagtacgttacttagtgtacgtagggtacggg

SEQ ID NO: 420769 - DNA, 516 bp, Homo sapiens
  misc_feature: GZ8MTXP02I4TN9.45.84.H07.1.454.CMB.2.raw
  modified_base (284)..(284): a, c, t, g, unknown or other
  modified_base (336)..(336): a, c, t, g, unknown or other
  modified_base (458)..(458): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttcctttttgctattgtagaaggtgtccactgtgaggtgcagctggtggagtcgggggaggcctggtcaagcctggggggtccctgagactctcctgtgcagcctctggattcgacttcagtatttanagtgtgaaatgggtccgccaggctccgagggaaggggctgggagtgggtctnatccattagcagtagcagtggtcacatatattacgcagactcagtgaaaggccgcttcaacatctaccagagacaacgccaaagaaactcactgtatactaacaaaatgaaacagtctaganagaccgaggacacggactgtttacactgtacgaagacagagctaataaggtcttttag

SEQ ID NO: 420770 - DNA, 522 bp, Homo sapiens
  misc_feature: GZ8MTXP02IR397.45.84.H07.1.454.CMB.2.raw
  modified_base (380)..(380): a, c, t, g, unknown or other
  modified_base (409)..(409): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcggggggaggcctggtcaagccgtgggggtccctgagactctcctgtgcagcctctggattcgacttcagtatttatagtgtgaaagtggtccgccaggctcgaggggagggctggagtgggtctcatcattagcagtagccagtgtcacatatattcgcagactcagtgaagggccnttcaacatctcagagacaacgccaagacncactgtatactaacaatagaacagtactagagacgcggaagacgacggtctagtttactacgtagtacgagacgagacgaactagtacggtactttgattggtaggtacgggg

SEQ ID NO: 420771 - DNA, 616 bp, Homo sapiens
  misc_feature: GZ8MTXP02HUUE8.45.84.H07.1.454.CMB.2.raw
  modified_base (392)..(392): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggtttttccttttgctattgtagaaggtgtccactgtgaggtgcagctggtggaggtcggggggaggcctggtcaagccgtggggggtccctgagactctcctgtgcagcctctggattcgacttcagttatttatagtgtagaaagtgggtccgccgaggcctaccgaggggaaggggcgtagggaggtggggtctcatccgaattacgcgtagtagcctagtcggtacaactattattattcgnagactcgagtaggaacgggccgcttacaacatccacaagacgaaccaacgacctaaagacctcaacgtagttaacttactaaacaaaatacgaaacgtagtactaggaagacggacccggaaggaccgtacgggtcttacggttttaacaacctggtaaccgaacgactaaggagtaacgttaacgtaaggtttactttgtaagttcggttagggtaaccgggg

SEQ ID NO: 420772 - DNA, 647 bp, Homo sapiens
  misc_feature: GZ8MTXP02F4286.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcggggggagccgtggtcaagccgtgggggtccctgagactctcctgtgcagcctctggattcgacttcagttattatagtgtagaaatcgggtccgcgaggcctcgaggggaagggctaggaggtcgggtctcgactcctattagctaaggtagccgtaggtcggtcaactataattaacttacgacacggaactcgaggtaggaaacgggccgtcttacaaactactacctacccgaagaacgaaccaaacgacccaaagtaacctctaacttacgtaaacttacctaaaacaaattacggaaaactacgtactaggaacgacggaccgaagggaccgacgggtactttacggtttaactaccgttagtaacgacggaaccaaggtaacgtaacgttaagttaacgggtttacttttaggaacgtttggtacgggtaacggggg

SEQ ID NO: 420773 - DNA, 546 bp, Homo sapiens
  misc_feature: GZ8MTXP02G4U1G.45.84.H07.1.454.CMB.2.raw
  modified_base (343)..(343): a, c, t, g, unknown or other
  modified_base (370)..(370): a, c, t, g, unknown or other
  modified_base (446)..(446): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcggggggaggcctggtcaagccgtggggggtccctgagactctcctgtgcagcctctggattcgacttcagtatttatagtgtgaaatggtccgccaggctccgagggaggggctggagtgggtctcatcattagcagtanccgagtgtcacatatattcgcagactnagtgaacgggccgcttacaacatctccagacgaccaacgccaaagacctcaactgtactactaacaaatagaaacngtactaggacgacgaccgaggacacgggtacttacggtttacacgtagtaccgtagacgagacgtctaagtacggtctttaggacttggtaggtacgggg

SEQ ID NO: 420774 - DNA, 518 bp, Homo sapiens
  misc_feature: GZ8MTXP02HTZT8.45.84.H07.1.454.CMB.2.raw
  modified_base (276)..(276): a, c, t, g, unknown or other
  modified_base (292)..(292): a, c, t, g, unknown or other
  modified_base (323)..(323): a, c, t, g, unknown or other
  modified_base (377)..(377): a, c, t, g, unknown or other
  modified_base (387)..(387): a, c, t, g, unknown or other
  modified_base (390)..(390): a, c, t, g, unknown or other
  modified_base (483)..(483): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttcctttttgctattgtagaaggtgtccactgtgaggtgcagctggtggagtcgggggagcctggtcaagcctgggggtccctgagactctcctgtgcagcctctggattcgacttcagttattanagtgtgaatgggtccncaggctccgagggagggctggagtgggtctnatccatagcagtagccagtggtcacatatattcgcagactcgagtgaagggccncttacaaacntcnccagagacaacgccaaagactcactgtactgtaacaaatgaacagtctagagagccgagacacggcttagtttactactgtacgacgacaagnaacgtataacggtctttagagttgtaggtacgggg

SEQ ID NO: 420775 - DNA, 603 bp, Homo sapiens
  misc_feature: GZ8MTXP02HSY21.45.84.H07.1.454.CMB.2.raw
  modified_base (450)..(450): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggtttttcctttttgctattgtagaaggtgtccactgtgaggtgcagctgggtggaggtcgggggagccgtgggtcaaggccggtgggggtccctgacgactctcctgtcgcagcccttcgtggattcgacttcagttatttatagtgtagaagtcggtccgcgaggcctccggaaggggaaggggcgtgggaggttgggtctcgatccgtattacgcgtagtgctaggtgtacacgtattaattacgttaccgactaagacttacgagtacggaaacgggtccctattacaaactnttccacaggaacacgaaacaccaaagacctacagttactatacaaactaaagtcaaaactgttacagacgacgaccgaaggacctacggtacttacggtttacacgtaggtacgaaagctaaagacggtaatttaacggtagtttcgtttagg

SEQ ID NO: 420776 - DNA, 779 bp, Homo sapiens
  misc_feature: GZ8MTXP02FPWA9.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcgggggagcctggtcaagccgtgggggtccctgagctctcctgtgcagcctcgtggattcgacttcagttatttatagtgtagtaaagtcgggtccgccgaggcctaccggaaggggaacggggcgtagggaggttcggggtctacgacgttaccgtaagtttacgccgtaaggttaacgccccgtagggttacggggttaccaaaccgttaaatttaaacgttaacgttttaccggaccgtaaagtacccgttaccgtaaggggttaacggggaaaaccgggggtcccccttaccgtttaaaccaaacccgtacgttacccttaacccgaaacggaaacgaaaccccgaaacccgggaaccccaaaacgggtaaaaccctcctaaaccgttaggttaaaccttaaccgttaaaactaaaacgttaacggaaaaccctaggttacgtagaaacgggacgaccgggaacgtaaccggtaccggtactttacggttttaaaccacgttacggtaaaccgaagaccgaagtacgtaagttaaagtaggttacgtttagtacgttcggtagggtaacgggg

SEQ ID NO: 420777 - DNA, 634 bp, Homo sapiens
  misc_feature: GZ8MTXP02GT00H.45.84.H07.1.454.CMB.2.raw
  modified_base (347)..(347): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggttttccttttgctattgtagaaggtgtccactgtgaggtgcagctggtggaggtcggggggaggcctggtcaaggccgtgggggtccctgagactctcctgtgcagcctctggtattcgtacttcagttatttatagtgtagaaagtgggtccgccaggctaccgaggggaaggggcgtgggagtgggtctnatcctatacgcagtagctaggtggtcacgtatatagttacgcagactacagtcggaaacggggtcctacttaccgaaactactccgtaccaggtaacaccgaaccgaccaaacgaactacaactagtactacctaaacaaagttacggaaactacggttacaggaacgacggaccggacggaaaccgtaccgggtacgttacggttttaaaccgtacgttaacgggtaaacgaacggtaacgaacggtaacgtacctttaaaggttaacgggtttacttttaagggg

SEQ ID NO: 420778 - DNA, 558 bp, Homo sapiens
  misc_feature: GZ8MTXP02JIIHK.45.84.H07.1.454.CMB.2.raw
  modified_base (187)..(187): a, c, t, g, unknown or other
  modified_base (294)..(294): a, c, t, g, unknown or other
  modified_base (351)..(351): a, c, t, g, unknown or other
  modified_base (438)..(438): a, c, t, g, unknown or other
  modified_base (485)..(485): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactgggctccgctgggttttccttttgctattgtagaaggtgtccactgtgaggtncagctggtggagtcgggggagcctggtcaagccgtgggggtccctgagactctcctgtgcagcctcgtggattcgacttcagttatttatagtgtagaatgggtccncaggctcgagggaggctggagtggtctacatccattagctagtagccgagtcgacanatatatcgacagactcgagtacggaacgggtccacttacgaaatctccaccaagagaaccgaacgacctaaagaacctcaaaccgtntaaactactaacgaaatcgaaactcgtacagagacgaccgaggtacnggtacttagtttacacgtagtaccgagacctaggacgtctaaagttagtcgtttagattgggtacgtacgggg

SEQ ID NO: 420779 - DNA, 580 bp, Homo sapiens
  misc_feature: GZ8MTXP02ILM3E.45.84.H07.1.454.CMB.2.raw
  modified_base (482)..(482): a, c, t, g, unknown or other
  modified_base (536)..(536): a, c, t, g, unknown or other
  modified_base (540)..(540): a, c, t, g, unknown or other
  modified_base (560)..(560): a, c, t, g, unknown or other
  modified_base (567)..(567): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctgggtgggaggtcgggggggagccgtggtcaaggccgtggggggtccctgagactctcctgtgcagcctctggattcgacttcagttatttatagtgtagaaagttcgggtccgccaggcctccggaaggggaggggctggagtgggtctcgatccattacgcagtgccagtgcatatatattcgcagactcgagtggaacgggccacgttacaactatcctaccgaagacgaccaaaccgaccaaaagtacctcaacttgtaaactaacctaacaaagttcgaaaaccngttaccgtagaggacgccgaagggacacggtctttacggttacacgttagacgnaacngaactaacgtaagtacgttntttaggngtcggaggtacgg

SEQ ID NO: 420780 - DNA, 708 bp, Homo sapiens
  misc_feature: GZ8MTXP02HX54U.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttccttttgctattgtagaaggtgtccactgtgaggtgcagcgtgggtgggaggtcggggggagccgtggtcaaggccgtggggggtccctgagacctctcctgtgcagcctcgtggattccgacttcaagttatttataggttgtagaaagtcgggtacccgcgaggcctaccggaggggaaggggctgggagtgggtctcatccattagcagtagccgagtgtcaactagtattaattcgactagactcgtaaggtggaaacgggtccgtacttacaaactactcctaccaaggaacggaaacccaaacgacccaaaaggtaccctaccgtaaacgttacgttaacttaaccttaaaactaaaattcggaaaacctagtcctaaggaaagaccgaccggaaaggtaaccgaaccgggtctttaaacgggttttaaccctaacgtaacggggttaaaccgaagaaacccgtaggttaaacccgtaacgtttaaaaggtttaaccggtttacgttttaaggtaacggtttacgggtttaagggggtaaccccggggg

SEQ ID NO: 420781 - DNA, 714 bp, Homo sapiens
  misc_feature: GZ8MTXP02F3GUU.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttccttttgctattgtagaaggtgtccactgtgaggtgcagctggtggaggtcggggggaggcctggtcaagccggtgggggtccctgagactctcctgtgcagcctctggtattcgacttcagttatttatagtgtagaaagtcgggtccgccgaggctaccggaggggaaggggcgtgggaggttggggtcctcgactccgtattagctaaggtagccgtaggtggtacaacgtattaattattaccgcaagtactacgaggtaggaaacggggcccgtactttaccaaactacttacctacccgaaagaaccgaaaccaaacccggaacccaaaacgtaaacctacctaaacgttattaaacttaccttaaaactaaaacgttacggaaaacctaacgttaccgtaaggaacggaaacggacccggaaagggaccgtaaccggtacgtttacgtttaaaccgtacgttaacggtaaaccggaagtaaaccgaggtaacgtaacgttaaacggtaaaggtttacgttttaggaacggtttggggtacggggtaaccggggg

SEQ ID NO: 420782 - DNA, 540 bp, Homo sapiens
  misc_feature: GZ8MTXP02IP2OO.45.84.H07.1.454.CMB.2.raw
  modified_base (249)..(249): a, c, t, g, unknown or other
  modified_base (260)..(260): a, c, t, g, unknown or other
  modified_base (296)..(296): a, c, t, g, unknown or other
  modified_base (350)..(350): a, c, t, g, unknown or other
  modified_base (362)..(362): a, c, t, g, unknown or other
tcagacgcgatcgacacgaccggtgctcgatttagcagacgtctgtcgcgggcgtagactttgtgtttctcgtagtctgctttgctcagcgtcagggtgctgctctggctcccaggtgccaaatgtgacatccagatgacccaatctccttctaccctgtctgcatctgtaggagacagagtcaccatcacttgccgggccagtcaaagtattagtgactggttgcctggtatcagcagaaccgggaanccctaaggtcngatctacgaggcgtactagtactagaaagtggggtnaccgaccaaggttcagcggcagtggatcgtaggacagtactcactctcacatcngcacgcctgacngcctgatgtatttgactacttactctagacctaagtactgttagttttagttcggtacgttacggacgaagggacgaaggtagaaacttaacgaaacgtaacgtggtaggactcggacaccgtgttactcgttacttactacgtccttcccgaactatccgtgactcgacttcgtacg

SEQ ID NO: 420783 - DNA, 573 bp, Homo sapiens
  misc_feature: GZ8MTXP02FP9ZN.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttcctttttgctattgtagaaggtgtccactgtgaggtgcagctggtggaggtcggggggaggcctggtcaagccgtgggggtccctgagactctcctgtgcagcctctggattcgacttcagtattatagtgtagaaagtgggtccgccaggctccgaggggaaggggctggagtgggtctcgatccattagcaagtagccagtggtcactataattattacgcaagactcgagtggaaacgggcccgacttaccgaaactattccacccaagaacgaaccaaacgaccaaaagaactcaacttagtaactactaaacaaatacgaaactagtctagagagccgaagccaacggtcttagttactacgtagtaacgagacagagtaagtaataaggtcttttaggactaggtaggtacgggg

SEQ ID NO: 420784 - DNA, 553 bp, Homo sapiens
  misc_feature: GZ8MTXP02HSXXE.45.84.H07.1.454.CMB.2.raw
  modified_base (465)..(465): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggttttccttttgctattgtagaaggtgtccactgtgaggtgcagctgggtggaggtcggggggagcctggtcaaggccgtggggggtccctgagactctcctgtgcagcctctggattcgacttcagtatttatagtgtagaaatgggtccgcaggctccgaggggaaggggctgggagtgggtctcatccattacgcagtagcaggtggtcacattaatattacgcagactcagtgaacggccgattacaactatcctaccagacaccaacgcccaaagaacctcatagtatacctaaacaaatgaaacngtactagagacgccgaggtaccacggtcttacgtttacctacgtcgtaacgaacgaacaggactacgttaacgtaacggtcttttagg

SEQ ID NO: 420785 - DNA, 534 bp, Homo sapiens
  misc_feature: GZ8MTXP02GQW64.45.84.H07.1.454.CMB.2.raw
  modified_base (382)..(382): a, c, t, g, unknown or other
  modified_base (404)..(404): a, c, t, g, unknown or other
  modified_base (416)..(416): a, c, t, g, unknown or other
  modified_base (528)..(528): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttccttttgctattgtagaaggtgtccatgtgaggtgcagctgggtggaggtcggggggaggcctggtcaaggccgtggggggtccctgagactctcctgtgcagcctctggattcgacttcagttatttatagtgtagaaatgggtccgcaggctccgagggaggggctggagtgggtctcatccattacgctagtagcaggtggcacatatattacgcagactnagtgaacggccgcttacaaacntcctccaagganaccaacgaccaaagaacctcaactgttaatactaacaaatacgaacagtctagagacgcgagacacggtctacgtttactactgtacgaagtacagtacgctaagtacgttntttagg

SEQ ID NO: 420786 - DNA, 517 bp, Homo sapiens
  misc_feature: GZ8MTXP02I0BTG.45.84.H07.1.454.CMB.2.raw
  modified_base (360)..(360): a, c, t, g, unknown or other
  modified_base (398)..(398): a, c, t, g, unknown or other
  modified_base (458)..(458): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggaggcctggtcaagcctgggggtccctgagactctcctgtgcagcctctggattcgacttcagtatttatagtgtgaaatgggtccgccgaggctccgaggggaaggggctgggagtgggtctcatccattagcagtagcagtggtcncgtatatattacgcagactcagtgaaggccgctcaacntccacagagacaacgtccaaagaactcactgtactactaacaaatagacaagtctagagngaccgagacacggcttacgttactactgtaacgaagacagacactagtaagtctttagg

SEQ ID NO: 420787 - DNA, 589 bp, Homo sapiens
  misc_feature: GZ8MTXP02FIJJM.45.84.H07.1.454.CMB.2.raw
  modified_base (258)..(258): a, c, t, g, unknown or other
  modified_base (297)..(297): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttcctttttgctattgtagaaggtgtccactgtgaggtgcagctggtggaggtcggggggaggcctggtcaagccgtgggggtccctgagactctcctgtgcagcctntggattcgacttcagtatttatagtgtgaaatgggtccncaggctccgaggggaaggggctggagtgggtctcatccattagcagtagccagtgcacatatattacgcagactcagtgaaagggcccgcttacaaacatctaccgaagacgaacaacgtacccaaagaaacctcaactgtaatactaaacaaattagaaacagttactagaagacggacccggaaggaccaacgggtacttaggttttaaacctaacgttaggtaaaccgagaaaccaagaacgtaacttaaagttaaacggtctttttagagttacggtggtaacggggg

SEQ ID NO: 420788 - DNA, 614 bp, Homo sapiens
  misc_feature: GZ8MTXP02F0QUX.45.84.H07.1.454.CMB.2.raw
  modified_base (499)..(499): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcggggggaggcctggtcaagccgtgggggtccctgagactctcctgtgcagcctctggattcgacttcagttatttatagtgtagtaaagtcggggtccgccgaggcctccggaggggaaggggcgtagggaggttggggtcctacgactccgtatttacgcaggttacgcctaggtcgtacactaatattacttacgcagtactcgagtacggaacgggccgtacttacaaacattcctaccgaagaacgaaccaaacgtacccgaaacgaaacctcaacttagtaactacctaanaaactagaaactagtctagacggacgaccgaggacacgggtacttaggttacctacgtacgtacgacgaacagacgtaagttaacgtaacggttcgtttgagtcggtggtacggg

SEQ ID NO: 420789 - DNA, 632 bp, Homo sapiens
  misc_feature: GZ8MTXP02H81E9.45.84.H07.1.454.CMB.2.raw
  modified_base (390)..(390): a, c, t, g, unknown or other
  modified_base (607)..(607): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctgggtggaggtcggggggaggcctggtcaaggccgtggggggtccctgacgactctcctgtgcacgcctctggattcgacttcagttattatagtgtagtaagtcgggtccgccgaggcctaccggagggggaaggggtcgtaggggaggttggggtctacgtataccagttagactagtagccgaggtggtaccaanattattaactttaccggactaacggtacttaccgaaggttacgggaaacgtcccggacctttaacaaacacgtcctacccgaagaacgaaaccaaaccgaccgaaacgactacactgtaaactctaaacaaatacgaaactagtactagagacgaccgagaccgaggtacttagttttacacttaggtacgagacgagagtaacgtaataacggttntttaggtagtgttacggaacggggg

SEQ ID NO: 420790 - DNA, 577 bp, Homo sapiens
  misc_feature: GZ8MTXP02IAOV3.45.84.H07.1.454.CMB.2.raw
  modified_base (411)..(411): a, c, t, g, unknown or other
  modified_base (425)..(425): a, c, t, g, unknown or other
  modified_base (470)..(470): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggagcctggtcaagccgtggggggtccctgagactctcctgtgcagcctctggattcgacttcagttattatagtgtagaaatgggtccgccaggctccgaggggaaggggctgggaggtgggtctcgtatccgtaatttacgccaagtagacgagtcggcactaagttaatattacgctagactcagtgaaagggcccncttacgaacatccncaagacgacaaacgacccaaagactacaacgtatactacctaaanaaatacgaactactacgagaacgacgacggaacggtaccgaacgtcgttacgtttaacgtacgttacgaacgaagaacgagtacgtactaagtaaacggtttcgttg

SEQ ID NO: 420791 - DNA, 632 bp, Homo sapiens
  misc_feature: GZ8MTXP02HE9NS.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtgggaggtcggggggaggcctgggtacaaggccgtggggggtccctgagactctcctgtgcagcctctggacttcgacttcagttattatagtgtagaaagtcgggtccgccgaggcctccggaaggggacggggctgggaggtgggtctcatccattacgcaggtagccgtagtgtacaactatactagttcgacagtacctgaggtaggaacggggcctcttacaactatccgtaccgaagacgaaccaacgaccaaacgtaactacgtacttagtaactacgttaaacaaagttacgaaactagttacgaggacgaacggcccgtaaaggacccgtaacggttaccgtttagtttaaaccgtaccgtaggtaaaccgagaaccgagaagtaacgtaaggttaaccgtctttagagttcggtagggtaaccgggg

SEQ ID NO: 420792 - DNA, 562 bp, Homo sapiens
  misc_feature: GZ8MTXP02FW28Z.45.84.H07.1.454.CMB.2.raw
  modified_base (297)..(297): a, c, t, g, unknown or other
  modified_base (404)..(404): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcggggggaggcctggtcaagccgtgggggtccctgagactctcctgtgcagcctctggattcgacttcagtatttatagtgtagaaatgggtccncaggctccgagggaaggggctggagtgggtctcgatccattagctagtagccagtgtacacatatattacgcagactcgagtacgaaaggggccctattaccaaacntacctaccaaagacgaaccaaacggaccaaacgaaactcaacttagtaatactaaacaaatagaaactagtctagagacgccgaagacacgggtacttgtttaacacgtagtacgagaacagagaactaagtaacggtctttagattggtgtacgggg

SEQ ID NO: 420793 - DNA, 566 bp, Homo sapiens
  misc_feature: GZ8MTXP02JKPFQ.45.84.H07.1.454.CMB.2.raw
tcagacgcgatcgacacgaccggtgctcgatttagcagacgtctgtcgcggggagctctgagagaggagccttagccctggattccaaggcctatccacttggtgatcagcactgagcaccgaggattcaccatggcacgtggggctccgcttgggttttcctttttgctattgtagaaggtgtccactgtgaggtgcagctggtggaggtcgggggagcctggtcaaggccgtgggggtccctgagactctcctgtgcagcctctggtattcgacttcagttatttatagtgtagaagtcggtccgcaggctaccgagggacggggctgggagtggtctcgatccattacgcagtagcgagtcggacacattaatacgttaacgcaacgacttacgagtaggaacgggcctacttacaacgtatccctacgaagacgaaaccaacgtaccgaaacgtaacctacgactagtactactaaacaatagaactagtcagagacgacgacgacacggtcttacgttactacgtgtacgaagtacgagacgtatacgtaggtactttagg

SEQ ID NO: 420794 - DNA, 569 bp, Homo sapiens
  misc_feature: GZ8MTXP02I5FW9.45.84.H07.1.454.CMB.2.raw
  modified_base (301)..(301): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggaggcctggtcaagccgtgggggtccctgagactctcctgtgcagcctctggattcgacttcagtatttatagtgtgaaatcgggtccnccgaggctccgaggggaaggggctgggagtgggtctcgatccattacgcagtagcagtggtcacatatacttacgacagactcgagtggaaacgggccctacgttacaaactatccgtaccaagaacgaaccaaacgccaaaagaacctcactagtactacctaacaaatgaaacagtctagaacgacgtacccggaggaccacgggtcttacggtttactaccgtaggtaccgaagtaacagacgactagtaacggttcttttaagg

SEQ ID NO: 420795 - DNA, 723 bp, Homo sapiens
  misc_feature: GZ8MTXP02H60BC.45.84.H07.1.454.CMB.2.raw
  modified_base (319)..(319): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcacgtggggctccgcttgggtttttcctttttgcttattgtagaaggtgtccactgtgaggtgcagcgtgggtggagggtcggggggaggccgtgggtcaaggccggtggggggtccctggagtactctccgtgtgcacgcctcgtggattccgtacttcagttattagtagtgtagaagtcgggtccnccgaggccgtaccggaggggaggggcgtgggaggtcgggtctacgacttaccgtagttacgactaggtacgccgtaggttcgtacaactaattaattaacgttaccgacgtaaacgtaccgttacgtaaggtacggggaaaccggtcccgtaaccttaacgaaacttacgttaccccaaccgaagaaaccggtaaacccaaacccggtaaacccaaaacgtaaccctactaaaccttcgttaaaactacctaaaacaaagtacgaaaacctgttaccgaagacggaacggacccgaaggaaccgacggttacttaacggttttacaacgttacggacgaagacctaaggaaccgtaagttaacggtaaggttcgtttaggacgtttcggtagggtaaccggggg

SEQ ID NO: 420796 - DNA, 658 bp, Homo sapiens
  misc_feature: GZ8MTXP02GNQ4Q.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttccttttgctattgtagaaggtgtccactgtgaggtgcagcgtggtggaggtcgggggagccgtggtcaaggccgtgggggtccctgagactctcctgtgcagcctctggtattcgacttcagttatttatagtgtagaaagtcgggtccgccgaggcctaccggaggggaacggggcgtgggaggttcgggtctcgtactacctagttagacgtaggtacgccgtaggtgtacaactagttaacttaacgttacgacaagtaccttacgaggtaggaaacgggcccgtacttacaaactctacgtacccaagaacgaaccaacgaccaaaacgactacgacttacgtaactaactaaacaaacttacgaaactacgtacgtagaacgacggaccggaagtaccgacggttacttacgtttaaccgtagtacggtaacgacgaaaccgaagtaacgtaacgttagttaacggtttactttagtacggttcggtagggtaaccgggg

SEQ ID NO: 420797 - DNA, 698 bp, Homo sapiens
  misc_feature: GZ8MTXP02JONVU.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcgggggagcctggtcaagccgtgggggtccctgagactctcctgtgcagcctcgtggattcgacttcagttatttatagtgtagaaagtcgggtccgccaggctaccggaggggaagggctggaggtgggtctcatccattagctaggtagccgtagtcggtaccaacgtattaacttaacgttaccggacaaggtaccttacgaaggtacgggaaacggggtccctaccgtttaccaaacctagttcccaccgaagtaacgaccaaaccggaaccccaaaagtaacccgtactaaaccgttcggtaaacttaacccgttaaaacaaaacgttcggaaaactacgttacgtacggaaacggacgaacccggggtaaggacccgtaaccggttaccgttaacggtttttaccaacgtttacggaaccgtaagaaccgtagaacgttaacgtaaaggttaacggttcttttagacgtttcgggtagggttaaccgggg

SEQ ID NO: 420798 - DNA, 567 bp, Homo sapiens
  misc_feature: GZ8MTXP02IABIJ.45.84.H07.1.454.CMB.2.raw
  modified_base (309)..(309): a, c, t, g, unknown or other
  modified_base (398)..(398): a, c, t, g, unknown or other
  modified_base (415)..(415): a, c, t, g, unknown or other
  modified_base (487)..(487): a, c, t, g, unknown or other
  modified_base (491)..(491): a, c, t, g, unknown or other
  modified_base (493)..(493): a, c, t, g, unknown or other
  modified_base (501)..(501): a, c, t, g, unknown or other
  modified_base (562)..(562): a, c, t, g, unknown or other
tcagacgcgatcgacacgaccggtgctcgatttagcagacgtctgtcgcgggggagctctgagagaggagccttagccctggattccaaggcctatccacttggtgatcagcactgagcaccgaggattcaccatggcactggggctccgcttgggtttttcctttttgctattgtagaaggtgtccactgtgaggtgcagctgggtgggaggtcggggggagcctggtcaagccgtgggggtccctgagactctcctgtgcagcctctggattcgacttcagttatttatagtgtagaaatgggtccnccgaggcctccgaggggaaggggctgggagtgggtcctcgatccattacgcagtagcagtggtacagtattaatattaccgcagacctnaagtgaaacggggcccnttacaaacagttccaccgaagaacgaacaaaccgacctaaaagaaccttacgacttagtaataccctaaaanaaananaaacagtnagagacgacgagacacggtcttacgttacacgtagaacgaagacagactatagtaacgttntttag

SEQ ID NO: 420799 - DNA, 576 bp, Homo sapiens
  misc_feature: GZ8MTXP02I4IU6.45.84.H07.1.454.CMB.2.raw
  modified_base (367)..(367): a, c, t, g, unknown or other
  modified_base (392)..(392): a, c, t, g, unknown or other
  modified_base (552)..(552): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttcctttttgctattgtagaaggtgtccactgtgaggtgcagctggtggaggtcgggggcaggcctggtcaagccgtgggggtcctgagactctcctgtgcagcctctggattcgacttcagttattatagtgtagaaatgggtcccgccgagctccgaggggaacggggctggagtgggtctcatccaattgctagtacgcagtgtacactatatnttacgcagactcagtgaagggccgnttacaacatctaccgagacgaacaacgacccaagaactacactagtactactaacaaatgaaaccagtctaggacgaggaccgaaggacctaacggggcttagtttaacctaacgttacggaaacgacgaccgtaagaacgtacgttaagtaaacggttntttttacggaagtggttacggggg

SEQ ID NO: 420800 - DNA, 590 bp, Homo sapiens
  misc_feature: GZ8MTXP02G8G9V.45.84.H07.1.454.CMB.2.raw
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggtttccttttgctattgtagaggtgtccactgtgaggtgcagctggtgggaggtcggggggaggcctgggtcaaggccgtgggggtccctggagctctcctgtgcagcctctggattcgacttcagttatttatagtgtagaaagtgggtccgccgaggctcgaggggaaggggctgggaggtgggtctcgatcctatacgcagtagctaggtcgtacacagttatagttacgcaagtactcgaaggttgaaaccggggccctagtttaccaaactctcctaccaagaacgaaccaacgtacccaaagaaaccttccaacttagtaacttaccaaacgaaatggaaaactgtacctggaacgacggaccgacggacgacggtcttacgtttacgactggtaacaaggacaagtacgacttagtaacggtttcttagg

SEQ ID NO: 420801 - DNA, 660 bp, Homo sapiens
  misc_feature: GZ8MTXP02FZHAB.45.84.H07.1.454.CMB.2.raw
  modified_base (298)..(298): a, c, t, g, unknown or other
  modified_base (353)..(353): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactgggctccgctgggttttccttttgctattgtagaaggtgtccactgtgaggtgcagctggtggaggtcggggggagcctggtcaaggccgtgggggtccctgagactctcctgtgcagcctctggattcgacttcagttatttatagtgtagaaagtgggtccnccgaggcctccgaggggaaggggctggagttggggtctcgatccattagcagtancgagtgacactatatatcgcaagactcaggttaggaacggggcctacttacaaactacgttcctacccgaagaacgaacccgaaacgacccgaaagaacctcgtaacttagtaactaccgtaaacaaaagttacgaaaaccagtttaccgaggaacggacgacccgggaaggaacccgtacgggtacttttacgtttaaacctaacgtacggttaaaccgaagaaaccgagggtaaaactaaccgtttaaagttaaaaccgggtttcttttaggaacgtttggggtacgggtttaaaacccgggggg

SEQ ID NO: 420802 - DNA, 603 bp, Homo sapiens
  misc_feature: GZ8MTXP02GMZYH.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggagcctggtcaagccgtgggggtccctgagactctcctgtgcagcctctggattcgacttcagtatttatagtgtgaaatgggtccgcaggctccgagggaaggggctggagtggggtctcgatccattagcagtagccagtggtcacatatattcgcagactcagtggaaagggcccgtacttcaaacatacctcccaagaacgaaccaaacggaccaaaacgaaacctcaaaccgttagtaaacttaccttaaacaaaacttacggaaaacctaacgtaccgttaggaagaacggacccggaaggaaccgacgggtacttacggtttaactaccgttagtaaccgagaacagacgaacgtaagtaaggtctttagaagttcggtaggtaacgggg

SEQ ID NO: 420803 - DNA, 574 bp, Homo sapiens
  misc_feature: GZ8MTXP02JDFBV.45.84.H07.1.454.CMB.2.raw
  modified_base (189)..(189): a, c, t, g, unknown or other
  modified_base (308)..(308): a, c, t, g, unknown or other
  modified_base (434)..(434): a, c, t, g, unknown or other
  modified_base (447)..(447): a, c, t, g, unknown or other
  modified_base (453)..(453): a, c, t, g, unknown or other
  modified_base (467)..(467): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttccttttgctattgtagaaggtgtccactgtgaggtncagctgggtggaggtcggggggaggcctggtcaaggccggtgggggtccctgagactctcctgtgcacgcctctggtacttcgacttcagttatttatagtgtagtaaagtcgggtccncgaggcctccggaaggggacggggctgggaggtcgggtctcatacctattcgacagtagctaggtgacaagtatataacttcgcagactagaggtggaaacggccgtctacaaactctcaccaganaccaacgacaaanacctanactagtacactaanaaactacgaactagtcagacgagaccgagacgacgtcttacgttacacgtactaacgacacagacgtaacgttaagtacggttctttaggacgttggtaggtacggg

SEQ ID NO: 420804 - DNA, 597 bp, Homo sapiens
  misc_feature: GZ8MTXP02F8332.45.84.H07.1.454.CMB.2.raw
  modified_base (258)..(258): a, c, t, g, unknown or other
  modified_base (280)..(280): a, c, t, g, unknown or other
  modified_base (405)..(405): a, c, t, g, unknown or other
  modified_base (538)..(538): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttcctttttgctattgtagaaggtgtccactgtgaggtgcagctggtggaggtcggggggagcctggtcaagccgtggggggtccctgagactctcctgtgcagcctntggattcgacttcagtatttanagtgtagaaagtgggtccgcaggctccgaggggaaggggctggagttggggtctcgatccgattagctagtagccagtgtacacatatattcgcagacctcagtagaacggccgcttacaaactntacctccgaagacgaaccaacgtacccaaagaacctcaacttagtatacctaacaaagtagaaacctagtcagagacgacgaacggacgacggtacttacggtttaacctacgtacgtaacggacgaaaccgnggaactcgttaaaagtaacgggtttaccttttaggagttcggtttagggtaaccggggg

SEQ ID NO: 420805 - DNA, 559 bp, Homo sapiens
  misc_feature: GZ8MTXP02FOXMM.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcgggggagcctggtcaagccgtgggggtccctgagactctcctgtgcagcctctggattcgacttcagtatttatagtgtagaaagtgggtccgccaggctccgaggggaggggctggagtgggtctcatccattagcagtagccagtgtcactatatattcgcagactcaggtgaaagggcccgacttacaaactatcctacccgaagacgaaccaaacgacccaaagaaacctcaactgtatactaacaaatgaacagtcagagacgcgaaggtacacggtcttacgtttacacgtagtaacgacgaacgacgtaagctaagtaaggttcttttagacgttggtaggtaccgggg

SEQ ID NO: 420806 - DNA, 554 bp, Homo sapiens
  misc_feature: GZ8MTXP02HAEVC.45.84.H07.1.454.CMB.2.raw
  modified_base (395)..(395): a, c, t, g, unknown or other
  modified_base (469)..(469): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcggggggaggcctggtcaaggccgtggggggtccctgagactctcctgtgcagcctctggattcgacttcagttatttatagtgtagaaagtgggtccgcaggctccgaggggagggctgggagtgggtctcatccatacgcagtagcagtgcacatatatacgcagactcgagtgaacggggtccncttacaaactctcctaccaagacgaaaccaaccgaccaaagtaacctcactagtaactacaacaaatcgaaacngtactgaacgacgaccggaagaccgacggtcttacggtttacacgtgtaaccgaagacagagacttaacgtaaggttctttaagg

SEQ ID NO: 420807 - DNA, 786 bp, Homo sapiens
  misc_feature: GZ8MTXP02IG6GD.45.84.H07.1.454.CMB.2.raw
  modified_base (269)..(269): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggttttcctttttgctattgtagaaggtgtccactgtgaggtgcagctgggtgggagggtcggggggaggccgtgggtcaaggcccggtggggggtccctggagctctcctgtgcngcctcgtggatcgtacttcagttattatagtgtagaagtcgggtccgccgaggcctaccggaggggaaggggcgtgggacggttgggtctcgattccgattacgctaggtagcgtaggtcggtacacgtattaaattaacgttaccgactaacggtaccttaccgaaagggtacgggaaaccgggggtacccccttacgtttaaacccaaaccgttaccttaccccgtaacccgaaaggtaaacccggaaaccccaaaacccgggaaaccccaaaacggtaaacccgtttaaccctaaaccgttagttaaaccttaaccctaaaaaccgtaaaagttaccggaaaaaccgtggtttaccgaaacgggaaacggtaacccggaaacccggggaacgggttaaacccgaccggggttaaccttttacggggttttaaacctacgggttacggtaaaccgaaaggtaaccgaaagggtacttaaccgttaaaagggtttaaaccggtttcgttttaaggg

SEQ ID NO: 420808 - DNA, 589 bp, Homo sapiens
  misc_feature: GZ8MTXP02I7PV7.45.84.H07.1.454.CMB.2.raw
  modified_base (464)..(464): a, c, t, g, unknown or other
  modified_base (542)..(542): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctgggtggaggtcggggggagcctggtcaaggccgtgggggtccctgagactctcctgtgcagcctcgtggattcgacttcagttatttatagtgtagaaagtcgggtccgccaggctccgaggggaagggctggagtgggtctcatccattagcagtagccgagtgtcacatatattcgctagactcgagtaggaaacggggcccacttacaatatctaccagacacaacgaccaaagactcgactgtactacgtaacaaagttcgaaaacngttacgagaacgacgaccgacgggacacgggtctttacggtttacctaccgttaggtaaaccgagtaccgaaggtaanccttaaaggtaaggttcttttaggaacgttcggtagggtaaccgggg

SEQ ID NO: 420809 - DNA, 721 bp, Homo sapiens
  misc_feature: GZ8MTXP02GY53O.45.84.H07.1.454.CMB.2.raw
  modified_base (355)..(355): a, c, t, g, unknown or other
  modified_base (560)..(560): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactgggctccgcttggttttccttttgctattgtagaagtgtccactgtgaggtgcagcgtggtggaggtcgggggagccgtggtcgaagccggtgggggtccctgagactctcttgcacgcgtctgtgtacgtactctagtattatagtagtagaagtacggtcgtaccgacgtacgccgagggagggtcggtggtggtggtcgtctacgtctacgtagacgngtagtcgacgtggtctactactattaacgttacgaccgacgtaacgtacgagtaacgggtacgggaccggtacctacgtaaacctaacgttcccacccggtaaagaaccggaaacccgaaacccgaacccgtaaaactaaaacccgttcccaaagtttaacgtaacttaccgtaaaacttaaacgacgggttaacacgttaacgngaaagggaacgccggaaacgggtacccgtacgggttaacctttcgtttaaaacgcggttaacgtaaaccgggaaagtaacccgaacgtaagttaccgtaaacgtttaacgggttaacttttcgggaaagtttcggggttaacggggcgggtaaaaacccgg

SEQ ID NO: 420810 - DNA, 566 bp, Homo sapiens
  misc_feature: GZ8MTXP02FVKVW.45.84.H07.1.454.CMB.2.raw
tcagacgcgatcgacacgaccggtgctcgatttagcagacgtctgtcgcgggggaggagaggagccttagccctggattccaaggcctatccacttggtgatcagcactgagcaccgaggattcaccatggcactggggctccgctgggttttcctttttgctattgtagaaggtgtccactgtgaggtgcagctggtggaggtcggggggaggcctggtcaagccgtggggggtccctgagactctcctgtgcagcctctggattcgacttcagtatttatagtgtgaatgggtccgccaggctccgagggaaggggctggaggtgggtctcgatccattagcagtagccagtgtacacatattatacgcagactcgagtagaacggggccacttacgaaacctatcctacccgaagacgaaccaacgacccaaagaaacctcaacctgtaactacctaaacaaatacggaaaacagtctagagacgaccgagacgacggccttagttacctactagtacgacgaacagtagaacttagtaaggtcttttagatgtggtacgggg

SEQ ID NO: 420811 - DNA, 630 bp, Homo sapiens
  misc_feature: GZ8MTXP02G5Z0Z.45.84.H07.1.454.CMB.2.raw
  modified_base (423)..(423): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttcctttttgctattgtagaaggtgtccactgtgaggtgcagctggtggaggtcggggggagccgtggtcaagccgtggggggtccctgagactctcctgtgcagcctctggattcgacttcagttatttatagtgtagaaagtcgggtccgccgaggcctccggaggggaaggggcgtgggaggtgggtctcgactcctagttagcagtagccaggtgtacactatatattacgcagactacgagtagaacgggcccgtacttacaaactntacctaccaagaacgaccaacgaccaaagaccactaatgtaactactaaacaaatcgaaactacgtacgtaggacgacggacccggaagggacccgtacgggtactttacgtttaaaccacggttacggtaaacgacgaaccgaggtaagtaaccgttaagtaacgggtttacttttaggacgtttaggggtacgggtaaccggggg

SEQ ID NO: 420812 - DNA, 597 bp, Homo sapiens
  misc_feature: GZ8MTXP02GXQE3.45.84.H07.1.454.CMB.2.raw
  modified_base (283)..(283): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttcctttttgctattgtagaaggtgtccactgtgaggtgcagctggtggaggtcggggggaggccgtggtcaagccgtgggggtccctgagactctcctgtgcagcctcgtggattcgacttcagttatttanagtgtgaaagtgggtccgccgaggctccgaggggaaggggctggagtgggtctcatccatagcaggtagccagtggtacacgtatatattacgcaagactcgaggtggaaacgggcccgtcttacaaactactaccgtccagaacgaccaaccgaccaaagacctacactagtaactactaaacaaagtagaaacagtactaggaacgacgacccggtaagaccgtacggtcgttacgtttactaccggttagtaacgacgacgagaacgaacttaagtaacgttctttaggtacgtggtacgggtaacggggg

SEQ ID NO: 420813 - DNA, 543 bp, Homo sapiens
  misc_feature: GZ8MTXP02GVK98.45.84.H07.1.454.CMB.2.raw
  modified_base (377)..(377): a, c, t, g, unknown or other
  modified_base (422)..(422): a, c, t, g, unknown or other
  modified_base (452)..(452): a, c, t, g, unknown or other
  modified_base (477)..(477): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttcctttttgctattgtagaaggtgtccactgtgaggtgcagctggtggaggtcggggggaggcctggtcaagccgtggggggtccctgagactctcctgtgcagcctctggattcgacttcagtatttatagtgtgaaatgggtccgcaggctccgagggaaggggctgggagtgggtctcgatccattacgcagtagcagtggtcacgatatattacgnagactcagtgaaacggccgacgttacaaactatcctacccagganaaccaacgaccaaacgaactcaactgtaanactaacaaatagaaacagtctaganagccgaggacacgcttagttactacgtcgtaacgaagacagacgacgtaataacggtacttttagg

SEQ ID NO: 420814 - DNA, 575 bp, Homo sapiens
  misc_feature: GZ8MTXP02JHZ4U.45.84.H07.1.454.CMB.2.raw
  modified_base (422)..(422): a, c, t, g, unknown or other
  modified_base (445)..(445): a, c, t, g, unknown or other
  modified_base (482)..(482): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttcctttttgctattgtagaaggtgtccactgtgaggtgcagctggtggagtcgggggaggcctggtcaagccgtgggggtccctgagactctcctgtgcagcctctggattcgacttcagtatttagtagtgtagaaagtgggtccgccgaggctccgaggggaaggggctgggagtgggtctcgatccattacgctagtacgcgagtcggtacacgtaataattaagttacgcaaggtactcgaaaggtgaaacgggggtcccncttacaaacatcctaccaagganacaacgaccaaagaactcactagtatacaacaaatanaacgaacgtactagaagacgacgacggacgacggacgttacgttacgtacgtacgtaacgaagaacgaacgacgacgtagtaagtacgtttag

SEQ ID NO: 420815 - DNA, 633 bp, Homo sapiens
  misc_feature: GZ8MTXP02IR5QO.45.84.H07.1.454.CMB.2.raw
  modified_base (260)..(260): a, c, t, g, unknown or other
  modified_base (505)..(505): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagcgtggtgggagggtcggggggaggccgtgggtcaaggccggtggggggtccctgagactctcctgtgcngcctgtggtattcgacttctagttatttatagtgtagaagtcgggtccgccgaggcctaccggaggggacggggtcgtgggtaggtcgggtctcactcctattacgcagtacgccgtagtcggtacactatattactacgcaagactacgagtaggaacgggtccctacttaccaaacgtacttccaaccgaagaacgaacccaaacgacccaaaagaccttcaaccttagtaacctaactaaanaatacgaaactacgtctaggaacgaccgaccggaaggtaccaacggtcttacgttaaccacgtacgtacaacgtacaagtacgtaacgtaaagtacggttctttaggagtttacgggacggtaacggg

SEQ ID NO: 420816 - DNA, 664 bp, Homo sapiens
  misc_feature: GZ8MTXP02HEOKZ.45.84.H07.1.454.CMB.2.raw
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggttttccttttgctattgtagaaggtgtccactgtgaggtgcagctggtgggaggtcgggggagccgtggtcaaggccgtgggggtccctgacgactctccgtgtgcagcctcgtggtattcgacttcagttatttatagtgtagaagtcgggtccgcgaggcctaccggaaggggaacggggcgtagggtaggtgggtctactactaccgtattaccgacgtagtacgacgtaggtcggtacacgtaattaattaacgttaccgactaagtaccttacggaagggttaacggaaaccgggggtccctaacttaccaaaactcttcccaaccgaaaggaaccgaaacccgaaaccgaaccgtaaaacgtaaacctacctacgttacgtaacttaacctaaacaaaagtacgaaactagttcgaggaacgaccgaccggaaggactaccggtattacgtttaacacgtagtaaccgaagtacagtacgtactaagttaacggttctttagg

SEQ ID NO: 420817 - DNA, 782 bp, Homo sapiens
  misc_feature: GZ8MTXP02JCPAJ.45.84.H07.1.454.CMB.2.raw
  modified_base (284)..(284): a, c, t, g, unknown or other
  modified_base (378)..(378): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttccttttgctattgtagaaggtgtccactgtgaggtgcagcgtgggtgggagggtcggggggagccgtggtacaaggccggtgggggtccctgacgactctcctgtgcacgcctcgtggtacttcgacttanagttatttatagtagtagaagtcggtccgccgaggcctacggaggggaaggggcgtagggaggttcgggtctacgtaagttccgtaagttacgntaaaggtagaccgtaaggtcgtactaaacgtaattaattaacgttaccggaactaaaggtacccgtacgaagggtacgggtaaacggggtcccttaaccgttaccaaacgtactccgtaacgaaggaaacgaaacccgaaaccgaaccgaaaacgtaacccttacgtaaacgttacgtttaaaactaaaccgtaaaactaaaacgtacgtaaaacccgtagttaacgaaggaacgaaccggggaaccggaaagggtaacccgttaaccgggttactttaacgggtttttaaacccaaacggttacggttaaaaccggaacggtaaaacgtacggtaaaacgtttaaccgtaaaggtttaacggtttctttaggtaggtttacggacgggggttaaaacccgggg

SEQ ID NO: 420818 - DNA, 617 bp, Homo sapiens
  misc_feature: GZ8MTXP02IWVXU.45.84.H07.1.454.CMB.2.raw
  modified_base (249)..(249): a, c, t, g, unknown or other
  modified_base (256)..(256): a, c, t, g, unknown or other
  modified_base (279)..(279): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttccttttgctattgtagaaggtgtccactgtgaggtgcagctggtggaggtcgggggagcctggtcaagccgtgggggtccctgagactctcctgtncagcctntggattcgacttcagttatttanagtgtgaaagtgggtcctccaggctccggaggggaacggggtcgtggagtcggggtctcactccattagctagtacgccaggtcgtcactatatatcgcagacctgagtggaacgggccgtacttacaactatcctacgaagacgaaccaacgaccctaaagaacctcgactgtaatctaaacaattacggaaaactcgttactaggaaggacgaccggaacgtacgacggtacgttaggtttaacctaacgtacggtaaaccgacgtaaccgaggaaacgtaaccgtaaagttaacgggttacgtttaggacggtttcggtagggtaaacccggggg

SEQ ID NO: 420819 - DNA, 711 bp, Homo sapiens
  misc_feature: GZ8MTXP02JASTF.45.84.H07.1.454.CMB.2.raw
  modified_base (565)..(565): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactgggctccgcttgggttttccttttgctattgtagaaggtgtccactgtgaggtgcagcgtggtggaggtcggggggaggcctggtcaaggccgtgggggtccctgagactctcctgtcgcagcctcgtggtacttcgacttcagttatttagtagttgtagtaaagttcgggtccgaccgtaggcctaccggaagggggaaggggtcgtagggtaggttcgggtctacgtacgtcctaagttacgcgtaaggtacgacccgtaggttcggtactaactagttaattacgttaccgactacggtactacgtagtacggaaacggggtccctaactttaaccaaactacttccgtacccgaaaaggacgaaaccgaaaccccgaccgtaaaaacggtaccttaacgtacgttacgttaaatacccgttaaaanaaaacgtacgaaacgtacgtacgaggaacggacggacgaacggtaccgtaacggttctttacgttacgacgttaacggaacgaacgaacgagtacgtaacgttaacgttaacgttcgttaaggtacggtcgggttaagggaccggg

SEQ ID NO: 420820 - DNA, 627 bp, Homo sapiens
  misc_feature: GZ8MTXP02GUSV2.45.84.H07.1.454.CMB.2.raw
  modified_base (484)..(484): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcgggggaggccgtggtcaagccgtggggggtccctgagactctcctgtgcagcctcgtggattcgacttcagtatttatagtgtagaaagtcgggtccgccgaggcctccgaggggaaggggctggaggtgggtctacgactcctaagttagctaagtagcccgagtcggtacacgtatattaattcgcagacttacgagtcggaaacgggcccgtacttacaaacatcctacccaagaacgaccaaaccgaccaaagacctctacctgtaactacctaaanaaatagaaacacgtcgtagacgaacggccgaagggaccacggtaccgtttacgtttacctaccgtagtaaacggacgaaccgaggaacgtaaccgttaaagtaaggttaccttttaggtaacgttggtacgggtaaccggggg

SEQ ID NO: 420821 - DNA, 637 bp, Homo sapiens
  misc_feature: GZ8MTXP02H55QN.45.84.H07.1.454.CMB.2.raw
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttcctttttgctattgtagaaggtgtccactgtgaggtgcagcgtggtgggaggtcggggggaggccgtggtcaaggccgtgggggtccctgagactctcctgtgcagcctcgtgacttcgacttctagttattatagtgtagaagtcgggtccgcgaggcctacgaggggaaggggcgtgggaggtgggtctacgactcctagttacgcgtagtagctaggtcggtacacgaattattacgttacgactacgactcgagtcggaaggggtccctcttaaccgaactactcccgtacgaagaacgaaccaacgaccgaaaactaccgtacaacttacgactaacccttaaacaaaataacgtaaactaacggttaccgagggaacgaacggtccggaaaacggacgaaccggttctaacgtttacctaaccggtagtaacgaacgtacaaaggtactacgtaagttaacgtttaacgtttg

SEQ ID NO: 420822 - DNA, 614 bp, Homo sapiens
  misc_feature: GZ8MTXP02HKE2Q.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcggggggaggctggtcaaggccgtgggggtccctgagactctcctgtgcagcctctggattcgacttcagtatttatagtgtgaaagtgggtccgcaggctccgaggggagggctggagtgggtctcgactccattagctaggtagccagtgtacacatatatacgcaagactgaagtggaaacgggcccgtacttacaaacgtactccgtacccgaagacgaacccaaacgaccccgaaaagtaaccctacgtaactacgttaactaccgtaaacaaaagtcgaaaacacgttaccaggagtacgacccgtaagggacacgggtcttaggtttacctaaacgtcggtaaacgacgaaccaggagtaacgtaagtaacgggttcttttaggacttacggtgggtaacggggg

SEQ ID NO: 420823 - DNA, 617 bp, Homo sapiens
  misc_feature: GZ8MTXP02JBQB2.45.84.H07.1.454.CMB.2.raw
  modified_base (329)..(329): a, c, t, g, unknown or other
  modified_base (422)..(422): a, c, t, g, unknown or other
  modified_base (459)..(459): a, c, t, g, unknown or other
  modified_base (479)..(479): a, c, t, g, unknown or other
  modified_base (519)..(519): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttccttttgctattgtagaaggtgtccactgtgaggtgcagctggtggaggtcgggggaggcctgggtacaagccgtgggggtccctgagactctcctgtgcacgcctcgtggatcgtacttcagttattatagtgtagaaagtcggtccgccaggctacgaggggaaggggctaggnggtgggtctcatcctattacgctaggtagccgtagtcggtacactatatattcgcacgactacgagtacggtaacgggccgtacttacaaacncttaccaccaagacgaaccgaaacgaccgaaagtacnctaagtacgtataacctaanaatacgaacagtcaggacgacgacggtagcgaacccggtnttacgttactacgttacggaacgtaacgaacgtaggaagtccgttaaaggtaaaccggtttcgtttaaggacgttttagggacggggttaaccggggg

SEQ ID NO: 420824 - DNA, 763 bp, Homo sapiens
  misc_feature: GZ8MTXP02GT00B.45.84.H07.1.454.CMB.2.raw
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggttttccttttgctattgtagaaggtgtccactgtgaggtgcagcgtgggtgggagggtcggggggaggccgtgggtcaacggtccggtcggggggtccctggacgactcctccgtgtcgcacgcctgtggtacttcgtacttctaagttatttagtagtgtagtaaagtcgggtcccgaccgtaggccgtaccggaagggggtaacggggcgtaggggtacggttcggggttcctacgtacgtaccgtagttaccgacgtagtacgacgtaggtcggtacactaattaattacgttaacgcaacggtactacggaagtggggaaaccgggtccctacttaccgaaactacttacccgacgaagaaccgaaaccaaccggaaccaaaggtaaccctacctacgttaacgttaaccttaaccgaaaacgtaaacgtacgtaaaacgtacggttaccgtaaggaaacggacccgggtaacccggacgggaaaccggtacccggttacgttaaaccggttttacccgtaacggtttaaccggtaaacgtaaccggaaacgtaaagggtaccgttaaaccgtttaaaggttacgggtttacctttttaagggg

SEQ ID NO: 420825 - DNA, 546 bp, Homo sapiens
  misc_feature: GZ8MTXP02IZA0M.45.84.H07.1.454.CMB.2.raw
  modified_base (363)..(363): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcggggggaggcctggtcaagccgtgggggtccctgagactctcctgtgcagcctctggattcgacttcagtatttatagtgtagaaatgggtccgccaggctccgagggaggggctggagtgggtctcatccattagcagtagccagtgtcacatatatcncagactcagtgaaacgggccgacttcgaacatctccagacgaccaaacggaccaaagactacactagtaactctaacaaatagaaaccagtctagagagccgagacacgggtcttaggtttaactacgtagtaacgagaacgagagaacgtaagtaacggtctttagattggtagtacggggg

SEQ ID NO: 420826 - DNA, 574 bp, Homo sapiens
  misc_feature: GZ8MTXP02HU8ML.45.84.H07.1.454.CMB.2.raw
  modified_base (351)..(351): a, c, t, g, unknown or other
  modified_base (483)..(483): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcgggggagcctggtcaagccgtgggggtccctgagactctcctgtgcagcctctggattcgacttcagttattatagtgtagaaatgggtccgccaggcctccgaggggaacggggcgtggagtgggtctcgatccattagctaggtanccgagtggtacacgataattagttacgctagacttacgagtaggaaacggggcctacttacaactactcctaccgagacgaaccaacggaccaaacgtactacgactagtactacttaacaaatcggaaacnggtacagaagacgacgaagacacggtctacgtttacacttgaccgagacagacgaattaacgtaaggtctttagacgtggttacggacggg

SEQ ID NO: 420827 - DNA, 727 bp, Homo sapiens
  misc_feature: GZ8MTXP02JRN11.45.84.H07.1.454.CMB.2.raw
  modified_base (238)..(238): a, c, t, g, unknown or other
  modified_base (277)..(277): a, c, t, g, unknown or other
  modified_base (287)..(287): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagcgtggtgggaggtcggggggagcctggtcaaggccgtgggggtcccngagactctcctgtgcagtccctgtggtattcgtaccttnagttatttanagtgtagaaagtgggtccgcgaggcctaccggaggggacgggctagggaggtcgggtctcatcctagttagccgtaaggtacgccgtaggtcggtactacgtattattacgttaccgctaacggaccttagaagggtacggaaacgggtcccgtactttaccaaaacctcttacccgacgaaaagaccgaaaccaaccggaacccaaaacggtaaccctactaaaccgttagttaaaccttaactaaaccgaaaattcggaaaactacggttctaagggaacgtaacgggacccggagggtaaaacccgacggtttaccgtttaagggtttacccttaacgggacgttaaccggaaacgtaacgtaaccggtaagtaaccgttaggttaaagggtttcccttttaaggtaacgtttgggggtaacgggtttaaacggggg

SEQ ID NO: 420828 - DNA, 651 bp, Homo sapiens
  misc_feature: GZ8MTXP02IWIBT.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactgggctccgctgggttttccttttgctattgtagaaggtgtccactgtgaggtgcagctgggtgggaggtcggggggagcctggtcaagccgtgggggtccctgagactctcctgtgcagcctctggattcgacttcagttatttatagtgtagaaagtgggtccgccaggcctccgagggaaggggctggagtgggtctcatccattagctagtagcagtggtcactatattattcgcagactcgagtagaaacggggccacgttacaaacagtcctaccaagaacgaaccgaaacgacccaaaagtaacctactaacgtacgttaactaaccttaaacaaaacttacggaaaacctaggtaccttaagggacgaacggaccggaagggaacccgtacgggtacgtttacggtttaaacctaacgttacggttaaacgacgaaacgaacggtaacgtaaccgttaaacgtaagggttactttttaggaacggtttggtaacggggtttaaccggggg

SEQ ID NO: 420829 - DNA, 870 bp, Homo sapiens
  misc_feature: GZ8MTXP02F828S.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcacgtggggctccgcttgggttttccttttgcttattgtagaaggtcgtccactgtgaggtgcagcgtgggtgggagggtcggggggaggtccgtgggtacaacggtcccggttggggggtccctgagtacctcctccgtgtgcagtccctgtggtatcgtacttctagttattagtaggttgtagtaaagtcgggtacccgccgaggtcctaccgggaagggggaacggggtcgtggggtacggttcggggtcctacgtacttaccgtagttaagacgtaaggtagacccggtagttcggtacaacgttaattaaacgttaacgttaccgacgtaacggtaacccgttaggtaacgggtacggggtaaaccgggggtccccttacctttaaccaaaccgttacttacccgttaacccgaaggaaacccgaaccccggaaaaccgtaacccgtaaacggtaaaccctccccggttaaaagttaccgtttaaactacccttaaaaactaaaacgggttaaccgaaaaccgtacgtttacggtaacggaacgggaaaccgggtacccgggaaaagggaccccgttaaccgggggttacctttttaacgggttttaaacccctaagggtttaaccggaaacggttaacgaaacccgtaagggggtaaaaccttaagttaaaaccgggtttaagttttccggtttaagtacggtttacgggggttacggggttaaacccggggg

SEQ ID NO: 420830 - DNA, 656 bp, Homo sapiens
  misc_feature: GZ8MTXP02JNC2Z.45.84.H07.1.454.CMB.2.raw
  modified_base (427)..(427): a, c, t, g, unknown or other
  modified_base (523)..(523): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggttttccttttgctattgtagaaggtgtccactgtgaggtgcagctggtggaggtcggggggagccgtggtcgaaggtccgtcggggggtccctggagtactctcctgtcgcagcctcgtgtattcgacttctagttatttatagtgtagtaagtcgggtccgaccgtaggcctaccggaagggggaacggggtccgtaggggtaggttcgggtctacgtactccgtagttacgcgtagtacgacgtagtggtacacgtattactagtacganagtactacgaggtacgaaccgggtcctacgttacaactatccaacgagtaacgaaccaacgaccaaagtacctactactgtaactaaccctaaaanaaacgtacgaacgtcgtaacggtaggaacgacgggaccgaacggtacccggttacggtactttaacgttaacctacggtacggaaacggaataaccggaagacttaacgttaaggttaacgtttcgtttaagg

SEQ ID NO: 420831 - DNA, 662 bp, Homo sapiens
  misc_feature: GZ8MTXP02F515N.45.84.H07.1.454.CMB.2.raw
tcagacgcgatcgacacgaccggtgctcgatttagcagacgtctgtcgcggggagctctgagagaggagccttagccctggattccaaggcctatccacttggtgatcagcactgagcaccgaggattcaccatggcacgtggggctccgcgttgggttttccttttgctattgtagaaggtgtccatgtgaggtgcagcgtggtgggagggtcgggggagccgtggtacgaaggccggtcgggggtcccctggacgtacctctccgtggtgcgctctgtagtctctactgtattattagtgtgaagtaggtcggtccgcgcgccgtacggaggggcggtcggtagggtggtcggtcctactaccgtacttagtacgacgtagtagacgtaggtcgtacagtattaagttacgtacgacgtaacgtaccgtagttaaaggacgggaacccggtccctaacttaaccaaattcctccccaagaacgacaaaaccgtaccgaaaccgaaactacctaccgtagttaactaactaacctaaaataagtaaacgacgttaacgtgaaacgggagaacccggacggtaacggaaccgttcggttacgtttaacgttacccgtaggacgtaacgaagacgaggtactagttaagtcgtttgtttaagg

SEQ ID NO: 420832 - DNA, 656 bp, Homo sapiens
  misc_feature: GZ8MTXP02J1KJ2.45.84.H07.1.454.CMB.2.raw
  modified_base (260)..(260): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcacgtggggctccgcttgggttttcctttttgctattgtagaaggtgtccactgtgaggtgcagcgtggtggaggtcgggggagccgtggtcaaggccgtgggggtccctgagctctctgtgcngctctggattcgacttcgattatttatagtgtagaagtcggtccgcgaggctaccggaggggagggcgtagggacggtcgggtctcgtactcctaagtttacgacgtagtacgacgtaggtacggtaccagtattaacttaacgttacgacgtaacgtaccgtacgaagggttacggaaaccggggtcccttacttaaccaactacttccgaaccgaagaaccgaaccgaaccggaaccaaagtaacctacgacgttactactaacctaacaaagttacgaaaccgtagttccgaagaacgacgaccggaacggacgtacccggttacttacgtttacgaacgttacgaacggaacgacgaagtacgtaacgttagttaaccggtttcgtttaagg

SEQ ID NO: 420833 - DNA, 628 bp, Homo sapiens
  misc_feature: GZ8MTXP02FY0YA.45.84.H07.1.454.CMB.2.raw
  modified_base (357)..(357): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcacgtggggctccgcttgggttttccttttgctattgtagaggtgtccactgtgaggtgcagcgtgggtgggagggtcggggggaggccgtggtacgaaggccggtgggggtccctggacgtactctccgtgtgcacgtcctcgtaggtacttcgtacttcgtagttatttatagtgtagaagtcggtccgcgaggctaccggaggggacgggcgtagggnggtgggtctcatccgtattacgacgtagtagcgtaggtgtacagtattaatagttaccgcaagtactacgaggtaggaacgggtccctacttaccgaaatctaccgtacgaagtaacgaaaccgaaccgaccaaacgacttacgacttagtaactaccaaaacaaagtagaacgtaagtcgtaaggacgacgaccggagaaccgtcgtacttacgttacctacggtagtaacgaacgacaagtacgacgtttaaaggtacgttgtttaagg

SEQ ID NO: 420834 - DNA, 726 bp, Homo sapiens
  misc_feature: GZ8MTXP02GM4TP.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcacgtggggctccgcgttgggttttcctttttgctattgtagaaggtgtccatgtgaggtgcagctggtggaggtcggggggaggcctgggtcaacggccggtcgggggtccctgagactctcctgtgcagcctcgtggtacttcgtacttctagttatttagtagtgtagtaaacgtcgggtcccgccgaggccgtaccggaggggaaggggcgtagggaggtgggtcctcgagtcctaagttagaagtagcgaggtcgtcaacgtaattattaacttacgacgtaacgtacgtacgtaaggtacgggaacgggtacccgtacttaaccgtaaaccacttaccgtaacccgaaggaaccgaaaccgaaaccgaaccgaaacgtaaacctacaacttacgtaaacttaacctaaacgtaaaacgtacgaaaccgtagtaccgtaacggacggaacggaacccggtaaggacccgtaacgggtcgtttaacggtttactacgttacggtaaacggacgaaccgtaaggtacgtaaccgttaaggttaacggtttacgtttaggtaagttcggggtaacgggtttacggggaaaccgg

SEQ ID NO: 420835 - DNA, 609 bp, Homo sapiens
  misc_feature: GZ8MTXP02HCPB3.45.84.H07.1.454.CMB.2.raw
  modified_base (292)..(292): a, c, t, g, unknown or other
  modified_base (311)..(311): a, c, t, g, unknown or other
  modified_base (400)..(400): a, c, t, g, unknown or other
  modified_base (522)..(522): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttccttttgctattgtagaaggtgtccactgtgaggtgcagctggtgggaggtcgggggagcctggtcaaggccgtggggggtccctggacgtactctcctggtgcacgcctctggattcgacttcagttatttanagtgtagaagtcgggtccnccgaggctaccgaggggaaggggcgtgggagtgggtctcgactcctaatcgactagtagcgtaggtggtcacgtattagtattaccganaggtactacgagtacggaaccggggtcacctttaccaaatctccgtaccaaggaacaccgaaacgacccgaaaacgtaaacctcctattagtactacgtaaacaaattcgaaaatcgttacngggaacgacgtaccggaggacgacggtacttacgttaaccttacgcgtaaacgaagacgagtaccagtttaacgaggttacgttttg

SEQ ID NO: 420836 - DNA, 685 bp, Homo sapiens
  misc_feature: GZ8MTXP02IXF4H.45.84.H07.1.454.CMB.2.raw
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgctgggttttccttttgctattgtagaaggtgtccactgtgaggtgcagcgtggtggaggtcgggggaggccgtggtcaagccgtgggggtccctgagactctcctgtgcagcctcgtggtattcgacttcagttatttatagtgtagaagtcgggtccgcgaggcctaccgaggggaaggggcgtgggaggttggggtcctacgtatccgtaatttacgacgtagtacgcgtaggtcggtacacgtaattaattaacgtttaaccgacaacggtaaccttacgaaagggttacgggaaacggggtcccctactttaaacaaacgtacttcccaaccgaaggaaaccgaaaccaaaccggaacccaaaacgtacctacgtaactacgttaaactacctaaaacaaagttacgaaactaggtcctaaagggacgaaccggaccggaaggtaaccgacggttactttaacggttttaccaacggttcgtaaaccgaagtacgaaaggtactacgtaagttaccgggtttacttttaggg

SEQ ID NO: 420837 - DNA, 764 bp, Homo sapiens
  misc_feature: GZ8MTXP02F8SMP.45.84.H07.1.454.CMB.2.raw
  modified_base (251)..(251): a, c, t, g, unknown or other
  modified_base (278)..(278): a, c, t, g, unknown or other
  modified_base (296)..(296): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcggggggagcctggtcaagccgtgggggtccctgagactctcctgtgcngcctctggattcgacttcagtatttanagtgtagaagtgggtccncaggctccggaggggagggctggaggtcgggtctcactcctagttagacaggtacgccgtagtcgtacaacgtattatattacgcaagtacctacgagtacggaaacggggtccctacttaccaaaactacttacccgacgaacgaaacaaacccgtaaacccgaacccgtaaaagaacccttacctaaacgtttacggtaaaccttaaccctttaaaacaaaaacgttaacgaaaacccgttaaggtttaccaaggggaaacggtaaacccggcccgggtaaaacggggaccccgtaaaccgggttacccgttttaaacgggtttttaaacccgtaaccggtttaaacgggaaacccgtaaagggttaaacccaagggtttaaaccgaacccggttttaaaaggttaaacccgggttttcgtttttaagggaaacgtttgggggttaccggggttaaacccgggggg

SEQ ID NO: 420838 - DNA, 590 bp, Homo sapiens
  misc_feature: GZ8MTXP02HB3JK.45.84.H07.1.454.CMB.2.raw
  modified_base (377)..(377): a, c, t, g, unknown or other
  modified_base (397)..(397): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggtttttcctttttgctattgtagaaggtgtccactgtgaggtgcagctggtggaggtcggggggaggcctggtcaaggccgtgggggtccctgagctctcctgtgcagcctctggattcgacttcagtatttatagtgtagaaatgggtccgccaggctccgaggggaaggggctgggagtgggtctcatccattacgcaagtagcagtgtcacatatatacncagactcagtgaaacggccncttagaacatcctaccagaacgaccaaacggaccaaagtaacctctaactgtaactactaaaccaaagacgtaaacagttaccagaagaacgacccggaaggaaccacgggtctttaacggtttaacctacgtacggttaaccgaagaaccgtaacgagtaaccgttaaagtaaaaccggtttcttttaaggg

SEQ ID NO: 420839 - DNA, 683 bp, Homo sapiens
  misc_feature: GZ8MTXP02HCZ0X.45.84.H07.1.454.CMB.2.raw
  modified_base (301)..(301): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcggggggaggcctgggtcaaggccgtggggggtccctgagactctcctgtgcagcctctggattcgacttcagttattatagtgtagaaagtgggtccnccgaggcctccgaggggaaggggcgtgggaggtggggtctcgatccattacgcagtagccgagtgtcaacgtatattattacgcaagactcgagtggaaacgggcccacgttacaaactatcctacgaagaacgaaccaaaccggacccaaaacggtaaacctaccgaacttacggttaaactacccttaaaacaaaacttacggaaactaacggttacctaggaaacggacggacccggaacgggaaccgtaaccggtacgtttacggtttaacctaacggttacgtaaaccggtagaaccgtaggtaacggtaaccgttaaaaggttaaacgggtttaccgtttttaaggaggtttacggggttacgggtaaaccggggg

SEQ ID NO: 420840 - DNA, 762 bp, Homo sapiens
  misc_feature: GZ8MTXP02H4NN6.45.84.H07.1.454.CMB.2.raw
  modified_base (279)..(279): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttcctttttgctattgtagaaggtgtccactgtgaggtgcagctggtggaggtcggggggagcctggtcaaggccgtgggggtcctgagactctcctgtgcagcctctggattcgacttcagtatttanagttgtagaaagtcggggtccgccgaggcctccggaaggggaaacggggcgtagggaggtggggttcctcgaactccaatttaaggccaaggtagaccccgtaggttcgggtacaactattaataatttaccggactaaggtaccttacgaaggttacgggaaaacggggtccccgtactttaccgaaactaacgttcctaccgaagaaacgaaaccaaaccggaaccccaaaacggtaacctaaccgtaacttaaccggttaaacgtaaaccctttaaaaccaaaaagttacggaaaaccttaaacggtaccgttaggaaacggtacgggaaccccggaaagggaacccgtaaaccggggtaccgttacggtttttaaaccgaaacctttacggggtaaacgtaaacgaccgtaaaggacgtaaccgttaaaagttaaacggtacgtttttaggaaacgttcgggttaaggtaacccggggg

SEQ ID NO: 420841 - DNA, 561 bp, Homo sapiens
  misc_feature: GZ8MTXP02GK2TF.45.84.H07.1.454.CMB.2.raw
  modified_base (302)..(302): a, c, t, g, unknown or other
  modified_base (405)..(405): a, c, t, g, unknown or other
  modified_base (434)..(434): a, c, t, g, unknown or other
  modified_base (451)..(451): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagcgtgggtggaggtcggggggaggcctggtcaaggacgtggggggtccctgagactctcctgtgcagcctctggattcgacttcagttatttatagtgtagaaatgggtccnccgaggcctccgagggaggggctaggagtgggtctcatccatagcagtagccagtgtcacatatatcgcagactcagtggaaacgggcccgtacttacaaacngtcctccaagacgacaacgaccaaagacncactgtaatccgtaaanaaaagtgaaacagtctagaacggacgaccggagaccgacgtcgttagttactacgtacgtacgagacaagagtaactaagtaacgttactttgagttggtaggtacgggg

SEQ ID NO: 420842 - DNA, 766 bp, Homo sapiens
  misc_feature: GZ8MTXP02JSF6R.45.84.H07.1.454.CMB.2.raw
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggttttccttttgctattgtagaaggtgtccactgtgaggttcagcgtggtgggaggtcgggggacggggcctcggtcgacgacggtcggggtccggtcagactctcctcgtgcacgccgtctggagttcgtacttctagtatttattagtgtgaaagtcgggtccgccgacggcgtccgacggggaaggggcgtggtaggtgggtcgtcacgtccacttagtccgacgttagcgaggttggtacgacagtaattacgttacgaccgagtaacctcgtaggtacgggaaacggggccccgttccctttaacaaaccgtactttacctacccccgaaaggaaacgggaaaccctaaaacccgaccccggtaaaacgtaaaccccgtttactaaccccttaagggtttaacttaacccgtaaaaccaaaaatcggttaaaacccgtaaggtttcgttaaccgggaaagggacccgggaacccccggggtaaggaacccgtaaacccgggggttctttacgtttttaaaaccccgttaagaccggttaacggaaaacggaaccttaaaggggtaatcccggtttaaaagtaacgggtttccgtttttaggtaaggg

SEQ ID NO: 420843 - DNA, 773 bp, Homo sapiens
  misc_feature: GZ8MTXP02JXTAK.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcggggggaggcctggtcgaaggccgtgggggtccctgagctctcctgtgcagcctctggtattcgacttcagttatttatagtgtgaaagtcgggtccgtccgaggctccggaggggtaggggctagggaggtgggtctctagtccattacgcagtacgccgtagtggtacacgtataattacgttacgacgaacgtactaccgaggttacgggaaacgggtcccgtacccttagaaaccctactccgtacccgaaacgaacgaaacccgaaaccgtaacccgaaaagtacccttacctaacgttaccggtaaactttacccgtaaaactaaaactacgggaaaacctacgtttaccggaacggtaaacggacggtaacccggggaaacgggtacccgtaaaaccggggtttccgtttaaacgttttttaaaacccggtaccgtttacggggttaaacccggtaaaggaaaccgtaaccggtaaagttaacccgttaaaacggtttaaaggggttttacctttttaagggggtaccgtttaaggggtaccccgggggtttaaaacgggggg

SEQ ID NO: 420844 - DNA, 687 bp, Homo sapiens
  misc_feature: GZ8MTXP02I734T.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcggggggagcctggtcaagccgtgggggtccctgagactctcctgtgcagcctcgtggtattcgacttcagttatttatagtgtagaagtcgggtcccgccgaggcctaccggaggggaggggcgtgggaggtggggtctcgtactccgtagttacgacgtaggtacgccgtaggtcggtacactatattacgttcgcaaggtactacgagtacggaacgggcccgtacttacaaactacgtcctaccaagacgaacccaacgacccaaaagtaacctctaaacgttgttaaactaacctaaactaaaagttacggaaacctacgttaccgaggaacggaaacggaccggtaaacgggaccgtaaccgggttacgtttaacgttttaaacctacgttaacggtaaccgaagaaaccgtagtaaggtaaccgtaaacgtttaaggtttaccgtttagtacggttacgggttaggggtaaccggggg

SEQ ID NO: 420845 - DNA, 900 bp, Homo sapiens
  misc_feature: GZ8MTXP02JEXPL.45.84.H07.1.454.CMB.2.raw
tcagacgcgatcgacacgaccggtgctcgatttagcagacgtctgtcgcggggagctctgagagaggagccttagccctggattccaaggcctatccacttggtgatcagcactgagcaccgaggattcaccatggcacgtggggctccgcttgggttttccttttgctattgtagaaggtgtccactgtgaggtgcagctggtggaggtcgggggaggcctggtcaaggccgtgggggtccctgagctctcctgtgcagcctcgtggattcgacttcagttattatagtgtagaagtcggtccgccgaggtctacccgaggggaacggggtcgtaggggtaggttcggggttacctcgacttaccccgtaagtttacggaccgtaaggtagccgtaaggtcggttacaccgtattaaactttacgttaaccggactaaacggtaacctaccggaaaggggtttacggggaaaacccgggggtcccccgttaacgttttaaacccgaaaaacccgttcttttacccccgtaaacccccggtaaagggaaacccggtaaaacccccgaaaacccggggtaaacccccaaaaaaccgggggttaaaacccccttaccggttaaacttaacgggtttaaaaccttaacccccttaaaaaccgaaaagtttacgggaaaaaacccccgtgggtacccttaaggggaaacgtaaacccggggaaccccggggttaaaacgggaaacccccggtaaaaccgggggtttccttttaaaccgggggtttttttaaaacccaacccggttagggggtttaaaaaccccgaaagggttaaaacccggagggttaaaacccggttaacgtttaaaaggtttaaaacccgggggttttgtttttaaacgggg

SEQ ID NO: 420846 - DNA, 574 bp, Homo sapiens
  misc_feature: GZ8MTXP02GL4B6.45.84.H07.1.454.CMB.2.raw
  modified_base (401)..(401): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggaggcctggtcaagccgtgggggtccctgagactctcctgtgcagcctctggattcgacttcagtattatagtgtagaaatgggtccgccaggctccgagggaaggggctggaggtgggtctcgatccattagcagtagcagtgtacacatatattacgcagtactcgagtagaaaggggcccgcttacaaactntcctacccaagacgaaccaaacgacccaaagaaacctcaaacctgtaaactactaaacaaaattggaaaccagttcgagagaacgccgaaggtacgacggtacttcgtttaacgtactaggtaacgacgaaacgagaagaagtaagtaaagtctttagagttggtgtacgggg

SEQ ID NO: 420847 - DNA, 621 bp, Homo sapiens
  misc_feature: GZ8MTXP02HH67D.45.84.H07.1.454.CMB.2.raw
  modified_base (309)..(309): a, c, t, g, unknown or other
  modified_base (598)..(598): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttccttttgctattgtagaaggtgtccactgtgaggtgcagctgggtgggagggtcgggggggaggcctgggtcaaggccgtggggggtccctgagactctcctgtgcacgcctctggtattcgacttcagttatttatagtgtagaagtcgggtccnccgaggctccggaggggaggggcgtaggaggtgggtctcatccattagctaggtagccgtagtgtacactatatatacgcaagactacgaggtacggaacggggtccctacttacaaactctccaccgaagacaaccgaacgacccaaaagacctacacgttagttaactaacctaaacaaatacgaaactacgttcgaggaacggacgaccggaagggacccgtacggtacttaacgtttaccgtacgtagtaaacgacgactaagacgtaacgttaagtaacggttntttagagtgggttacggacgggg

SEQ ID NO: 420848 - DNA, 671 bp, Homo sapiens
  misc_feature: GZ8MTXP02GWE28.45.84.H07.1.454.CMB.2.raw
  modified_base (343)..(343): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttccttttgctattgtagaaggtgtccactgtgaggtgcagctggtggaggtcggggggaggccgtggtcaaggccgtgggggtccctgagactctcctgtgcacgcctctggattcgacttctagttattatagtgtagaaagtggtccgaccgaggcctccgaggggaagggcgtggaggtgggtctcgntacctagttagcagtagccgagtgtacactagtattatcgcaagacctcgagtaggaacgggcccgtattacaaacctactcccgaccaagacgaacccaaacggccaaaacgtactacgacgttagtaaacttaccctaaataaagttcgaaaactagttaccgaggaacggtaacggacccggaaacgggtaaccgaccggggttacctttacggttttaaacctaaccgtttagggaaacccgtaggaaacccgtaaggtaaacgttaaccgttaaaggttaacgggtttacttttaaggccgtttacgggtagggtaccggggg

SEQ ID NO: 420849 - DNA, 657 bp, Homo sapiens
  misc_feature: GZ8MTXP02JD2VK.45.84.H07.1.454.CMB.2.raw
  modified_base (296)..(296): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactgggctccgctggttttccttttgctatgtagaaggtgtccactgtgaggtgcagctggtggaggtcgggggagcctggtcaagccgtgggggtccctgagactctcctgtgcagcctctggacttcgacttcagttatttatagtgtagaaagtcgggtccnccgaggcctccgaggggagggcgtggaggtgggtctcatccagtagcagtgcaggtgcactatatactcgcagtactcgagtcggaaacgggcccgtacttacgaaacctactccctaccgaaggaacgtaacccgaaaaccgacccgaaaagtaaaccctcccgtaaacgttacgttaactaaaccgtaaaccaaaagttacggaaaacctacggtactagggaaaggacggtaacccggaggtaacccacgggtactttacgttttaaacctaccggttagtaaacgaacgtaaccgtagtacgtaaccgttaaaggttaacggttctttttaaggaggtttacggtaacgggtacggg

SEQ ID NO: 420850 - DNA, 628 bp, Homo sapiens
  misc_feature: GZ8MTXP02HS0LV.45.84.H07.1.454.CMB.2.raw
  modified_base (233)..(233): a, c, t, g, unknown or other
  modified_base (338)..(338): a, c, t, g, unknown or other
  modified_base (416)..(416): a, c, t, g, unknown or other
  modified_base (467)..(467): a, c, t, g, unknown or other
  modified_base (602)..(602): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactgggctccgctgggttttcctttttgctattgtagaaggtgtccactgtgaggtgcagctggtggaggtcgggggagcctggtcaagccgtgggggtccngagctctcctgtgcagcctcgtggacttcgacttcagttatttatagttgtagaaagtgggtccgccaggctaccggaggggaacgggctagggagtgggtcctnagtccattagcagtagccagtgtcaacatactattcgactagacttcaggtacggaacggggccctcttacaaacgtnttaccgacccaaggaagaaccaaccggaccctaaagtacccactaccgttntaaactttccaaaacgaaaagttcgaaactaacggtccttaaggacgacgggacccgttaaaggaccgacggtctttaggtttaaccctacgtagggttacaccgaacaggattaacctaagtaaaccggttttnttagtacggttggtacgggtaccggg

SEQ ID NO: 420851 - DNA, 667 bp, Homo sapiens
  misc_feature: GZ8MTXP02HIAFS.45.84.H07.1.454.CMB.2.raw
  modified_base (253)..(253): a, c, t, g, unknown or other
  modified_base (518)..(518): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttcctttttgctattgtagaaggtgtccactgtgaggtgcagctgggtggaggtcgggggagcctggtcaaggccgtgggggtcctgagactctcctgtgcngcctcgtgatcgtacttcagttatttatagtgtagtaagtcgggtccgaccgaggccgtacggaagggaggggcgtaggtaggttcgggtctcgtactccgtaattagacctaggtagaccgtaggtggtaccaagtatagttaacttccgactaacgtacctacggaagttacggggaaacgggtccctacttaccgaaactacttcccgaacaagaacgaaaccaccgaaccgaaagaacctctaacgtataacctactaaanaaagtacaaacgtagttacgagacggacgaccggtaaggacgtacgtacgtttacgtttaactaaacgtacgaacgaaccgaagaacgttacgaaacgtttaacggttaagtttaccgtttagaccgtttgggtaaggggtaaccgggg

SEQ ID NO: 420852 - DNA, 534 bp, Homo sapiens
  misc_feature: GZ8MTXP02HTJ4X.45.84.H07.1.454.CMB.2.raw
  modified_base (285)..(285): a, c, t, g, unknown or other
  modified_base (449)..(449): a, c, t, g, unknown or other
  modified_base (502)..(502): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttcctttttgctattgtagaaggtgtccactgtgaggtgcagctgggtggaggtcggggggaggcctgggtcaaggccgtggggggtccctggagactctcctgtgcagcctctggattcgacttcagtatttanagtgtgaatcgggtccgccaggctccgagggaaggggctggagtgggtctcatccatagcagtagccagtcggtcacatatattcgcaagctgagtggaagggcccgattacaacatctaccgagagacaacgaccaagactcactgtatctaacaaatgaacngtctagacgacgccgagacacggtcttagtttactactggtaacacggacagngaactagagttctttgattggtacgtacgggg

SEQ ID NO: 420853 - DNA, 626 bp, Homo sapiens
  misc_feature: GZ8MTXP02JJ1O3.45.84.H07.1.454.CMB.2.raw
  modified_base (284)..(284): a, c, t, g, unknown or other
  modified_base (301)..(301): a, c, t, g, unknown or other
  modified_base (347)..(347): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctgggtggaggtcggggggagcctggtcaaggccgtggggggtccctggagactctcctgtgcacgcctctggattcgacttcagttatttangtgtagaagtgggtccncgaggctcgagggaggggctggagtgggtctcatcctatgcaggtnacgtgtggtacacgtattaatacttcgcaagacttacgaggtggaaacgggtccctacttacgaactatcctaccaagacgaccaaacggaccaaagtaacctcaacgttagtaactacctaaagaaattgaaaccgtagttcaggaaggacgaccgggaaagaccgacgggttactttacgtttaaccaaccggttagtaaacccggagaaccgttaaggaacgtaacgttaaagttaacggtttcgtttagaacgttgggttacggtaaaccggggg

SEQ ID NO: 420854 - DNA, 624 bp, Homo sapiens
  misc_feature: GZ8MTXP02H6NAY.45.84.H07.1.454.CMB.2.raw
  modified_base (282)..(282): a, c, t, g, unknown or other
  modified_base (313)..(313): a, c, t, g, unknown or other
  modified_base (443)..(443): a, c, t, g, unknown or other
  modified_base (495)..(495): a, c, t, g, unknown or other
  modified_base (508)..(508): a, c, t, g, unknown or other
  modified_base (601)..(601): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggtttttcctttttgcttattgtagaaggtgtccactgtgaggtgcagctgggtggaggtcgggggaggtctggtcaagccgtgggggtccctgagactctcgtgtgcagcctctggacttcgaccttnagttatttagtagtgtagaaagtcgggtccnccgaggctaccggaggggaaggggctgggaggttggctctatcctaagttacggctaaggtagctaggttcggacactataatattacgcaagactcgaaagtaggaaacgggccctacttaccgaaacncttacacccgaaagaacgaaccgaaaaccgccaaaagtacctacaaacgttntaactactaaaanaaaacgtagaaaacctaggtacctaggaaggaaccgcccgggaaagaccgtaccgtatttaccgttataaccgttagaacgaagaccgagtanaccttaaagtaacgttcttttag

SEQ ID NO: 420855 - DNA, 764 bp, Homo sapiens
  misc_feature: GZ8MTXP02GJ99Y.45.84.H07.1.454.CMB.2.raw
  modified_base (242)..(242): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactgggctccgcttgggttttccttttgctattgtagaaggtgtccactgtgaggtgcagcgtgggtgggaggtcggggggaggccgtggtcaaggccggtgggggtcccngagctctcctgtgcacgcctcgtggattcgacttcagttatttatagtgtagtaaagtcgggtccgccgaggccgtaccggaaggggaaggggcgtagggaggtcgggtctcaacttcctaagtttagacgtaagtacgaccgtaggtcggtacaacgtaattaacttacgttaccgacgtaagtaccttacgaaggttaggaaacgggtcccgtactaaccgaactactcctaccaagaacgaaccgaaaccgacccgaaaacgtaaacctaccgtaaacgttacgttaaacttaaccgtaaactaaaactaacgggtaaaaccctaaacggtttaccgaacgggttaacggaaaccgggaacccgggttaaacgggaacccgtacggttaccgtttaaccggtttttaaccgttaaacgttacgggttaaacgtaaaccggaaccgtaaggtaaacgtaaccgttaaacggttaagtttaccggtttaagtacggttaggtttacgggtaaacccggggg

SEQ ID NO: 420856 - DNA, 607 bp, Homo sapiens
  misc_feature: GZ8MTXP02F3XVD.45.84.H07.1.454.CMB.2.raw
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggagtcgggggagcctggtcaagccgtgggggtccctgagactctcctgtgcagcctcgtggattcgacttcagttatttatagtgtagaaagtgggtaccgccaggctccgaggggaaggggctggaggtgggtctcgataccgtattagctagtagaccgtagtgtacactattaataattacgcaagactacgagtggaaacgggtccgtcttacaaacgatcctaccaagtaacgaccaaaccgccaaaagaacctacaaactgtaataccctaaagaaatacgaaacagtcgtagacgaagccggaaggtacacggtactttacggtttaactaccgtagttaacggacgtaaacgagaagtaacgtaaagttaacgtcgttttagacttagggtggtaacggggg

SEQ ID NO: 420857 - DNA, 676 bp, Homo sapiens
  misc_feature: GZ8MTXP02HW2KG.45.84.H07.1.454.CMB.2.raw
  modified_base (231)..(231): a, c, t, g, unknown or other
  modified_base (392)..(392): a, c, t, g, unknown or other
  modified_base (422)..(422): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggtttttcctttttgcttattgtagaaggtgtccactgtgaggtgcagctgggtgggaggtcggggggagccgtggtnaagccgtgggggtcctgagactctccgtgtcgcacgtcctcgtggtacttcgtaccttctagttaatttagtagtgtagtaagtcgggtccgcgacggccgtacggaaggggaagggtcgtagggaggttgggtctacactcctaattacgctaagtacgnaggtgtacacgtattaataacgttaccganagtactacgagtggaaccgggcctacttacgaaactcttacctacgaaagaccgaaccaaccgtaaccgtaaaacgtaaacctccgtaaccgtttagtaactttaacccaaaacgaaagttacgaaaccgtaagttacctaaggaaacggaacggtacccggaaggttaaacccgcgtttaacgtttacgtttaaccgcttaacggaaacgaagtaacgaaggtactaccgtaacggtttaagtttcgtttagg

SEQ ID NO: 420858 - DNA, 676 bp, Homo sapiens
  misc_feature: GZ8MTXP02GRS80.45.84.H07.1.454.CMB.2.raw
  modified_base (483)..(483): a, c, t, g, unknown or other
  modified_base (487)..(487): a, c, t, g, unknown or other
  modified_base (512)..(512): a, c, t, g, unknown or other
  modified_base (536)..(536): a, c, t, g, unknown or other
  modified_base (540)..(540): a, c, t, g, unknown or other
  modified_base (557)..(557): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcacgtggggctccgcttgggtttttccttttgctattgtaggaaggtgtccatgtgaggtgcagcgtggtgggagggtcggggggaggccgtagggtcgaacggtccgggttcgggggggtaccctggacgaccttccttccgtggtcgaccgtcgtcccgttcgtcggtaactttccgtaccttacgttagtttaattttagtaggttagtaaggtaaaggtccgggtaccccgacgacgggaccgtacgggaaggggggaacgggtcggtggggaggggtttcggtactaccgtacgttacctaaaggtcgtagaaggttacgaccgtaggtcgtacatatagttatcganagangtagagacggccttacgactaaacnctacacgaagacaacaacaacaanactntactataactaacaaanaatacgaaactagtagaggaacgacgacggacgacgtacgttacttacgtactacaggtaacgacgtaacgataacggtaacttaaaggtacgtttacgttagcggtcggtacggacgg

SEQ ID NO: 420859 - DNA, 740 bp, Homo sapiens
  misc_feature: GZ8MTXP02FX4IW.45.84.H07.1.454.CMB.2.raw
  modified_base (274)..(274): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcacgtggggctccgcttgggttttccttttgctattgtagaggtgtccactgtgaggtgcagcgtggtgggagggtcgggggaggccgtggtcaaggccggtgggggtccctgagctctccgtgtgcgactccttcgngtactacgttacttacgtagttaatttagtaggtagtaagtaggtccggtaccgcgtacgccgtacgggaggggtagggcgtgggtaggtcgtctacgtactactagttacgacgtagtagtctaggtacgtacgtactataaagttacgtaccgactaacgtcgtacgtagtacgggaccggtacccctattaaacccgatacgtaaccgaacgaacggaacgaaaccgaaacccgaaaccgaaacgttaaacctacccttagttacgtaacttaaactaaaaccgtaaagtaaaccgtacgtaacgttccaaggggaacgaccggtaaaccggaacggaccggtaacggtttaaccctttaacgtttaacccgggttaacttaacccgggtaaacgaaacgggtaaaaccgtagggttaaaaccgtagtttaaaccggtttaaaagttttcggttttaaaaggg

SEQ ID NO: 420860 - DNA, 707 bp, Homo sapiens
  misc_feature: GZ8MTXP02HYZ0J.45.84.H07.1.454.CMB.2.raw
  modified_base (337)..(337): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttcctttttgctattgtagaaggtgtccactgtgaggtgcagctggtggaggtcggggggagcctggtcaagccgtgggggtcctgagactctcctgtgcagcctctggattcgacttcagttattatagtgtgaaagtgggtccgccgaggcctccgaggggaaggggcgtgggagtggggtctcnctccattagcagtacgcgagtggtacacattaattattacgcagacctacgaggtcggaaagggtcccgtacttacaactacttccacccgagaaacgaaccaaaccgacccgaaaacggaaaccttaccaaccttcgttaaacttaccttaaaccaaaagttacggaaaactacggtacctaggtaacggaacggacccgggaagggtaaccgtaaaacccggggttctttacggtttttaaaccgtaacggtttacggttaaaccggacgtaaccggaacgaaagttaacccgttaaacggtttaaaaggggtttccgttttttaacggaaggttttaccgggttaagggggtttaaacccggggggg

SEQ ID NO: 420861 - DNA, 774 bp, Homo sapiens
  misc_feature: GZ8MTXP02JXZNI.45.84.H07.1.454.CMB.2.raw
  modified_base (297)..(297): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttcctttttgctattgtagaaggtgtccactgtgaggtgcagcgtggtgggaggtcggggggaggccgtgggtcaaggccgtggggggtccctggacgactctccgtgtgctacgcctcgtggattcgacttcagttattatagtntgaaagtgggtccgcaggctaccggaggggaacgggcgtggaggtgggtactcgaacttccaagttgactaggtagcccgaggttggtacaactataagttactttacggaccgtaagtaccgtacgtaggggttacggaaaacggggtccccggtacctttaacccgaaactaccgtttaccaccgaaacggggaaacaaacccgaaaccgggtaaaccccaaacggtttaaccctacggaaaccttacggtttaaactaccccgtttaaaaacgtaaaacgttacggtaaaacccgtacgttaaccggtaagggtaaccgggaaaccggtaaccggggaaacggtaaccggtaaccggtttacgtttaacggtttacccgtaacggtaacggtaacggtaaacgacgaaacgtacgttaacgttaacggttaacggtttacgtttaggtacggtttacgggtacggggtacgggg

SEQ ID NO: 420862 - DNA, 870 bp, Homo sapiens
  misc_feature: GZ8MTXP02IJZF0.45.84.H07.1.454.CMB.2.raw
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttggttttccttttgctattgtagaaggtgtccactgtgaggtgcagctgggtggaggtcggggggagccgtggtcaaggtccgtgggggtccctgacgaccttctccgtgtcgcgacgtcctgtcggattcgacttctaggttatttaagtgttgtagaaagttcgggtccgccgaggtcccgtaccggaggggtaacggggtctggggtaggtcgggtcctactacgttacccgtagttaacccggacgtacgttacggacgtaacgggtttccggtaccgtaaccttaacttaaagtttaaaccgttaccggaccttaacgggtaaaccgttacccgggtaaaagggttccggggaaaaacccgggggttccccgttaacctttaaacccgggaaaaacccttaaaccggttccccctttaaaccccggaaaagggaaaccgttaaaaccccgtaaaaccccggtaaaccctaaaacccggaaaaccgtttccccctaaaggttaaacgtttaacccgtttaaaccgtaaaaccctaaaagttaaccgaaaacgtacggttacttaaacggtaaccggaacggtaaaaccccgggtaaaggacccgttaaaccgggtaccttttaaaccggttttaaaccggaacttaacccgggtaaggaaaccttaaaccggaagggtaaccttacgtaaaacgtttaggtttaccgttttaagg

SEQ ID NO: 420863 - DNA, 775 bp, Homo sapiens
  misc_feature: GZ8MTXP02HW2IP.45.84.H07.1.454.CMB.2.raw
  modified_base (273)..(273): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcactggggctccgcttgggtttttccttttgctattgtagaaggtgtccactgtgaggtgcagcttgggtgggaggtcggggggaggccgtggtcaaggcccggtggggggtccctgacgctctcctgtgcagcctnggattcgacttcagttatttatagtgtagaaagtcgggtccgccgaggcctaccggaaggggaacggggtctaggggagttcggggtcctcgtaagtcctaattaccggactaggttacgcgtaggttcggtacacgtattaagttaacgttaccgctaacggtaccttcgaacggttagggaaacgggggtcccttaccgttaaccaaacccgtaacttaccctacccgaaaggaaccgaaacccaaacccgtacccgaaaagtaaacccttacgtaacctttggtaaacttaccgttaaaacaaaacgtcgtaaaaccgtaggtttaccgaaggtaacgggaaccggtcccggggaaaacggtaccggtaaacccggggtacctttttaaccggttttaaaccgtaaccggtttacggtaaaacccggtaaaggtaacccggtaaaacggacggtttaccgttaaaaacggtttaacgggtttaacccgtttttaagggg

SEQ ID NO: 420864 - DNA, 715 bp, Homo sapiens
  misc_feature: GZ8MTXP02IF015.45.84.H07.1.454.CMB.2.raw
  modified_base (450)..(450): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctatgtagaggtgtccatgtgaggtgcagcgtgggtggaggtcggggggagccgtggtcaacggccggtgggggtccctgacgctctcctgtgcagcctacgtggtattcgtacttactattattatagtgtagaagtcgggccgtccgaggccgtaccggaaggggagggtcgtagggaggtcggtctacgctacctagttacgcgagtacgccgtagtcgtacaacgtattacttacttacgctacgaccgttagaggtacgggacggggtccctacgttacaaccgtntccgtacaaggaaacacccgtaaacgacccgaaaacgtaccgtacctaacgttacgtaaaccttaccctaaactaaaggtacgtaaaacgtacgttaccgtagggtaaccgaacggggtacccgaagggtaccgtaacggttccgttttaacgttacgttaaaccgttacggttaacggaccgaaacgtaaggacgttaaacgttaaacggtttaggttttaccggtttaaggtccggtttagggggttacgggtaaaccggggg

SEQ ID NO: 420865 - DNA, 728 bp, Homo sapiens
  misc_feature: GZ8MTXP02F0AJS.45.84.H07.1.454.CMB.2.raw
tcagacgcgatcgacacgaccggtgctcgatttagcagacgtctgtcgcggggagctctgagagaggagccttagccctggattccaaggcctatccacttggtgatcagcactgagcaccgaggattcaccatggcacgtggggctccgcgttgggtttttcctttttgcttattgtagaaggtgtccactgtgaggtgcagcgtgggtgggagggtcggggggaggccgtggtacgaacggcccggtcggggggtcccctggacgacctccgtccgtgtcgcgcgtcctggtagtctaccgtctatagttattagtgtgtaagtaggtccggtccgacggacgtccgaccgggaagggggtacggtcggtagggtaggtcggtctacgtcctacgtagtaccgacgtagacgtagtgtacgtacactaattaattaacgtacgacgtaacgtactacggtaggtaagggacccggtccttactaaacgaacttcgtacccgtaacgaaagaccaaaacccgaacgaaaacccggtaaactaaccctacgtaacgttagtaacccttaaacaaaacgtacgaacgtaaacgttacgtgaaacggacgacccggaacggaaaccggtacccggtaacgttaccgttttaacgttaacccttagggtaccgaaacggaacgtacgaaaggtacgttaacgttaaaggggtttcctttaggtttaacggg

SEQ ID NO: 420866 - DNA, 671 bp, Homo sapiens
  misc_feature: GZ8MTXP02F0KLZ.45.84.H07.1.454.CMB.2.raw
  modified_base (483)..(483): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgctgggttttccttttgctattgtagaaggtgtccactgtgaggtgcagctggtggaggtcggggggaggcctggtcaagccgtgggggtccctgagactctcctgtgcagcctctggtattcgtacttctagttatttatagtgtagaagtcggtccgcaggctcgaggggaggggcgtggaggtgggtctcgatcctattagcgagtagcctaggtgtacactataattagtacgcagactcgagtaggaacgggcctattcaaactcgtacctacgaagaacgaaccctaacgacccaaagaacctactacgtagtaactaccctaaataaacgttanaaaacgtgttacctaagggaacgaaccgggcccggaaaagggacccctacggggttaccttttaacggtttaaccgtaaaccggttacgggttaaacggaaccgaaacgtaaggaaacggtaacctttaaaaggttaaaggtttccgtttttaggaaacgtttcggggttaacggggtaacccggggg

SEQ ID NO: 420867 - DNA, 646 bp, Homo sapiens
  misc_feature: GZ8MTXP02FJ1ZG.45.84.H07.1.454.CMB.2.raw
  modified_base (548)..(548): a, c, t, g, unknown or other
  modified_base (566)..(566): a, c, t, g, unknown or other
  modified_base (618)..(618): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcacgtggggctccgcttgggttttccttttgctattgtagaaggtgtccactgtgaggtgcagcgtggtggagggtcggggggaggccgtggtcaacggccggtcgggggtccctgacgactctccgtgtgcgctctgtgtcgtctctacgtattattagtgtgtaagtaggtcggtccgacgcgtccgacggaggggtacggtcggtagggtaggtcggttactactacgtaccgttaagtaccgtacgtagacgtacggttacgggtacgtaacctagtaattaaacgttacgtaccgacgtaacgtacgtacgtaagggtacgggacccggtcccttactaaacgaaccttcgacccagaaggaaccaaacccgacaaaccgttaacacccttatacgtatttaaccanaaaacgtaagtcgaactntcgaggaccacgggacgtacgcgtacgtctttactaacgcgtacgacgaagngtaacgagtataaacggtcgtttatagg

SEQ ID NO: 420868 - DNA, 704 bp, Homo sapiens
  misc_feature: GZ8MTXP02JLBCS.45.84.H07.1.454.CMB.2.raw
  modified_base (577)..(577): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttccttttgctattgtagaaggtgtccactgtgaggtgcagctgggtggaggtcggggggaggccgtgggtacaaggccggtcgggggggtccctggacgacctctcctgtgcagcctctggacttcgacttcgagttatttagtagttagtacgtaaaagtcgggtccgccgaggcctaccggaagggggaacggggctagggtacggtcgggtctcgtactcctagttacgcgtaagtacgaccccgtaggtccggtactaacgttatagttaacgttaccgactaacggtaaccttacgaagggtacggaaacggggtcccttacttaaccgaactactccgttaccgaagacgaaccaacgaccaaagaacctacgaacgttactaactacaaactaaagtacgaaacgtagtccgtaaggngaacgaccggaaggtacccacgggttactttacgttaccgaaacgttacggtaaacggaaccgtaagacgaaaggtttaacctaacggttaaaggttcgtttagagtttacgggacgggtaaggggg

SEQ ID NO: 420869 - DNA, 725 bp, Homo sapiens
  misc_feature: GZ8MTXP02F0BOK.45.84.H07.1.454.CMB.2.raw
  modified_base (176)..(176): a, c, t, g, unknown or other
  modified_base (236)..(236): a, c, t, g, unknown or other
  modified_base (269)..(269): a, c, t, g, unknown or other
  modified_base (279)..(279): a, c, t, g, unknown or other
  modified_base (300)..(300): a, c, t, g, unknown or other
  modified_base (307)..(307): a, c, t, g, unknown or other
  modified_base (352)..(352): a, c, t, g, unknown or other
  modified_base (361)..(361): a, c, t, g, unknown or other
tcagacgcgatcgacacgaccggtgctcgatttagcagacgtctgtcgcgggggagagaggagccttagccctggattccaaggcctatccacttggtgatcagcactgagcaccgaggattcaccatggcactggggctccgcttgggttttccttttgcttattgtagaaggtntccactgtgaggtgcagctggtggaggtcgggggagcctggtcaagccgtgggggtcccngagctctctgtgcagcctagtggattcgacttnagttatttanagtgtagaaacgtcgggtccncaggtcncggaaggggaggtctggagtcgggtctacgactccgtagttacgngtaggtacnccgtaggttcgacaatattaaccttagttccggacaggtaccttacgaacgtaggaaaccggggtcctaacttaccaaacctgtacccaccgaagaccggaccaaaccgaaccccaaagttaaacctccggtaaagttacgtaaacttacctaaaacctaaaagggttaccgtaaaacgtacgttacgtaacggaaccggaaccggtaaccgggaaacgggttaacccgtaaccggttaaccgtttaacgtttaaaccgtaaacggtaaccggtaaacgtaacggtaaacggtaacgttaaccgtaaacgttaacggttaacggtttacgtttaaggacggttacggttaacccgggggtacgg

SEQ ID NO: 420870 - DNA, 757 bp, Homo sapiens
  misc_feature: GZ8MTXP02G9T4B.45.84.H07.1.454.CMB.2.raw
  modified_base (662)..(662): a, c, t, g, unknown or other
tcagacgcgatcgacacgaccggtgctcgatttagcagacgtctgtcgcggggagctctgagagaggagccttagccctggattccaaggcctatccacttggtgatcagcactgagcaccgaggattcaccatggcacgtggggctccgcgttgggtttttccttttgcttagttgtaagaaggtgtcctatggtgaggtgcagcgtgggtgggagggtcgggggagccgtggtcgaacgtccgggtgggggtccctggacgacctctccgtgtcgcgcgtcctcgtggtacttcgtaccttagtaattatttagtaggtgtagtaaacggttcgggaccccggtacgcggtccgtaccggggaagggggtacgggggtcgtagggtggggttacggtctaccgtacgtacctaaggtttaccggacgtacggtacgtaccgtaggttacgggttacccaagtttaagtaagtttaaaccggtaaccgtacgtaaacggtaaccttaggtaaacgggtacggggtaaaccggggtacccctacgtttaacaaaccgtacttaccccgacgaaagaacccaaccgaaaccgtaacgaaaccgtaacctaacgtacgtaacttaccaactaaaacgtaaagacgtaaacgtacttcgaaacgngggaacctaacgggggaccctaggtaccgttacttacgggtttaacacggttacgaagaacgacaggtaacctagtttaaacgtagttacttggg

SEQ ID NO: 420871 - DNA, 607 bp, Homo sapiens
  misc_feature: GZ8MTXP01EC240.21.34.D01.1.454.CMB.2.raw
  modified_base (277)..(277): a, c, t, g, unknown or other
  modified_base (317)..(317): a, c, t, g, unknown or other
  modified_base (374)..(374): a, c, t, g, unknown or other
tcagtcgtcgctcgcacgaccggtgctcgatttagatcgtctgtgttgggtttgggggaggcttggtccagcctgggggggtccctgagagtctcctgtgtggcctctggattcaagtttaatacctattggatgagctgggtccgccaggctccagggaaggggctggagtgggtggccaaacataaaaggaagatggaagtgaacaaaaagtatgtggactctgtgaagggccgattcaccatcttcagagacaacgccaaagaactcactttanctgcaaatgaatagcctgagagtcgaaagacacggctgtntattactgtgcgagagatagcgaggaggtgagcacgctcgtcgtatttgtaactacngtgggacgtcgtggggacaaaggggccacggtacaccgtctcctcacgcctaccaccgaacggcccacgtcccggtccttcccccgtcggccaccccgtccctacccgaacgacgccacccgtcgtcgggggcaccgacgccggcccgtcgggccgttcggccgttcggtaccgaacggttaccgttaccgttacccggaacgccgaaccgacgtcggacggcgggcgtcggg

SEQ ID NO: 420872 - DNA, 584 bp, Homo sapiens
  misc_feature: GZ8MTXP01EO4B5.21.34.D01.1.454.CMB.2.raw
  modified_base (275)..(275): a, c, t, g, unknown or other
  modified_base (372)..(372): a, c, t, g, unknown or other
tcagtcgtcgctcgcacgaccggtgctcgatttagatcgtctgtgttgggtttgggggaggcttggtccagcctggggggtccctgagagtctcctgtgtggcctctggattcaagtttaatacctattggatgagctgggtccgccaggctccagggaaggggctggagtgggtggccaaacataaaaggaagatggaagtgacaaaaaagtatgtggactctgtgaagggccgattcaccatcttcagagacaacgccaagaactcactttanctgcaaatgaatagcctgagagtcgaaagacacggctgtgtattactgtgcgagagatagcgaggaggtggagcagctcgtcgtatttgaaactacngtgggactcgtggggacaaaggggccacggtcaccgtctcctcacgcctaccaccgaacggcccacgtccgtccttccccgtcggccgtacccctcctaccaacgacgccacctcgtcgggggcaccgacgccggcccgtgggcttcggccgttcggtacaacggacttccgttcccgaagccgaacgacgtggacggtcgggcgtaacggg

SEQ ID NO: 420873 - DNA, 634 bp, Homo sapiens
  misc_feature: GZ8MTXP01A1CDP.21.34.D01.1.454.CMB.2.raw
  modified_base (181)..(181): a, c, t, g, unknown or other
tcagtcgtcgctcgcacgaccggtgctcgatttagatcgtctgtgttgggtttgggggaggcttggtccagcctggggggtccctgagagtctcctgtgtggcctctggattcaagtttaatacctattggatgagctgggtccgccaggctccagggaagggctggagtgggtggccaanaataaaggaagatggaagtgaacaaaaagtatgtggactctgtgaagggccgattcaccatcttcagagacaacgccaagaactctactttatctagacaaatgaatagctgagagtcgaaagacacggctgtgttattactgtagcgagagataggacgaggaggtgagcagctagtcgtatttgaactacaagtcggacgtcgtaggggacaaacggggaccctacgggtccaacccgtctacctcaacgccctacccgaccgaaccgggccccaagttcccggtccctttcccccgtcggcccgtaaccccttccctaccaacgaccgcctaaccgtcgtacgggggcaccgacggccggcccgtcgggcttcggtccgttcgggacaacgggttaccttaccgttccccggaagtacccgaacgacgtcggacgggtccgggcgtcggg

SEQ ID NO: 420874 - DNA, 594 bp, Homo sapiens
  misc_feature: GZ8MTXP01E3EYJ.21.34.D01.1.454.CMB.2.raw
  modified_base (275)..(275): a, c, t, g, unknown or other
tcagtcgtcgctcgcacgaccggtgctcgatttagatcgtctgtgttgggtttgggggaggcttggtccagcctggggggtccctgagagtctcctgtgtggcctctggattcaagtttaatacctattggatgagctgggtccgccaggctccagggaaggggctggagtgggtggccaaacataaaaggaagatggaagtgaacaaaaagtatgtggactctgtgaagggccattcaccatcttcagagacaacgccaaagaactcactttanctgcaaaatgaatagcctgagagtcgaaagacacggctgtgtattactgtgcgagagatagcgaggaggtggagcagctcgtcgatttcgaaactacaagtgggacgtcgtgggggacaaaaggggccacgggtcaccgtctccgtcacgccctaccaccgaaacgggcccaacgtccggtccttcccccgtggcccgacccctcctacccaagacgcacccgtcgtcgggggcacgacgccggcccgtcgggcttcgccttgggtcaacgggaccttaccttcccgaagccgaacgccgtggacggtcgggcgtcggg

SEQ ID NO: 420875 - DNA, 599 bp, Homo sapiens
  misc_feature: GZ8MTXP01C0R1U.21.34.D01.1.454.CMB.2.raw
  modified_base (271)..(271): a, c, t, g, unknown or other
  modified_base (369)..(369): a, c, t, g, unknown or other
tcagtcgtcgctcgcacgaccggtgctcgatttagatcgtctgtgttgggtttggggaggcttggtccagcctggggggtccctgagagtctcctgtgtggcctctggattcaagtttaatacctattggatgagctgggtccgccaggctccagggaaggggctggagtgggtggccaacataaaggaagatggaagtgacaaaaagtatgtggactctgtgaagggccgattcaccatcttcagagacaacgccaagaactcactttanctgcaaatgaatagcctgagagtcgaaagacacggctgtgtattactgtgcgagagatagcgaggaggtggagcacgctcgtcgtatttgaaactacngtgggacgtcgtgggggacaaaggggccacggtcaccgtctcctcacgccctaccaccgaacgggccccacgttccgtcccttcccccgtcggccctaccccgtcctccaacgacgccacctcgtcggggctacgacggccggccctcgggcttcggtccgttggtaccgaacgggttaccttccgttcccgcgaaccgtaacgtcggacggccgggtcgttcgggaacg

SEQ ID NO: 420876 - DNA, 590 bp, Homo sapiens
  misc_feature: GZ8MTXP01CAB6T.21.34.D01.1.454.CMB.2.raw
  modified_base (371)..(371): a, c, t, g, unknown or other
  modified_base (582)..(582): a, c, t, g, unknown or other
tcagtcgtcgctcgcacgaccggtgctcgatttagatcgtctgtgttgggtttgggggaggcttggtccagcctggggggtccctgagagtctcctgtgtggcctctggattcaagtttaatacctattggatgagctgggtccgccaggctccagggaagggctggagtgggtggccaacataaaggaagatggaagtgacaaaaagtatgtggactctgtgaagggccgattcaccatcttcagagacaacgccaagaactcactttatctgcaaatgaatagcctgagagtcgaaagacacggctgtgtaattactgtgcgagagatagcggaggaggtggagcagctcgtcgtattttgaacttacngtgggaacgtcgtggggacaaaaggggccacggtcaccgtcctcctcacgccctacccaccgaacgggcccacgtccgtccttccccctcggcccacccgtcctacccaacgacgccacctcgtcgggggccacgacgccggcccgtcgggcttcgcccgttgggtacacggaccgttccgttcccgaagccgaacgacgcggagccgggngtaacggg

SEQ ID NO: 420877 - DNA, 605 bp, Homo sapiens
  misc_feature: GZ8MTXP01A8YR2.21.34.D01.1.454.CMB.2.raw
  modified_base (273)..(273): a, c, t, g, unknown or other
  modified_base (374)..(374): a, c, t, g, unknown or other
tcagtcgtcgctcgcacgaccggtgctcgatttagatcgtctgtgttgggtttgggggaggcttggtccagcctggggggtccctgagagtctcctgtgtggcctctggattcaagtttaatacctattggatgagctgggtccgccaggctccagggaagggctggagtgggtggccaaacataaaggaagatggaagtgaacaaaaaagtatgtggactctgtgaagggccattcaccatcttcagagacaacgccaagaactcactttanctgacaaatgaaatagcctgagagtcgaaagacacggctgtgtaattactgtgcgagagataggcgaggaggtggagcagctcgtcgtatttgtaactacngtggacgtcgtggggacaaacggggacacggtacaccgtctcctcacgccctaccgaccgaacgggccccacgtcccgtcccttcccccgtcggccctaccccgtcctaccaacgtacgccaccgtcgtcgggggccacgacgccggcccgtgggccttcggccgttcggtaccgaacggttaccgttaccgttcccggaagtccgaacgcgtggacggcggcgtaacggg

SEQ ID NO: 420878 - DNA, 640 bp, Homo sapiens
  misc_feature: GZ8MTXP01BJW41.21.34.D01.1.454.CMB.2.raw
  modified_base (274)..(274): a, c, t, g, unknown or other
  modified_base (379)..(379): a, c, t, g, unknown or other
tcagtcgtcgctcgcacgaccggtgctcgatttagatcgtctgtgttgggtttgggggaggcttggtccagcctggggggtccctgagagtctcctgtgtggcctctggattcaagtttaatacctattggatgagctgggtccgccaggctccagggaaggggctggagtgggtggccaacataaaaggaagatggaagtgaacaaaaagtatgtggactctgtgaagggccgattcaccatcttcagagacaacgccaagaactcactttanctgacaaatgaatagcctagagagtcgaaagacacggctgtgtattacgtgtgcgagagagtaggcggaggaggtggagcacgcttcgtcgtatttgaacctacngtgggaccgtcgtggggacaaaggggcccacggtccaccgtcctcctcacgccctacccgaccgaacgggccccaacgttccggtcccttcccccgtcggccctacccctccctaccgaacgacgcccacccgtcggtcgggggccaccgacgggcccggcccggtcgggccgttcggcccgttggtaccgaacggttacccgttaccgtttacccggaacggccgtaaccgacgtcgggacggccgggttcgtaacgggg

SEQ ID NO: 420879 - DNA, 618 bp, Homo sapiens
  misc_feature: GZ8MTXP01D52ZN.21.34.D01.1.454.CMB.2.raw
  modified_base (248)..(248): a, c, t, g, unknown or other
  modified_base (269)..(269): a, c, t, g, unknown or other
  modified_base (282)..(282): a, c, t, g, unknown or other
  modified_base (368)..(368): a, c, t, g, unknown or other
tcagtcgtcgctcgcacgaccggtgctcgatttagatcgtctgtgttgggtttgggggaggcttggtccagcctggggggtccctgagagtctcctgtgtggcctctggattcaagttttaatacctattggatgagctgggtccgccaggctccagggaagggctggagtgggtgccaacataaaggaagatggaagtgaacaaaaagtatgtggactctgtgaagggccattcaccatcttcaganacaacgcaagactcactttanctgacaaatgaanagctgagagtacgaaagacacggctgtgtattactgtagcgagagataggcgaggaggtgagcagctcgtcgtattgtaaactacngtgggtaacgtcgtaggggacaaaacggggccacgtcacccgtctcctcacgccctacccaccgaacgggaccccacgtcccggttcccttcccccgtcggcccgtacccctccgtacccaaacggaccgccctaccgtcggtcggggcctacgacggcccgggcccgtcgggcgttcggcccgttggtaccgaacggttaccttaccgttcccgaacgtcgaacgtacgtcggacggccgggcgtcggg

SEQ ID NO: 420880 - DNA, 581 bp, Homo sapiens
  misc_feature: GZ8MTXP01E3UQJ.21.34.D01.1.454.CMB.2.raw
  modified_base (211)..(211): a, c, t, g, unknown or other
  modified_base (271)..(271): a, c, t, g, unknown or other
  modified_base (283)..(283): a, c, t, g, unknown or other
  modified_base (365)..(365): a, c, t, g, unknown or other
tcagtcgtcgctcgcacgaccggtgctcgatttagatcgtctgtgttgggtttggggaggcttggtccagcctggggggtccctgagagtctcctgtgtggcctctggattcaagtttaatacctattggatgagctgggtccgccaggctccagggaaggggctggagtgggtggccaacataaaggaagatggaagtgacaaaaaagtntgtggactctgtgaagggccgattcaccatcttcagagacaacgcaagaactcactttanctgcaaatgaanagcctgagagtcgaaagacacggctgtgtattactgtgcgagagatagcgaggaggtggagcagctgtcgatttgaactacntgggactcgtgggggcaaaaggggccaacggtcaccgtctcctcacgccctccaccaacgggcccagtccgtccttccccgtcggccgtacccctcctaccaacgacgccgaccctcgtcgggggcacgacgccggcccgcgggcttcgccgttcgggtacgaacggaccttccgttacccgcggccgaaccgtcgcggacgtcgggcgtaacggg

SEQ ID NO: 420881 - DNA, 651 bp, Homo sapiens
  misc_feature: GZ8MTXP02JWRWA.21.34.D01.1.454.CMB.2.raw
  modified_base (373)..(373): a, c, t, g, unknown or other
tcagtcgtcgctcgcacgaccggtgctcgatttagatcgtctgtgttgggtttgggggaggcttggtccagcctgggggggtccctgagagtctcctgtgtggcctctggattcaagtttaatacctattggatgagctgggtccgccaggctccagggaagggctggagtgggtggccaacataaaggaagatggaagtgaacaaaaagtatgtggactctgtgaagggccgattcaccatcttcagagacaacgccaaagaactcactttatctgacaaatgaatagcctgagagtcgaagcacggctgtgtattactgtgacgagagataggcgaggaggtggagcacgctcgtcgtatttgtaactacngtggacgttcgtgggggacaaaacggggacctacgggtccacccgtctacccgtcacgtccctaccaacccgaaacggggcccctacgtccggtacccttcccccgcggacccacccccgttccaccgaacgacgcctaacccgtcgggtcgggggaccaaccgtcgggcccggcccggttcgggcccttcgcccggttcgggaactaacgggtaaccttaccccgttcccggaacggtcccgaaaacggtccgtaacggcggccggggacgtcgggg

SEQ ID NO: 420882 - DNA, 591 bp, Homo sapiens
  misc_feature: GZ8MTXP02GD86O.21.34.D01.1.454.CMB.2.raw
  modified_base (213)..(213): a, c, t, g, unknown or other
  modified_base (272)..(272): a, c, t, g, unknown or other
  modified_base (365)..(365): a, c, t, g, unknown or other
tcagtcgtcgctcgcacgaccggtgctcgatttagatcgtctgtgttgggtttgggggaggcttggtccagcctggggggtccctgagagtctcctgtgtggcctctggattcaagtttaatacctattggatgagctgggtccgccaggctccagggaaggggctggagtgggtggccaacataaaaggaagatggaagtgaacaaaaagtntgtggactctgtgaagggccattcaccatcttcagagacaacgccaagactcactttanctgcaaatgaatgcctgagagtcgaagacacggctgtgtattactgtgcgagagataggcgaggaggtggagcagctcgtcgtatttgactangtggactcgtggggacaaaggggccacggtccaccgtctcctcacgccctaccaccgaacggccccagtccgtcccttccccgtcggccctacccctccctaccaacgacgccgaccgtcgtcgggggacacgacggccgcccgtcgggccgtcgtccgtcggtacgaacgtaccgttacccttaccggaacgccgtacgaccgtaggacggccgggcgtaccggg

SEQ ID NO: 420883 - DNA, 590 bp, Homo sapiens
  misc_feature: GZ8MTXP02JUEGQ.21.34.D01.1.454.CMB.2.raw
  modified_base (424)..(424): a, c, t, g, unknown or other
  modified_base (486)..(486): a, c, t, g, unknown or other
tcagtcgtcgctcgcacgaccggtgctcgatttagatcgtctgtgttgggtttgggggaggcttggtccagcctggggggtccctgagagtctcctgtgtggcctctggattcaagtttaatacctattggatgagctgggtccgccaggctccagggaaggggctggagtgggtggccaaacataaaaggaagatggaagtgaacaaaaaagtatgtggactctgtgaagggccattcaccatcttcagagacaacgccaaagaactcactttatctgcaaatgaaatagcctgagagtcgaaagacacggactgtgtaatttactgtgcgagagatagcggaggaggtgggagcgagctcgtcgtatttgtactacagtggacgtgtgggggacaaacggggcccaggtccaccgtcctccncagccctaccaccaacgggcccagtccggtccttcccccgcgtccaccctccctccagaccncacctcgtcggggcacgacgcggcccgtcgggcctcgcccgtcggtacgaacggacctaccgttacccggaacgccggaacgtactcgacggcgggcgtacggg

SEQ ID NO: 420884 - DNA, 502 bp, Homo sapiens
  misc_feature: GZ8MTXP01D1LFW.41.67.G01.1.454.CMB.2.raw
  modified_base (264)..(264): a, c, t, g, unknown or other
  modified_base (477)..(477): a, c, t, g, unknown or other
  modified_base (499)..(499): a, c, t, g, unknown or other
tcagtctatactatcacgaccggtgctcgatttagagtatacatattgggtttgggggagctacaacaggcaggcaggggcagcaagatggtgttgcagacccaggtcttcatttctctgttgctctggatctctggtgcctacggggacatcgtgctgacccagtctccaaagtccctggctgtgtctctggcgagagggccaccatcaactgcaagtccagccagagtatttatacacctccaaacaatcaccactacttancatgtatcaacacagaccaggcagcctcctaagtgctcatttactgggcatccgaccgggaatccggggtccccctgagcgattcaagtgcagcgggtctgggacagattcactctcacatcagcagcctgacaacctgaagatggtggctagttatactgtcagacaatattatagactctcgctaccttcggccaagggacacgactgganaacgttaaacgacttagtcggntcg

SEQ ID NO: 420885 - DNA, 603 bp, Homo sapiens
  misc_feature: GZ8MTXP01EU3OK.41.67.G01.1.454.CMB.2.raw
  modified_base (454)..(454): a, c, t, g, unknown or other
tcagtctatactatcacgaccggtgctcgatttagagtatacatattgggtttgggggggagaggagcccagcactgggattccgaggtgtttccattcggtgatcagcactgaacacagaggactcaccatggagttttggctgagctgggttctccttgttggtacttttaaaaggtgtccagtgtgaggtgcggctgatggagtcgtggaggaggcttagtccagccgtgggggtcccagagactctcctgtgcagcctcgtgggctcaccgtcagcagccaactacatgaggttcgggtcccgccaggcctccggagggggaaggggctgggaggtgggtctcgagtctatttatacgttggtgtatttcactataactacgcagacctccgtaggaacgggtccattccaccatctcgaggacaattaccaaggtaactacggtttacnctacaaatcgaacgactgaagaggacacgacgaccggtccgtacttattacgtgtgcgaagacgaacggttccggacgtcgttacgggttgttagggttttaatttacgttcggttttgaccgtttcggtcgggggccgtaaccggggg

SEQ ID NO: 420886 - DNA, 598 bp, Homo sapiens
  misc_feature: GZ8MTXP01CHH3G.41.67.G01.1.454.CMB.2.raw
  modified_base (237)..(237): a, c, t, g, unknown or other
  modified_base (262)..(262): a, c, t, g, unknown or other
  modified_base (403)..(403): a, c, t, g, unknown or other
tcagtctatactatcacgaccggtgctcgatttagagtatacatattgggtttgggggagctacaacaggcaggcaggggcagcaagatggtgttgcagacccaggtcttcatttctctgttgctctggatctctggtgcctacggggacatcgtgctgacccagtctccaaagtccctggctgtgtctctgggcgagagggccaccatcaactgcaagtccagccagagtatttanacacctacaacatcaccactactancatgtatacaacacagaccaggcacgcctacctaagttcgctctatttacgtgggcacgtccggaacccgggaacgtcccggggtccccctggacgcgtaatcgaagtcgcgaggtcgggtcgtgggacagtattcactcncacatcagcacgtctcgacaacgtgaagtcgtgggtcggtactagtttataactgtcagactaaataattacgtacggtaccttcccgtacgttcccgtaaccgtttccggaaaccggaacgggttaacccgacggttacccgtaaggtaaagtaaaacgtttaaaacgaacgttggtaacgggaacttaaccgg

SEQ ID NO: 420887 - DNA, 535 bp, Homo sapiens
  misc_feature: GZ8MTXP01E0KQR.41.67.G01.1.454.CMB.2.raw
  modified_base (267)..(267): a, c, t, g, unknown or other
  modified_base (385)..(385): a, c, t, g, unknown or other
tcagtctatactatcacgaccggtgctcgatttagagtatacatattgggtttgggggagctacaacaggcaggcaggggcagcaagatggtgttgcagaccccaggtcttcatttctctgttgctctggatctctggtgcctacggggacatcgtgctgacccagtctccaaagtccctggctgtgtctctgggcgagagggccaccatcaactgcaagtccagccagagtattttatacacctccaaacaatcaccactacttancatgtatcaacacagaccaggcagccctctaagttgctcatttactgggcagtccggacccgggaagtcccggggtcccccctggagcgattcaagtggcagcgggtctgggacagtntttcactctcacatcagcagcctgacaaccgtgaaagcgtgggtggtcttagtttatactgtccagactaaattattatacggactccgtcgcctaccgttcggaccgaagggacacgacgtggagtaacttaaacgacttgtcggctcg

SEQ ID NO: 420888 - DNA, 638 bp, Homo sapiens
  misc_feature: GZ8MTXP01EH7WU.41.67.G01.1.454.CMB.2.raw
  modified_base (246)..(246): a, c, t, g, unknown or other
  modified_base (273)..(273): a, c, t, g, unknown or other
  modified_base (280)..(280): a, c, t, g, unknown or other
  modified_base (310)..(310): a, c, t, g, unknown or other
  modified_base (323)..(323): a, c, t, g, unknown or other
tcagtctatactatcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgctcgacccagtctccaaagtccctggctgtgtctcgtgggcgagacgggccaccatcaactgacaacgtccagccagtagttattttanacacctaccaaacatcaccactactancatgtanacaacacagaccaggcacgcctactaagtnactctatttacgnggctacgtccggaaccgggacgtccccggggtcccctaggacgcgtactcgaaaggtcggcgagggtccgggtcgacgggtacctaggtactttacgaccttcaccaacctagtccgaacgcccaacggtccacgaccctaaaccgtagaaagtacgttggggtaggtacgtttaagtttacttaacgtggtactaagaacttaattagtaactacggtccctaacgtcgaccgttaccggttacggaaccgaacggacgacggttacgtaagggaaacgtaacgtttaaacgagttacggtaacgttcgtaacg

SEQ ID NO: 420889 - DNA, 692 bp, Homo sapiens
  misc_feature: GZ8MTXP01BEN2R.41.67.G01.1.454.CMB.2.raw
tcagtctatactatcacgaccggtgctcgatttagagtatacatattgggtttgggggggagaggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagccgtgggggtcccagagactctcctgtgcagcctcgtgggcctcaccgtcagcagcaaactacagtgagttcgggtcccgccgacggcctccggaagggggaacgggggctgggaggtggggtctcgagttccattttactacgttggtagtatttacacaataaccttaacgcgtaacgtaaccgtcccggtaggaaacggggccgtacttaccaccctaactccgtacccgaaggggaccaaacttacccggaaacggaaaccttacggtttaactctttaacaaaagtcgaaaaccaacgtaggacgaacggggccaaaccgcggaaaccgggtcctccgttaaatccgttggcggaacgagaaaccgaacggccggtacccggtgttacggggttggtttaggtttaaatttcgtttcggttttcgacggtttccggtgggggttaacccccgtaagggggg

SEQ ID NO: 420890 - DNA, 605 bp, Homo sapiens
  misc_feature: GZ8MTXP01DKTV2.41.67.G01.1.454.CMB.2.raw
  modified_base (241)..(241): a, c, t, g, unknown or other
  modified_base (263)..(263): a, c, t, g, unknown or other
tcagtctatactatcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgctgacccagtctaccaaagtccctggctgtgtctcgtgggcgagagggccaccatcaactgcaagtccagccagagttatttanacacctcaacatcacatactancatgtatcaacacagaccaggcagcctactaagtcgctactatttacgtggcacgtccggaacccgggtacgtcccgggggtccccctggagcgtattcgaaggtcggcgaggtcgggtcgtagggacagtactttcactctaccaacatcagcacgcctagaccaacgtagaagtagtgggtggtacttaagtttacttacgtcgtacagtaactaattaattacgtacgtaccttcccgtacgaccctacccggttcggaaaccgaaacggggttaccaacggttaccgttaagggaaacgttaaacgtaaacggaacgttggtcggttaaccgtaaccg

SEQ ID NO: 420891 - DNA, 615 bp, Homo sapiens
  misc_feature: GZ8MTXP01C16NC.41.67.G01.1.454.CMB.2.raw
  modified_base (237)..(237): a, c, t, g, unknown or other
  modified_base (262)..(262): a, c, t, g, unknown or other
tcagtctatactatcacgaccggtgctcgatttagagtatacatattgggtttgggggagctacaacaggcaggcaggggcagcaagatggtgttgcagaccccaggtcttcatttctctgttgctctggatctctggtgcctacggggacatcgtgctgacccagtctccaaagtccctggctgtgtctctggcgagagggccaccatcaactgcaagtccagccagagtatttanacacctaccaacatcacactactancatgtatacaacacagaccaggcacgcctacctaagttgctctatttacgtggcacgtccggaacccggacgtcccggggtccccctggacgcgtatcgaagtcgcgaggcgggtcgtgggactagtactttcgacctcgtacacctatacaacgcacgccctaggaccctaaccgtaggaaacgtgtacgggggttcggtacgtttaacgttttaacttaccgttaggtacccagtaacctaaattattaagtacggtaaccttaacccgtcgaccctacgttccggaaaccgtaacggttaccacgttacgtaaggtaacgtaacttaaaaccggagttacgtggctaacg

SEQ ID NO: 420892 - DNA, 684 bp, Homo sapiens
  misc_feature: GZ8MTXP01BSGP6.41.67.G01.1.454.CMB.2.raw
  modified_base (240)..(240): a, c, t, g, unknown or other
  modified_base (268)..(268): a, c, t, g, unknown or other
  modified_base (312)..(312): a, c, t, g, unknown or other
  modified_base (325)..(325): a, c, t, g, unknown or other
  modified_base (431)..(431): a, c, t, g, unknown or other
tcagtctatactatcacgaccggtgctcgatttagagtatacatattgggtttgggggagctacaacaggcaggcaggggcagcaagatggtgttgcagacccaggtcttcatttctctgttgctctggatctctggtgccgtacggggacatcgtgctgaccagtctaccaaagtccctggctgtgtctcgtggcgagagggccacatacaactgacaagtccagccagagttatttanacacctaccaaacaatcaccactactancatgtatacaacacacgaccgaggacacgcctacgtaaggttcnctactatttacgnggcacgtaccggaccgggacgtcccgggtccccctggaacgcgtaacttcgaaagggtcgcgtaagggtccgggtcgtacgggaacgtacggttactttaaccccnccttaccaccgaaccgtacgtaccgaaccggtacgtaccgtaccgtacggaaaccaaagttaggtaaacgtggttacggggtacggttaactttaacgttaacttacgcggttaactaagaacgttaagttaacttacggtaccgttcccgtaacgtccccgttaccgttaacccggttaacggaaccggtaaaggacccgttacggaggtaaaggtaaactaaacggtaacgcgttacggtccgttctaacg

SEQ ID NO: 420893 - DNA, 519 bp, Homo sapiens
  misc_feature: GZ8MTXP02JAY50.41.67.G01.1.454.CMB.2.raw
tcagtctatactatcacgaccggtgctcgatttagagtatacatattgggtttggggagctacaacaggcaggcaggggcagcaagatggtgttgcagacccaggtcttcatttctctgttgctctggatctctggtgcctacggggacatcgtgctgacccagtctccaaagtccctggctgtgtctctgggcgagagggccaccatcaactgcaagtccagccagagtatttatacacctccaacaatcaccactactatcatgtatcaacacagaccagggcagcctcctaagttgctcatttactgggcatcgacccgggaatccggggtcccctgagcgattcagtggcagcgggtctgggacagatttcactctcacatcagcacgcctgcaacctgaagatgtggctagtttattactgtcagtacaatattaagtacggtactcctcgctacccgttcggaccaacgggaccacgacgtggaagtaacgttaaacgactaggtcgactacg

SEQ ID NO: 420894 - DNA, 621 bp, Homo sapiens
  misc_feature: GZ8MTXP02HRWGX.41.67.G01.1.454.CMB.2.raw
  modified_base (265)..(265): a, c, t, g, unknown or other
  modified_base (272)..(272): a, c, t, g, unknown or other
tcagtctatactatcacgaccggtgctcgatttagagtatacatattgggtttggggagctacaacaggcaggcaggggcagcaagatggtgttgcagacccaggtcttcatttctctgttgctctggatctctggtgcctacggggacatcgtgctgacccagtctccaaagtccctggctgtgtctctggcgagaggccaccatcaactgcaagtccagccagagtatttatacactcaacaatcacactactatcatgtaancacacanacaggcacgcctactaagtgctctatttacgtggacacgtaccgaccgggaacgtccggggtcccctagacgcgtattcgaggtcggcgacgtcggtcgtacgggacgacgtacttactactactacaccactacacgacgacgacctacgaccaaccgtaacgaaagtaagtagtaggtacgtaagtttaacttaacgttacgtacgtaacgtaactaaacttaaagttaacgtaaacgtaaccgtaccgtaccgtaccgtacccgtaccggtaaccggaaaccggaaccgaaccgaacgtaacggtaacgtaaacgtaaaacgtaaaacgtacggtacggtacgtcg

SEQ ID NO: 420895 - DNA, 516 bp, Homo sapiens
  misc_feature: GZ8MTXP02JVHRQ.41.67.G01.1.454.CMB.2.raw
tcagtctatactatcacgaccggtgctcgatttagagtatacatattgggtttgggggagctacaacaggcaggcaggggcagcaagatggtgttgcagacccaggtcttcatttctctgttgctctggatctctggtgcctacggggacatcgtgctgacccagtctccaaagtccctggctgtgtctctgggcgagagggccaccatcaactgcaagtccagccagagtatttatacacctccaacaatcaccactacttatcatggtatcaacacagaccagggcagcctcctaagttgctcatttactgggcatcgacccgggaatccggggtcccctgagcgattcagtggcagcgggtctgggacaggatttcactctcaccatcagcagcctgcaacctgaagatgtggctagtttattactgtcagctaatattatagtactcctcgccaccttcggacctaacgggacacgactaaggagaagttaaaacgacgtagtacggctacg

SEQ ID NO: 420896 - DNA, 497 bp, Homo sapiens
  misc_feature: GZ8MTXP02HNXWF.41.67.G01.1.454.CMB.2.raw
  modified_base (478)..(478): a, c, t, g, unknown or other
tcagtctatactatcacgaccggtgctcgatttagagtatacatattgggtttgggggagctacaacaggcaggcaggggcagcaagatggtgttgcagacccaggtcttcatttctctgttgctctggatctctggtgcctacggggacatcgtgctgacccagtctccaaagtccctggctgtgtctctgggcgagagggccaccatcaactgcaagtccagccagagtattttatacacctccaacaatcaccactactatcatggtatcaacacagaccagggcagcctcctaagttgctcatttactggcatcgacccggatccggggtccccctgagcgattcagtggcagcgggtctggggacagatttcactctcacatcagcagcctgcaacctgaagactgtggctagtttattactgtcagctaatattatagactctcgcaccttcggcacgggacacgactgganacttaacgactgacgctcg

SEQ ID NO: 420897 - DNA, 517 bp, Homo sapiens
  misc_feature: GZ8MTXP02JA52I.41.67.G01.1.454.CMB.2.raw
  modified_base (356)..(356): a, c, t, g, unknown or other
tcagtctatactatcacgaccggtgctcgatttagagtatacatattgggtttgggggagctacaacaggcaggcaggggcagcaagatggtgttgcagacccaggtcttcatttctctgttgctctggatctctggtgcctacggggacatcgtgctgacccagtctccaaagtccctggctgtgtctctgggcgagagggccaccatcaactgcaagtccagccagagtattttatacacctccaacaatcaccactactatcatgtatcaacacagaccaggcagcctcctaagtgctcatttactggcatcgacccggatccgggtcccctgagcgattcagtgcagcggtntgggacagatttcactctcacatcagcacgcctgccaacctgaaacgatgtggctagtttacttactgtcagctaatattataggtactcctacgcctaccgttcggacctaacgggaccacgacgtaaggaagaacgttaaaacgacgtgtacgactacg

SEQ ID NO: 420898 - DNA, 499 bp, Homo sapiens
  misc_feature: GZ8MTXP02HFHQ2.41.67.G01.1.454.CMB.2.raw
  modified_base (308)..(308): a, c, t, g, unknown or other
  modified_base (438)..(438): a, c, t, g, unknown or other
tcagtctatactatcacgaccggtgctcgatttagagtatacatattgggtttggggagctacaacaggcaggcaggggcagcaagatggtgttgcagacccaggtcttcatttctctgttgctctggatctctggtgcctacggggacatcgtgctgacccagtctccaaagtccctggctgtgtctctgggcgagagggccaccatcaactgcaagtccagccagagtatttatacacctccaacaatcaccactactatcatgtatcaacacagaccaggcagcctcctaagttgctcatttacnggcatcgaccggaatccggggtcccctgagcgattcagtgcagcggtctgggacagatttcactctcaccatcagcagcctgacacctgaagatgtggctagtttatactgtcagcaatatatagactcncgctaccttcggaccaaggaccacgacgtggaagtaacttaaacgaactggtacggctacg

SEQ ID NO: 420899 - DNA, 515 bp, Homo sapiens
  misc_feature: GZ8MTXP02JQ5AG.41.67.G01.1.454.CMB.2.raw
  modified_base (237)..(237): a, c, t, g, unknown or other
  modified_base (308)..(308): a, c, t, g, unknown or other
  modified_base (450)..(450): a, c, t, g, unknown or other
tcagtctatactatcacgaccggtgctcgatttagagtatacatattgggtttgggggagctacaacaggcaggcaggggcagcaagatggtgttgcagacccaggtcttcatttctctgttgctctggatctctggtgcctacggggacatcgtgctgacccagtctccaaagtccctggctgtgtctctgggcgagagggccaccatcaactgcaagtccagccagagtatttanacacctcaacaatcaccactactatcatgtatcaacacagaccaggcagcctctaagttgctcatttacgnggcatccgaccggatccggggcccctgacgcgattcagtgcagcggtctggggacagtactttcactctcacatcagcacgctgacacctgaagatgtcggctagtttactacgtgtacagactaatattagtagtacctcncgtcctaccgtcggaccaacgggaccacgacgtaaggagtaacgtaaacgaatcgtacggctacg

SEQ ID NO: 420900 - DNA, 601 bp, Homo sapiens
  misc_feature: GZ8MTXP02HUJ71.41.67.G01.1.454.CMB.2.raw
tcagtctatactatcacgaccggtgctcgatttagagtatacatattgggtttgggggagctacaacaggcaggcaggggcagcaagatggtgttgcagacccaggtcttcatttctctgttgctctggatctctggtgcctacggggacatcgtgctgacccagtctccaaagtccctggctgtgtctctgggcgagaggccaccatcaactgcaagtccagccagagtatttatacacctcaacaatcaccactactatcatgtatcaacacagaccaggcagcctctaagttcgctctatttacgtgggctaacgtccggaaccccgggaaagtccccggggtcccctacggacgcgacttcgaggtggcgaggtcggtcgtaggggacagtatttcactctacaccatcagcacgctagaccactagaaagtgtagtcggtactagtttaactacgttgtacctaagactaaattagttaaagtacggtacctacccgtccgtacctacccgttaccggaaccgtaacggggaccaaccggtacgtaaggaaacgtaaacgtttaaaaccggaaccgttaggtacgggtaacctacg

SEQ ID NO: 420901 - DNA, 512 bp, Homo sapiens
  misc_feature: GZ8MTXP02FS0IC.41.67.G01.1.454.CMB.2.raw
  modified_base (238)..(238): a, c, t, g, unknown or other
  modified_base (311)..(311): a, c, t, g, unknown or other
  modified_base (444)..(444): a, c, t, g, unknown or other
  modified_base (505)..(505): a, c, t, g, unknown or other
tcagtctatactatcacgaccggtgctcgatttagagtatacatattgggtttgggggagctacaacaggcaggcaggggcagcaagatggtgttgcagacccaggtcttcatttctctgttgctctggatctctggtgcctacggggacatcgtgctgacccagtctccaaagtccctggctgtgtctctgggcgagagggccaccatcaactgcaagtccagccagagtattttanacacctccaacaatcaccactacttatcatgtatcaacacagaccaggcagcctcctaagttgctcatttacngggcatcgaccggaatccgggtccccctgagcgattcagtgcagcgggtctgggacagtatttcactctcaccatcagcagcctgcaacctgaagatagtggctagtttattactgtcagtactaaatattanaggtacctcgtacgctaccttacggcctaaacgggacacgactggaacaataaacgatcgnggctacg

SEQ ID NO: 420902 - DNA, 547 bp, Homo sapiens
  misc_feature: GZ8MTXP02I81EH.41.67.G01.1.454.CMB.2.raw
  modified_base (237)..(237): a, c, t, g, unknown or other
  modified_base (416)..(416): a, c, t, g, unknown or other
tcagtctatactatcacgaccggtgctcgatttagagtatacatattgggtttgggggagctacaacaggcaggcaggggcagcaagatggtgttgcagacccaggtcttcatttctctgttgctctggatctctggtgcctacggggacatcgtgctgacccagtctccaaagtccctggctgtgtctctgggcgagagggccaccatcaactgcaagtccagccagagtatttanacacctccaacaatcaccactactatcatgtatcaacacagaccaggcagcctcctaagtgctcatttactggcatccgaccggagtccggggtcccctgagcgtattcgagtggcgaggcgggtcgtgggacagtatttcactctccacctatcagcacgcctcgacaacctgaaagntgtgctagtttatactgtacagactaatattacacggtactacctcggacctacccgttacggaccgaacggggaaccacgaacgtaacggtaaacgtaacgttaaaacggacgtacggtcggtacgtacg

SEQ ID NO: 420903 - DNA, 581 bp, Homo sapiens
  misc_feature: GZ8MTXP02IZQBD.41.67.G01.1.454.CMB.2.raw
  modified_base (237)..(237): a, c, t, g, unknown or other
  modified_base (297)..(297): a, c, t, g, unknown or other
  modified_base (307)..(307): a, c, t, g, unknown or other
tcagtctatactatcacgaccggtgctcgatttagagtatacatattgggtttgggggagctacaacaggcaggcaggggcagcaagatggtgttgcagacccaggtcttcatttctctgttgctctggatctctggtgcctacggggacatcgtgctgacccagtctccaaagtccctggctgtgtctctgggcgagagggccaccatcaactgcaagtccagccagagtatttanacacctcaacaatcaccactactatcatggtatcaacacagaccaggcagcctctaagtnctcatttacnggcagtccgaccggatccggggtcccctgacgcgattcgaggtcggcaggcgggtcgtgggacagtactttccactctacaccctatcagtcgacgcctcgaccaaccgtagaaagtacgttggtacggtacttaaggtttattaaccgtgttacagtactaaattattagtaacggtaccttcccgtacgacctaccgttaccgggacgtaaacgggaccaaccgtaacgtaaggaaacgtaaagttaaaaccgaacgtggtacggtactacg

SEQ ID NO: 420904 - DNA, 656 bp, Homo sapiens
  misc_feature: GZ8MTXP02I3Q0R.41.67.G01.1.454.CMB.2.raw
  modified_base (237)..(237): a, c, t, g, unknown or other
tcagtctatactatcacgaccggtgctcgatttagagtatacatattgggtttgggggagctacaacaggcaggcaggggcagcaagatggtgttgcagacccaggtcttcatttctctgttgctctggatctctggtgcctacggggacatcgtgctgacccagtctccaaagtccctggctgtgtctctgggcgagagggccaccatcaactgcaagtccagccagagtatttanacacctccaacatcaccactactatcatgtatcaacacagaccaggcagccctctagtcgcgtctatttacgtgggcctagtccggacccgggtaaagtcccgggtccccgtgacgtcgactcgaggtcggcgaggtccggggtgtcggggaacagtactttacgacttcctcacctacgtcaacgcaccgcctacgacccaacgttacggaaacgtagttacgggtacgggtactttagttttaacgttaactttacggtccgtaaagtaccttaaaaagttacttttaaagtaaccggtaacgtttacccccgtcggtacccctaaccggtttaccggaacccgggtaaacggaaaaccgaccggtaaccgtaaggaaaccggtaagttaaaaccgtacgtcgtaggccgtttacgg

SEQ ID NO: 420905 - DNA, 531 bp, Homo sapiens
  misc_feature: GZ8MTXP01D9RP9.52.37.D04.1.454.CMB.2.raw
  modified_base (303)..(303): a, c, t, g, unknown or other
  modified_base (362)..(362): a, c, t, g, unknown or other
  modified_base (409)..(409): a, c, t, g, unknown or other
  modified_base (442)..(442): a, c, t, g, unknown or other
  modified_base (492)..(492): a, c, t, g, unknown or other
tcagcgcagtacgacacgaccggtgctcgatttagtagcatactgttgggtttgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctcctggtaccaacaataccccggcaaagtccccaaactcatgatctttnaggtcagtgatcggcccgcaggggtttctcatcgcttcctccggctccaagtctgggcngcacggccctccctgaccatctctgggctccaggctgaggcgaggcngattatactgcagctcatatacaaacagaaacncttagggtgttcggcggcgggaaccaaacgtcgaccggtcctacggttcncgcccaaggctcgccccctcggttcaaccttcgttcccg

SEQ ID NO: 420906 - DNA, 529 bp, Homo sapiens
  misc_feature: GZ8MTXP01DU7XD.52.37.D04.1.454.CMB.2.raw
  modified_base (435)..(435): a, c, t, g, unknown or other
tcagcgcagtacgacacgaccggtgctcgatttagtagcatactgttgggtttgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataatctgtctctggtaccaacaataccccggcaaagtccccaaactcatgatctttgaggtcagtgatcggcccgcaggggtttctcatcgcttcctccggctccaagtctggcaagcacggcctccctgaccatctctggctcagctgaggcgaggctgatatactgcagctcatatacaaacagaaacncgttgggtagttcggcgggaacgggaaccaaacgtcgaccggtcctacggttcacgcccaaggtctcgcccctcggttcctaacgttcttcccg

SEQ ID NO: 420907 - DNA, 566 bp, Homo sapiens
  misc_feature: GZ8MTXP01DON3T.52.37.D04.1.454.CMB.2.raw
  modified_base (227)..(227): a, c, t, g, unknown or other
  modified_base (331)..(331): a, c, t, g, unknown or other
  modified_base (399)..(399): a, c, t, g, unknown or other
  modified_base (428)..(428): a, c, t, g, unknown or other
  modified_base (440)..(440): a, c, t, g, unknown or other
tcagcgcagtacgacacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcaaatgacattggtacttataattctgtctcctggtaccaaacaactaccccggacaaacgtccccaaactcatcgaatctttgaggtcagtgatcggcccgnagggtttctcatcgcttccctccggctcccaaagtctagggccaagccaacgggccctccctgaaccntctctggctccgagctgaggacgaggctnatattatgcganctacataacaaacaaacaaacgaaacgtacgtacggtcggtcggcgggaaccggaacgaacgtacgaccgtaccgtacgttacgcgaccgaacgcgtccgtcccgtccgttcctccgttccgtccg

SEQ ID NO: 420908 - DNA, 540 bp, Homo sapiens
  misc_feature: GZ8MTXP01BQG74.52.37.D04.1.454.CMB.2.raw
  modified_base (345)..(345): a, c, t, g, unknown or other
tcagcgcagtacgacacgaccggtgctcgatttagtagcatactgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctcctggtaccaacaataccccggcaaagtccccaaactcatgatctttgaggtcagtgatcggcccgcagggggtttctaatcgctttcnccccggctccaagtctggcagcacggcctccctgaccatctctgggctccaggctgaggacgaggctgattatactgcaggctcatatacaaacagaaacacgttgggtgttcggcgggcgggaaccaaacgttgaacccgttccgtacgtcacgttcccaaggctcgcccctcggtcacctcgttcgttccccc

SEQ ID NO: 420909 - DNA, 556 bp, Homo sapiens
  misc_feature: GZ8MTXP01BSFDW.52.37.D04.1.454.CMB.2.raw
  modified_base (335)..(335): a, c, t, g, unknown or other
  modified_base (365)..(365): a, c, t, g, unknown or other
  modified_base (434)..(434): a, c, t, g, unknown or other
  modified_base (444)..(444): a, c, t, g, unknown or other
tcagcgcagtacgacacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattgtacttataattctgtctctgtacaacaactaccccggacaaacgtcccaaactcatgatctttgagtcagtgagtcggcccgcgtaggggtttcncatcgcttccgtccggctccgagtctggcngcaccgggcctccctcgaccatcctcgtcgggcctccgagcgtgaggacgagctagtattatactgacngctcaattanaacaaacagaaactcgttgggtgttcgggcgggtcgggaacaacgtcgacccgtccgtacgttcgcgacccaacggcctccgccccgtcggttcctaaccgttcgttccccg

SEQ ID NO: 420910 - DNA, 833 bp, Homo sapiens
  misc_feature: GZ8MTXP01DD9GU.52.37.D04.1.454.CMB.2.raw
tcagcgcagtacgacacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctctggacagtcgatcaccatctcctgcactggaaccagcaaatgactattggtaacttataattctgtctctggtaccaacaataccccggacaaacgtccccaaactcatgaatctttgaggtcagtgagtccggccccgtcgtacgggggttttctacgtactccgtcctttccccgtcccgggtaccttcccgtaaacggttcccgttcgggggaccaacgggacccgtaaacccggggtccccttacccccgttacggaacccctaacgttcccgtcccgttcgggggtaaccctttcccggaaacggggtcccgttaaggggaaacgggaaccccgggtaggggtacccgtcgggttaaaattttacgtttaaaccgttcgggacctaaacggttccttaacaaacttaaacttaaaacccgaaaacaaacgtaaaaaccgtaccgtttaggggggttccgttcccgggggacccgggggtaaaccggggaaaccccttaaaaccgggttacggttaaaccccggttacccgtttaaccggttaccgttaaccggttaacccccggaaacgggtccccgttccccgggtaaccccccgttcggggttaacccctcccgggttaaccttttcccccccgg

SEQ ID NO: 420911 - DNA, 527 bp, Homo sapiens
  misc_feature: GZ8MTXP01CM7TI.52.37.D04.1.454.CMB.2.raw
  modified_base (517)..(527): a, c, t, g, unknown or other
tcagcgcagtacgacacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaaatgactagttggggttctcatcgcttctccggctccaagtctggcagcacggccctcctgaccatctctgggctccaggctggaggacgaggctgatttataccctgcagctacaaataataacaaaacaagaaaacctacgttggggtgttcgggcgggacgggaccaaaacgtcgaccgtccgtacgtacacgtcccaaggcctacgccccctcggtccactccttcgtccccaccctctctactacgatcgtctggacgcgggctggcaaggcgcgattagnnnnnnnnnnn

SEQ ID NO: 420912 - DNA, 719 bp, Homo sapiens
  misc_feature: GZ8MTXP01DGZXY.52.37.D04.1.454.CMB.2.raw
  modified_base (326)..(326): a, c, t, g, unknown or other
  modified_base (337)..(337): a, c, t, g, unknown or other
  modified_base (375)..(375): a, c, t, g, unknown or other
tcagcgcagtacgacacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgactattgtaacttataattctgtctctgtaccaacaactaccccggacaaacgtccccaaactcatgatctttgagtcagtgatcggcccgngaggggtttcnctatcgtcttcccgtccggctcgtaagtccgtacggcncgccacccgggtccctccccgtacgacctactcctcgtcgggcccttccgacggtcgttacgggaacgggacggacggtaccgttagtaactttaacgttaacgtcggactaacgtccttaacctaacgttaaactaaaccaaaaccgtaaacgtaaaaaccgttacggtttgggggttacggttaccgggggaccggggtaacccgggtaaacccgttaaaccgtttaccggaaccccgtttacccgtaaccggttacccgaccggaaccccggtaaaccgggtcccgttccccggtccccccgtacgggttcccttaacccgttcccggttttaaccccccg

SEQ ID NO: 420913 - DNA, 536 bp, Homo sapiens
  misc_feature: GZ8MTXP01CGJ4K.52.37.D04.1.454.CMB.2.raw
  modified_base (318)..(318): a, c, t, g, unknown or other
  modified_base (359)..(359): a, c, t, g, unknown or other
  modified_base (495)..(495): a, c, t, g, unknown or other
tcagcgcagtacgacacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaaatgactattgtacttatattctgtctctgtacacaatacccggcaacgtcccaaactcatgatcttgagtcagtgactcggcccgngagggggtttctcatcgcttccctccggctccaagtctgcngcacgggccctccctgaccatctcgtcgggctccgaggcctgaggaccgaggctgattatactgcagctcataactaacaaacagaaactacgttgggtgttcggcggaacggacaaacgtcgacgtcctagttcncgacccaagggcctcgccccgtcggttactcttcgttcccg

SEQ ID NO: 420914 - DNA, 658 bp, Homo sapiens
  misc_feature: GZ8MTXP01EMXDU.52.37.D04.1.454.CMB.2.raw
  modified_base (185)..(185): a, c, t, g, unknown or other
  modified_base (246)..(246): a, c, t, g, unknown or other
  modified_base (251)..(251): a, c, t, g, unknown or other
  modified_base (347)..(347): a, c, t, g, unknown or other
tcagcgcagtacgacacgaccggtgctcgatttagtagcatactgttgggtttgggcacgaccggtgctcgatttagtagcatactgttgggtttgggggcgtggtccagcctggggaggtccctgagactctcctgtgcaggctctgcatttcccttcagtaactatgctatcgattgggtccnccaggctccaggcaagggactggagtgggtggcagttatatcagctgatggagcagtaatntacgnagatctgcgaggcgatcacatatcagagacaactccaagatatgatatatactaacaaatgaacagcctagacgaccctgagacgacgctagtatnttatgtgcgtgaggggcagtgcgtgcacgtgattgtctttgtatttcggtcggggaccgaagggtactaacggtttcgtccgtaccgttcctacccttccgaaccgtcccttaccccgaacccgtaaaccgggggtacccctaacggttccccggttccccgtttccccccgttcggggtacccccttaacccccgttaccccgttaaccccgaaaacggggttcccaccccgtaaccccggttcccgggttcggggggggtacccctaacccggttaaccgggccccggggttccccggttcccgggggg

SEQ ID NO: 420915 - DNA, 518 bp, Homo sapiens
  misc_feature: GZ8MTXP01ASMCX.52.37.D04.1.454.CMB.2.raw
  modified_base (361)..(361): a, c, t, g, unknown or other
  modified_base (455)..(455): a, c, t, g, unknown or other
tcagcgcagtacgacacgaccggtgctcgatttagtagcatactgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaaatgacattggtacttataattctgtctctggtacacaataccccggcaaagtccccaaactcatgatctttgagtcagtgatcggcccgcaggggtttctcatcgcttccctccggctccaagtctgggcngcacggcctcctgacatctctgggctccaggctgaggacgaggctgattattactggcagctcatatacaaacagaaacacttgggtgttcggngcgggaccaaagtgaccggtctacgttcgacgcccaagggctcgccccctggcctcgcttccg

SEQ ID NO: 420916 - DNA, 772 bp, Homo sapiens
  misc_feature: GZ8MTXP01DXD67.52.37.D04.1.454.CMB.2.raw
  modified_base (330)..(330): a, c, t, g, unknown or other
tcagcgcagtacgacacgaccggtgctcgatttagtagcatactgttggggtttgggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccagcaatgactattggtacttataattctgtctctaggtaccaacaactaccccgacaaacgtacccaaactcatgatcttagagtcagtgagtccggcccgngtacgggggtttctctatcgtcctttccgtcccgggtcctaccgtaacggtcgtcgggacctaacggccgtaacccgggtcccccttccccgttaccggaaccctacgttcccgtccgttcgggggtccctaacccggacgggtccgtaggggaacggggaaccgggagggtacctaggttaactttaacgttaacttcgggactaaacggtccttaaacgaaacgttaaactaaaaccgaaaacgaaacgttaaaaccgtaccggttttagggggtaccgggtttacccggggaccgggggtaacccgggtaaacccgaaaccggttaccggttaaccccggttaacccgttaccggttacccgacccggacccgaaaccggggtcccttaaccccggtcccccgggttaccggttacctaacccgttcccgtttcccccg

SEQ ID NO: 420917 - DNA, 659 bp, Homo sapiens
  misc_feature: GZ8MTXP01EL0LO.52.37.D04.1.454.CMB.2.raw
  modified_base (323)..(323): a, c, t, g, unknown or other
  modified_base (336)..(336): a, c, t, g, unknown or other
tcagcgcagtacgacacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgactagttgtacttatatctgtctctgtaccaacaactaccccggacaaacgtcccaaactcatgatcttgagtcagtgactcggcccgngtacggggtttcncgtatcgtccttcccgtcccggtctaccgaagttccgtacgggccaacgcccgacccgggtcccttccccgtacgaccctattcccgtcgtcgggtactccgaggctggacgggacgagtctagtattagttactgctagcttacaataactaaacaaaacgtaacgaaaacgttcggttaggggtcggttaccggggcgggtaaccgggaacccttaaaacggtccggttacccgtacccgttaacggccgaccggaccccggaaggtccccgtcccggtaccccccgtcgggttaccctaaccgttcccgttttcccccgg

SEQ ID NO: 420918 - DNA, 640 bp, Homo sapiens
  misc_feature: GZ8MTXP01DJHPV.52.37.D04.1.454.CMB.2.raw
  modified_base (283)..(283): a, c, t, g, unknown or other
  modified_base (340)..(340): a, c, t, g, unknown or other
  modified_base (375)..(375): a, c, t, g, unknown or other
  modified_base (400)..(400): a, c, t, g, unknown or other
tcagcgcagtacgacacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaaatgactagttggtactttatattctgtctctgtaccaacaactaccccganaaactaccccaaatcatgatcgtttgagtcagtgactccggcccgcgtagggtttcncatccgcttcccgtccggctaccaagtctgggacncgccgaccggcccttccacgacctntcctcgtcggcctccgagccgtgacggacgaggtctagtaacgttaatctgaccgatctacctaataaactaaacgaaacaaagtaaaacccgtgttcggggttacggttcccgggacggggtaacccgggaacccttaaacgtaccggttacccgttacccgtacgttaaccgccggacccgaaacggtccccgtcccggtcccccgttcgggttccctaaccttcccggtttcccccg

SEQ ID NO: 420919 - DNA, 558 bp, Homo sapiens
  misc_feature: GZ8MTXP01BY69W.52.37.D04.1.454.CMB.2.raw
  modified_base (336)..(336): a, c, t, g, unknown or other
  modified_base (429)..(429): a, c, t, g, unknown or other
tcagcgcagtacgacacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaaatgactattggtacttatattctgtctctggtacaacaataccccggcaaagtcccaaactcatgatctttgaggtcagtgatcggcccgcgtagggggtttcnctatcgcttcctccggctccagtctggcaagcacggccctccctgacctatctcgtgggcctccgagctgacggacgagctgattattactgnacgtctacataactaacaaacagaaaactcgttggggtcgttcgggcggcgggaaccaaacgtcgacccgtccgtacgttcgcgcccaaggcctccgccccgtcggttcctaaccgttcgttaaccccg

SEQ ID NO: 420920 - DNA, 691 bp, Homo sapiens
  misc_feature: GZ8MTXP01EEQ9A.52.37.D04.1.454.CMB.2.raw
  modified_base (342)..(342): a, c, t, g, unknown or other
tcagcgcagtacgacacgaccggtgctcgatttagtagcatactgttggggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctccgtggacagtcgatcacatctcctgcactggaaccagcaatgactagttgtacttatatctgtctctagtaaccaacaactaccccggacaaacgtcccaaactcatgatgtttgaggtctagtagactccggcccgtgtagggtttccncgatcgtccttccgtcccggctacccgaagtcgtagggcaacggccacccgggtccctaccctgacccctagttcctcgtcggcctccgaggccgtaggaacggacgagggtacctaggttaactactttaacgcgtacaacgtactaacctaataaactaaacaaacgtaaacgaaaaccgttcgttaacggggtcggttaccggggaccgggaaaccggggtaaacccttaaaacggttccggaaaccccgttaccgttaaccggaccgttaccggaccccgaaacgggtcccttaaccccgggcccccgttaacgggttccccgtaaccgttccctttcccccggg

SEQ ID NO: 420921 - DNA, 577 bp, Homo sapiens
  misc_feature: GZ8MTXP01DPB6A.52.37.D04.1.454.CMB.2.raw
  modified_base (367)..(367): a, c, t, g, unknown or other
tcagcgcagtacgacacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccagcaaatgactattggtacttataattctgtctctggtaccaacaatacccggcaaacgtcccaaactcatgaatctttgaggtcagtgatcggcccgcgaggggtttctcatcgccttccgtccggctccaagtctggcngcacgcctcctgaccatctcgtggctcgaggctggagacgagctgtattattactcgcagctactaataactaaacaaacaacgtaaaacgtcgtttagggtacggttcggggcggtaaccgggaacccgttaaagtccgttaaccgtccgtacgttcgaccgacccgaacggtcctcccgtccccgtcggttacctccttcgtttcccc

SEQ ID NO: 420922 - DNA, 535 bp, Homo sapiens
  misc_feature: GZ8MTXP01ECH5X.52.37.D04.1.454.CMB.2.raw
  modified_base (323)..(323): a, c, t, g, unknown or other
  modified_base (365)..(365): a, c, t, g, unknown or other
  modified_base (382)..(382): a, c, t, g, unknown or other
tcagcgcagtacgacacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgactattggtacttataattctgtctctgtacaacaactacccggcaaacgtcccaaactcatgatctttgaggtcagtgatcggcccgngtagggggtttctcatcgcttcctccggctccagtctaagcngcacgccctcctcgacntctctggctcagctgaggacgagctagattactactgcagctacatactaacaaacaagaaactacgttggtagttcggcggaacgggaccaacgtcgaccgtctacgttcgcgccgaagcctccgccccgtcggttcctcgttccgttcccg

SEQ ID NO: 420923 - DNA, 579 bp, Homo sapiens
  misc_feature: GZ8MTXP01DKN17.52.37.D04.1.454.CMB.2.raw
tcagcgcagtacgacacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaaatgactattggtacttataattctgtctctggtaccaacaactaccccggacaaacgtcccaaactcatgatctttgaggtcagtgatccggcccgtacgagggggtttctcatccgtacttcctccggctccagtctggcaagcacggccctccctgaccatctctcgggctccgagctggaggacgaggctgtattactactagcgagtctacaataactaaacaaaaccaagaaaactccgtttagggtacggttcgggcggaacgggaaaccaaacgtcgaaccgtacctacgttacgacgcccaaggtctccgcccctcggttctaaccgttcgttccccgg

SEQ ID NO: 420924 - DNA, 721 bp, Homo sapiens
  misc_feature: GZ8MTXP01CZCSE.52.37.D04.1.454.CMB.2.raw
tcagcgcagtacgacacgaccggtgctcgatttagtagcatactgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcactggaaccagcaaatgactattggtacttatattctgtctctggtaccaacaactaccccggacaaacgtccccaaatcatgatctttgaggtcagtgagtccggcccgtcgtagggggtttctcgatccggtctttacccgtcccggtctccgtaacgtccgtagggcaacgccgacccgggtcccttcccgacgacccactccgtccgttggggccttccgaaggtcgtaggaacgggtaccggagggtcttaggtaactttattaaccgttcggactacggtaccttacctaaattaaactaaaccaaaacgaacgtaaaaaccgtcggtttaggggtcggtttaccggggacgggaacccggggtaaaccttaaacggtaccggaaccccggtttaacccgtacggttaacccgaccggacccccggtaaaagggtccccgaaccccggttccccccggtcgggttaccccttaaccgttccccgtttcccccggg

SEQ ID NO: 420925 - DNA, 562 bp, Homo sapiens
  misc_feature: GZ8MTXP01BBJ0Q.52.37.D04.1.454.CMB.2.raw
  modified_base (361)..(361): a, c, t, g, unknown or other
  modified_base (542)..(542): a, c, t, g, unknown or other
tcagcgcagtacgacacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgactattgtacttatattctgtctctggtacaacaataccccgcaaacgtcccaaactcatgatcttgaggtcagtgatcggcccgcgtagggggtttctcatcgtcttcctccggctccagtctgcngcacggcctccctgaccatctcgtgggctccgaggcgtgacggacgaggctagattattacgtgacgtagtctactactttaacaacgccaaccaaccctacttcccgtagttaaacctcgttcggggacggacgggacccaggtctcgacccgttcgttacgtcgacgcccgaaggtccncccgtccccgttcggtcccg

SEQ ID NO: 420926 - DNA, 560 bp, Homo sapiens
  misc_feature: GZ8MTXP01BQZNQ.52.37.D04.1.454.CMB.2.raw
  modified_base (364)..(364): a, c, t, g, unknown or other
tcagcgcagtacgacacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaaatgacattggtacttataattctgtctctgtaccaacaactaccccggacaaagtcccaaactcatgatcttgagtcagtgatccggcccgcgtaggggtttctcatcgcttcctccggctccaagtctggcngcaccggcctccctgaccatctctgggctcgagctggacggacgaggctgattacttactcgacgacgtctacaataactaaacaaaacaagaaaactcggttgggtagtccgggcgggaacgggtaacaaacgtcgaccgtccgtacgttcgacgccgaagggcctccgccccgtggttcctaaccttcgtcccg

SEQ ID NO: 420927 - DNA, 545 bp, Homo sapiens
  misc_feature: GZ8MTXP01DV7T6.52.37.D04.1.454.CMB.2.raw
  modified_base (261)..(261): a, c, t, g, unknown or other
  modified_base (287)..(287): a, c, t, g, unknown or other
  modified_base (331)..(331): a, c, t, g, unknown or other
  modified_base (339)..(339): a, c, t, g, unknown or other
  modified_base (342)..(342): a, c, t, g, unknown or other
  modified_base (354)..(354): a, c, t, g, unknown or other
  modified_base (485)..(485): a, c, t, g, unknown or other
  modified_base (492)..(492): a, c, t, g, unknown or other
  modified_base (514)..(514): a, c, t, g, unknown or other
  modified_base (519)..(519): a, c, t, g, unknown or other
  modified_base (529)..(529): a, c, t, g, unknown or other
  modified_base (533)..(533): a, c, t, g, unknown or other
  modified_base (535)..(545): a, c, t, g, unknown or other
tcagcgcagtacgacacgaccggtgctcgatttagtagcatactgttggggtttgggggggggtctcaggaggcagcgctctcgggacgtctccaccatggcctgggctctgctattcctccaccctcctcactcagggcacgagggtcctgggcccagtctgccctgactcagcctgcctccgtgtctgggtctccgtggacagtcgatcaccatctcctgacactaggaaaccagacaaatgaactagtttggggttcncatcgcttctccggctaccgaagtcnggcacgcgaccgcctccctagaccatctcgtggctccgaggtcnggagacgngtntagtattatacngacagtctacaaataactaacgaaaacaagtaaactacgttggggtacggtcgggacgggacggaaaccaaacgtcgaaccttcaacgtacacgaccaaggccaccgcccctagtcacgtctccgtacccncctcgtntacgtagactcgcgtggacggnggcgngacgacgcgntaangnnnnnnnnnnn

SEQ ID NO: 420928 - DNA, 588 bp, Homo sapiens
  misc_feature: GZ8MTXP01BB5FE.52.37.D04.1.454.CMB.2.raw
tcagcgcagtacgacacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataatctgtctctgtacaacactacccgcaaagtcccaaactcatgatcttgaggtaatgatcggcccgcgtaggggtttctcatcgcttctccccggctccaagtctcggcagccgacgccctccctcgacctctctctggactccaggctgaggtacgaggctgattattactgccaggtctctaataataaacaaactacgaaacgtcgttcggggtcgtttccgggacgggcggggtaaaccctaaacgttccggtaacccgttccgtaaccggtacgaccggcccaacgggtccctccgcccccgttcggtaccaccgttccgttccgtttccccccg

SEQ ID NO: 420929 - DNA, 690 bp, Homo sapiens
  misc_feature: GZ8MTXP01CN4A8.52.37.D04.1.454.CMB.2.raw
  modified_base (337)..(337): a, c, t, g, unknown or other
  modified_base (367)..(367): a, c, t, g, unknown or other
tcagcgcagtacgacacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttatattctgtctctgtaccaacaactaccccggacaaacgtccccaaactcatgatcttgaggtcagtgactcggcccgcgtaggggtttcncactcgcttccctccggctccaagtctgcncgcaccggcctccctgacctatctcgtgggcctccgaggctggacggacggaggctaggtatttaacttacgttggcaggtccttactaattaaacttaaaccgaaaacgaaacggtaaaaccgttaccggtttacgggggttcggtttacccgggggaccgggtaacccggggaaacccgttaaaccgtaccggggttaaaccccgttaccccggttaaccggttaccccgaaccggaacccccggtaaacggggtccccgttccccggtcccccccgttaccggggttaccccttaacccgttcccgttttaaccccccgg

SEQ ID NO: 420930 - DNA, 629 bp, Homo sapiens
  misc_feature: GZ8MTXP01ESQBR.52.37.D04.1.454.CMB.2.raw
  modified_base (385)..(385): a, c, t, g, unknown or other
  modified_base (412)..(412): a, c, t, g, unknown or other
  modified_base (512)..(512): a, c, t, g, unknown or other
tcagcgcagtacgacacgaccggtgctcgatttagtagcatactgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaaatgaactattggtaacttataattctgtctctgtaccaacactacccggacaaacgtcccaaactcatgatctttgagtcagtgacgtccggcccgtcgtaggggtttctcgtatccgtcctttcccgccggtctaccaagtcgtaggaccngcctacccgggccctccctacgacctntcctcgtcggctccgagctggaacggacgaggctagtacttagttacgcgtacagtaccttacattaaaacgtaaactaaaacccgaaggtaaaacccgngggttttaacgggggtcgttaccggggacgggaacgggtaaaccaacggtaccgacccgtacgtacgttcacgggacccaagggccctcgccccgtgttactaaccgttcgtccccg

SEQ ID NO: 420931 - DNA, 697 bp, Homo sapiens
  misc_feature: GZ8MTXP01EU0TZ.52.37.D04.1.454.CMB.2.raw
  modified_base (451)..(451): a, c, t, g, unknown or other
tcagcgcagtacgacacgaccggtgctcgatttagtagcatactgttggggtttggggggggtctcaggaggcagcgctctcgggacgtctccaccatggcctgggctctgctattcctcaccctcctcactcagggcacgagggtcctgggcccagtctgccctgactcagcctgcctcgtgtcgtgggtctcctggacagtcgatcaccatcctcctgcactggaaccagacaatgactagttaggtaacttataacttctgtctcctcggtaaccaacaaacgtaccccggacaaaacgtaccccaaactcatcgtaattcgttttagaggttcaggtgacgtccggcccgcggttacggggtttctctacgtcgtcctttcccgccgggtactccgtaaagtccgtaacgggcaacggccgtaccgggtccctacccgtacgaaccncttctcggtcgggccctaccggaggcgtagggaacgggccgtaagggtctagttaacttaacgttaacgtcgacggtactactactaactaaactaaaccgaaaaacgtagtaaaaccgttcgggttaagggttcgggttacccggggacggggaaccggaaaccgttaacggtcgttaaacccgtccgttacgacgcggacctaacggccctcccgtcccgcggttacctccgttccgttccccg

SEQ ID NO: 420932 - DNA, 674 bp, Homo sapiens
  misc_feature: GZ8MTXP01EXN2U.52.37.D04.1.454.CMB.2.raw
  modified_base (228)..(228): a, c, t, g, unknown or other
tcagcgcagtacgacacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcaaatgactattggtaacttataattctgtctcctggtaccaacaactaccccggacaaacgtaccccaaactcatgatctttgagtcagtgatccggcccgcgtagggggtttctcatcgtcttcccgtccggctccaagtctagggcaacgcaccggtccctccctacgacctactctccgttgggcctccgaagggccgtagggaacggacggtaaggccgtagtaattaattaacgtggtacaggtaccctataactaaacttaaacaaaacgtaaacgaaaaaccgttcgggtttcggggttacgggtttaccggggaccggggaacccggggtaaccttaaaccggtccggttacccgttaccgtaacggttaccgacgaccccgaaggcccgtaacccgtcccccgtcggttaccctaaccgttcccgtttaaccccg

SEQ ID NO: 420933 - DNA, 648 bp, Homo sapiens
  misc_feature: GZ8MTXP01CB1AV.52.37.D04.1.454.CMB.2.raw
tcagcgcagtacgacacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactggaaccagcaatgactattgtacttatattctgtctctagtaccaacaactacccgacaaacgtaccccaaactcatgattcttagaggtcagtgacgtccggcccgtcgtacggggtttctcgtatcgtcttccccgtccgggactacccgtaagtcgtacgggaccaacgccgaacccggtccctccccgtacgaccctactccgttccgtcggggtccaccgacggcgtagggacggacgtacggtcttaggtatttaacttacgtgactagtcctataataaactaaacaaaacgaagtaaacgtcggttagggtcgttcgggacgggaacgggaaaccacgtacgaccgtaccgtacgttccgacgttacccgaacggtcccgtaacccgtccccgtcggttacctccgttccgttaaccccg

SEQ ID NO: 420934 - DNA, 724 bp, Homo sapiens
  misc_feature: GZ8MTXP01B1VZV.52.37.D04.1.454.CMB.2.raw
  modified_base (301)..(301): a, c, t, g, unknown or other
tcagcgcagtacgacacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcacgtgaaccagcaaatgactattagtacttataattctgtctctgtaaccaacaacacccgacaaacgtacccaaactcatnatcttagagtcagtgacgtccggcccgtcgtaggggtttcacgtacgtcgtccttcccgtccggtcttacccgaacgtcgtcggactaacggccgacccgggtcccctcccgtacgaccctacttcctccggtcgggtcccttaccggagggtacccgttaggggaaacggggaccggagggttccgtaggttaactttaacgttacgtacggtactacggtactactaaactaaacgtaaacaaaacgaacgtaaaaccgtcggtttcggggtacggttaccgggacgggtaacccggaaaccgttaaaccggtccggttaaccccgttacccgtacggttacccgaccggaccccggtaaacggtccccgtcccggtaccccccgttcgggttacccctccggtttcccgtttccccccgg

SEQ ID NO: 420935 - DNA, 763 bp, Homo sapiens
  misc_feature: GZ8MTXP01CT9Z7.52.37.D04.1.454.CMB.2.raw
  modified_base (353)..(353): a, c, t, g, unknown or other
tcagcgcagtacgacacgaccggtgctcgatttagtagcatactgttgggtttgggggggtctcaggaggcagcgctctcgggacgtctccaccatggcctgggctctgctattcctcaccctcctcactcagggcacgagggtcctgggcccagtctgccctgactcagcctgcctccgtgtcgtgggtctcctggacagtcgatcaccatctcctgcactggaaccagcaatgactagttgtacttaatacttctgtctctcggtaccaacaactacccggacaacgtaccccaaactcatagattctttagaggtctagtgacgtccggcccgtcggtaggggttttccnctacgttccgtcctttccccgtcccgggtcctaccgtaaacggttccgtcgggccaacggtacccgtaaccccgggtcccttaccccgtacggtaacccctacgttcccgttcgttcggggcccttccggacggtccggtaggaacggggaccggtaggtcgttagtactttacgttactcgtactacgttcctactaacgtaaactaaaccgaaaacgtaaacgtaaaaccgttcgggtttcgggggtacgttacccgggggaccgggtaaccggggtaaacccttaaaccgggttccggttaaaccccgtttacccgtaacgttacccgaacggaccccgtaaacggggcccttaaccccgggtcccccgttaccgggttaccctaaccgtttccgtttaacccccgg

SEQ ID NO: 420936 - DNA, 562 bp, Homo sapiens
  misc_feature: GZ8MTXP01C9GK5.52.37.D04.1.454.CMB.2.raw
  modified_base (343)..(343): a, c, t, g, unknown or other
  modified_base (376)..(376): a, c, t, g, unknown or other
tcagcgcagtacgacacgaccggtgctcgatttagtagcatactgttggggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaaccagcaaatgactattggtaacttataattctgtctctggtaccaacaactaccccggacaaacgtccccaaactcatgattctttgaggtcagtgatcggcccgcgtagggtttcncactcgccttccgccggctccgaagtcgtggcngcaccggccctcctgaccatctcgtggctcgagctgaggacgagtctagtattatacgtgcacgtctacaataactaacaaacagaaactacgttgggtgtcgggcggtaacggaaccaaagtcgaccgtctacgttacgcgacccgaaggcctccgccccgtcggttacctccgttccgttcccg

SEQ ID NO: 420937 - DNA, 574 bp, Homo sapiens
  misc_feature: GZ8MTXP01A25FQ.52.37.D04.1.454.CMB.2.raw
  modified_base (159)..(159): a, c, t, g, unknown or other
  modified_base (185)..(185): a, c, t, g, unknown or other
  modified_base (224)..(224): a, c, t, g, unknown or other
  modified_base (247)..(247): a, c, t, g, unknown or other
  modified_base (353)..(353): a, c, t, g, unknown or other
  modified_base (404)..(404): a, c, t, g, unknown or other
tcagcgcagtacgacacgaccggtgctcgatttagtagcatactgttgggtttgggcacgaccggtgctcgatttagtagcatactgttgggtttgggggcgtggtccagcctgggaggtccctgagactctcctgtgcaggctctgcattttcccttnagtaactatgctatcgattgggtccnccaggctccaggcaagggactggagtgggtggcagttanatcagctgatggagcagtaaatntacgcagattctgcgagggccgattcaccatatccagagacaactcccaagatatgatatatctaacaaatgaacagcctgagacccctgagacacggctagtatnttatgtgcgtcgagggggcagtgctggccagtgatgtacttttgatttcgngggaccaagggtacacgttcgtcaccgtctcctcacgccctccaccgtaacgggccctacgtcccggtccttccccgttcggacccttaccccgttcctacccgaaacggcacccgaacccgtttcggtaaccgggggccaccggacggtcccgggcccgtaaccggggg

SEQ ID NO: 420938 - DNA, 580 bp, Homo sapiens
  misc_feature: GZ8MTXP01ABVEB.52.37.D04.1.454.CMB.2.raw
  modified_base (360)..(360): a, c, t, g, unknown or other
  modified_base (452)..(452): a, c, t, g, unknown or other
  modified_base (459)..(459): a, c, t, g, unknown or other
  modified_base (477)..(477): a, c, t, g, unknown or other
tcagcgcagtacgacacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgactattggtacttataattctgtctcctggtaaccaacaaataccccggtcaaacgtccccaaactccatgaatctttagacggtcagtgaactcggcccgcgtagggggtttctcgatcgcttccnccggctcccaagtctgggcaagtcaccgggcctcccgtgaccatcctcgtgggactcgaggctgaacggcgtaggctgagttatacgtgccngctacanagtaacaaacgataaacncgttagggtcgttcgggcggccgggaaacaaacgttcggaccgtttccgacgttcagaccccgtaagggcctaaccgggccctcggttacaacttcgttcccg

SEQ ID NO: 420939 - DNA, 588 bp, Homo sapiens
  misc_feature: GZ8MTXP01EUJ71.52.37.D04.1.454.CMB.2.raw
  modified_base (373)..(373): a, c, t, g, unknown or other
tcagcgcagtacgacacgaccggtgctcgatttagtagcatactgttgggtttgggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccagcaaatgaacattggtacttataattctgtctctggtaccaacaataccccggacaaagtaccccaaactcatgatctttgaggtcagtgatcggcccgcgtagggggtttctcatcgcttccgtccgctaccaagtcgtcggcngcgaccggccctccctcgaccatctcgtcggctcgagctggagacgagctagtattataacgttgacgacgtctacaataactaaacaaacgaagtaaacctagttgggtaggttcgggcgggtaacgggaaccaaacgtcgacccgtcctacgttcgacgttacccgaacggtccgtaacccgccccgtcggttcctaacgttccgtaaccccg

SEQ ID NO: 420940 - DNA, 685 bp, Homo sapiens
  misc_feature: GZ8MTXP01EPQOR.52.37.D04.1.454.CMB.2.raw
  modified_base (303)..(303): a, c, t, g, unknown or other
  modified_base (655)..(655): a, c, t, g, unknown or other
tcagcgcagtacgacacgaccggtgctcgatttagtagcatactgttgggtttggggggggtctcaggaggcagcgctctcgggacgtctccaccatggcctgggctctgctattcctcaccctcctcactcagggcacgagggtcctgggcccagtctgccctgactcagcctgcctcgtgtctggtcctcctggacagtcgatcacatctctgcactgaaccagcaatgactattgtacttatatctgtctctagtaccaacaactacccgacaaacgtacccaaatcatgtatctttagngtcagtcgagttccggcccgtcgtacggggtttctcgacgtcgtccgtttccgtcccggtctacccgtaacgttccgtcggaccaacggtaccgacccgggtcccctccccgttacggaaccctacgttcccttcggtcgggtacccgttaacccgggacggtacgtaacggggaacggacgggtacggtacgttacgttaactttacgttacgtacgtacgtacgtactaactaaactaactaaaccgaaacgtaaacgtaaacgttcggttacggggtcggttaccggggaccggtaacggtaacttaacgtccgttaccgtaccgtaacgcgacgacccgaaggtcccnccgtcccgtcgttacctccgttccgtcccg

SEQ ID NO: 420941 - DNA, 740 bp, Homo sapiens
  misc_feature: GZ8MTXP01A0WYH.52.37.D04.1.454.CMB.2.raw
  modified_base (227)..(227): a, c, t, g, unknown or other
tcagcgcagtacgacacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcaaatgactattggtacttataattctgtctctggtaccaacaactaccccggacaaacgtaccccaaactcatgatctttgaggtcagtgactcggcccgtcgtaggggtttcctcatccgtcttccccgtcccggtctacccgtaacgtccgtacggccaacggcccgtaacccgggccccttacccccgtacggtaacccctacgttcccgttccgttcggggtcccgttacccgtaacgggccggttacgggaacgggaacgggtaacgggtccgttaggttaacttaacgtttaaccgttcggtacgtaacggtccttacctaacgtaacttaaacgtaaaaccaaacggtaaaaccgtaacgttacgggttacgggttccgggtccgggaacctaaccggggggggggggggggggttaaacctaccggttacccgtaccgtaaccgttaccgaccgacccgaaccggccgtccgtccccgtccgttccgtaaccttccgttcccg

SEQ ID NO: 420942 - DNA, 765 bp, Homo sapiens
  misc_feature: GZ8MTXP01AFBQY.52.37.D04.1.454.CMB.2.raw
  modified_base (230)..(230): a, c, t, g, unknown or other
tcagcgcagtacgacacgaccggtgctcgatttagtagcatactgttggggtttgggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatccaccatctcctgcactggaaccngcaaatgaactagttggtaacttatattctgtctctagtaccaacaactaccccggacaaacgtaccccaaactcatgattctttgaggtcagtgacgtccggcccgtcggtacgggggtttctcgagttccgtcctttcccgtcccggtctacctaacgtcgtcgggctaacggcccgtaacccgggtcccttaccccgtacggtaaccctacgttcccgttccggtacgggggtcccttacccgggaacgggtcccgttaggggaacgggaaccggtagggtacctaggttaactttaacgttacctcggactacgtccttacgaaacttaaactaaacgaaaaccgtaacgtaaaaccgttcgggtttcgggggtacggttaccgggggaccgggtaacccggggtaaacccttaaaccggtccgggttaaaccccgttcccgttaaaccggttccgaaccgggttaccccgaacggggccccttccgggtccccccgtacgggttcctaacccgtttcccgtttcccccgg

SEQ ID NO: 420943 - DNA, 613 bp, Homo sapiens
  misc_feature: GZ8MTXP01CV7K1.52.37.D04.1.454.CMB.2.raw
  modified_base (320)..(320): a, c, t, g, unknown or other
  modified_base (378)..(378): a, c, t, g, unknown or other
tcagcgcagtacgacacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaaatgaacattggtacttataattctgtctctgtacaacaatacccgcaaagtcccaaatcatgatctttgaggtcagtgatcggcccgnacgggggtttctcatcgtcttcctccggctccaagtcctggccaagcacggcctcccncgacatctcgtcgctacgaggcgtagaggacggagtacgtagtattaacttacgtacgacgacgtactactaactaaactaaaccaaaacgaaacgtaaaacgtaacggttagggttacgggttacgggcgggaaccgggtaaaccgttaaaccgtaccgttaccgtaccgtaccgttaccgaccgaccgaacgtaccgtccgtccccgtccgttaccgtaaccgttccgtcccg

SEQ ID NO: 420944 - DNA, 755 bp, Homo sapiens
  misc_feature: GZ8MTXP01AKA6N.52.37.D04.1.454.CMB.2.raw
  modified_base (217)..(217): a, c, t, g, unknown or other
tcagcgcagtacgacacgaccggtgctcgatttagtagcatactgttgggtttgggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctncacgtacggaaccagactaatcgaactagttaggttaactttaagttaacttcgtcgttcctccgtacggtaacccaaactaaccgtacccccggaactaaaccgtaccccaaactcctaattacgtaacttcgtttaggacggtcgtaggtacgtacgtccccggggcccgtcggttaccgggggtttcctaccgtacgttccgtccctttccccgtaccccggtacctacccgtaagtccgtcggaccgcggtacccaccccggtacccttcccctacgaacccttcgttcccgtcggtcgggtaccctcggacgggtccgtagggtaacgggacgtcggtcttaggttattacttgtacgcgtactacttacaacgtaaactaaacctaaagtaaaccggtaacgttcggttcggggttacgggaccgggtccggggaaccggaaaccttaacggtccaccgtaccgtacgttacgcccgttaccgaacgtcccgtcccgtaccccggtgttaccctccgttcccgttaaccccg

SEQ ID NO: 420945 - DNA, 706 bp, Homo sapiens
  misc_feature: GZ8MTXP01BO61M.52.37.D04.1.454.CMB.2.raw
  modified_base (235)..(235): a, c, t, g, unknown or other
  modified_base (331)..(331): a, c, t, g, unknown or other
  modified_base (336)..(336): a, c, t, g, unknown or other
  modified_base (399)..(399): a, c, t, g, unknown or other
  modified_base (486)..(486): a, c, t, g, unknown or other
tcagcgcagtacgacacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctcgtgtctggtctcctggacagtcgatccacctatctcctgcactaggaaccagcaatnactattgtacttatatctgtctctgtacaacaactacccgacaactacccaaactcatgattcgttgagtcagtgacgtcgccgtgtcgggtttcncgtancgtcctttcccctccggactcgtacgtgtacggctcgccgaccggccctacccgtagaccctntcctcggtacgctccgaggctagggaacggcggtacgtcgtagtactttaacgtacgttcgacgtaacggtcttaacgactttaaanaaacccgttaaaacgaaacggtaaaccccgttacgggtttgggggtacccggtttcccggggaacccggggtaacgggggtaaaaccccttaaccggtttacccggaccccgtttaacccggtcggttaaccgaccccgggttaaaacccctcgggggtacccctccccgggtaccccccgttcccggaccctttaaccccgtttccccggttaaccccg

SEQ ID NO: 420946 - DNA, 516 bp, Homo sapiens
  misc_feature: GZ8MTXP02JOBN9.52.37.D04.1.454.CMB.2.raw
tcagcgcagtacgacacgaccggtgctcgatttagtagcatactgttgggtttgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctcctggtaccaacaataccccggcaaagtccccaaactcatgatctttgaggtcagtgatcggcccgcaggggtttctcgatcgcttcctcgctccaagtctggcagcacggcctccctgaccatctctggctccagctgagcgaggctgattatactgcagctcatatacaaacagaaacacttgggtagttcggcggcgggacaaacgtcgaccgtctacgtcacgcccaaggcctcgcccctcggtcaccgtcttcccg

SEQ ID NO: 420947 - DNA, 530 bp, Homo sapiens
  misc_feature: GZ8MTXP02GLVJZ.52.37.D04.1.454.CMB.2.raw
  modified_base (361)..(361): a, c, t, g, unknown or other
tcagcgcagtacgacacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctcctggtaccaacaataccccggcaaagtccccaaactcatgatctttgaggtcagtgatcggcccgcaggggtttctcatcgcttcctccgctcaagtctggcngcacggcctccctgaccatctctggctcagctgagcgagctgattatatgctagctcatataacaaacagaaactcgttagggtgttcggcggacgggaaccaaacgtcgaaccgtccgtaacgtccacgcccaaaggtctacgccccctcggtcctactccgttcccg

SEQ ID NO: 420948 - DNA, 496 bp, Homo sapiens
  misc_feature: GZ8MTXP02F7IKH.52.37.D04.1.454.CMB.2.raw
  modified_base (487)..(496): a, c, t, g, unknown or other
tcagcgcagtacgacacgaccggtgctcgatttagtagcatactgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggggtttctcatcgcttctccggctccaagtctggcagcacggcctccctgaccatctctgggctccaggctgaggacgaggctgattatacctgcagctcatatacaaacagaaacacgttgggtagttcgggcggcgggaaccaaacgtgaccgtctaacgtcacgcccaaggctcgcccctcggcactctcgtccccacctcctctactacgactcgctgacgcgggctggcaacgggcacagtagnnnnnnnnnn

SEQ ID NO: 420949 - DNA, 471 bp, Homo sapiens
  misc_feature: GZ8MTXP02I70AT.52.37.D04.1.454.CMB.2.raw
  modified_base (431)..(431): a, c, t, g, unknown or other
  modified_base (462)..(462): a, c, t, g, unknown or other
  modified_base (465)..(465): a, c, t, g, unknown or other
  modified_base (467)..(471): a, c, t, g, unknown or other
tcagcgcagtacgacacgaccggtgctcgatttagtagcatactgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggggttctcatcgcttctccggctccaagtctggcagcacggcctccctgaccatctctggctccaggctgagacgaggctgattatactgcagctcatatacaaacagaaacacttgggtgttcggcgcgggaccaaactgaccgtcctacgtcagccaaggctgccccctggtcactctgttcccacctccncatacgatcgctgagcgggctgggcaaggcncanannnnn

SEQ ID NO: 420950 - DNA, 593 bp, Homo sapiens
  misc_feature: GZ8MTXP02GW59M.52.37.D04.1.454.CMB.2.raw
  modified_base (465)..(465): a, c, t, g, unknown or other
  modified_base (585)..(593): a, c, t, g, unknown or other
tcagcgcagtacgacacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaaatgactagtttggggtttctcatcgcttctccggctccaagtctggcagcaccggcctccctgaccatcctcgtcgggcctccgaggctaggaggacgaggctgatttatacctgcagctacataactacaaacaagaaaactacgttggggtacgttcgggaccggggaccgggaaaccctaaaacgtcggtaaccccgtccgtaaccgtacgaccgaccccgaaaggtcccncccggtcccccgtacgggtaccctaccttcccgttccgttaccccctacccttccctaccttaacgtaccgtactccgtacgtcggacggccggtcgacggacgaacggcgacaagacgnnnnnnnnn

SEQ ID NO: 420951 - DNA, 523 bp, Homo sapiens
  misc_feature: GZ8MTXP02IA6VJ.52.37.D04.1.454.CMB.2.raw
  modified_base (352)..(352): a, c, t, g, unknown or other
  modified_base (513)..(523): a, c, t, g, unknown or other
tcagcgcagtacgacacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggggtttctcatcgcttctccggctccaagtctggcagcacggcctcccctgaccatctctgggctccaggctgaggacgaggctgattatacctgcagctcatatacaaacanaaacacttggggtagttcgggcggacgggaaccaaacgtcgacccgtccgtacgtacacgcccaagggcctcgccccctagggtcctacctccttcgtcccccacccttcctctagtaccatccgcgtgacgtccgggctgggacaagggccacacgacgnnnnnnnnnnn

SEQ ID NO: 420952 - DNA, 533 bp, Homo sapiens
  misc_feature: GZ8MTXP02GKHV9.52.37.D04.1.454.CMB.2.raw
  modified_base (184)..(184): a, c, t, g, unknown or other
  modified_base (221)..(221): a, c, t, g, unknown or other
  modified_base (244)..(244): a, c, t, g, unknown or other
  modified_base (353)..(353): a, c, t, g, unknown or other
tcagcgcagtacgacacgaccggtgctcgatttagtagcatactgttgggtttgggcacgaccggtgctcgatttagtagcatactgttgggtttgggggcgtggtccagcctgggaggtccctgagactctcctgtgcaggctctgcatttcccttcagtaactatgctatcgattgggtccnccaggctccaggcaagggctggagtgggtgcagttanatcagctgatggagcagtaaatnttacgcagattctgcggaggggccgattcaccatatccagagacaactcccaagatatgatatatctaacaaatgaaacagcctgagacccctgagacacggctgtatnttatgtgcgtcgaggggcagtgcgtgcacgtgatgtctttgagtttcgcggggtacgaagggactagttcgtcaccgtctcctcacgctaccacgacggccacgtccggtcctccccgtgcctacccgtcctaccgaacgcgaccaaccgtcgtcggggaccacgcgccggcccgtcggg

SEQ ID NO: 420953 - DNA, 562 bp, Homo sapiens
  misc_feature: GZ8MTXP02IVMNO.52.37.D04.1.454.CMB.2.raw
  modified_base (183)..(183): a, c, t, g, unknown or other
  modified_base (244)..(244): a, c, t, g, unknown or other
  modified_base (465)..(465): a, c, t, g, unknown or other
tcagcgcagtacgacacgaccggtgctcgatttagtagcatactgttgggtttgggcacgaccggtgctcgatttagtagcatactgttgggtttggggcgtggtccagcctgggaggtccctgagactctcctgtgcaggctctgcatttcccttcagtaactatgctatcgattgggtccnccaggctccaggcaagggactgggagtgggtgcagttatatcagctgatggagcagtaatntacgcagatctgcgagggccgattcaccatatccagagacaactccaagactatgatatatctaacaaatgaaactagcctagagtacccctagacggacacggtcttagttatagtttatggtgacttcggagggggcagtcgcgtggccaacggtgtaatcgtctttgtatttcggtagggacctaagggctagttcggtctacccgtctcctcgaccnctccaccgacgaccgtacgtccgtccgtcccgtccgtccgtaccctacctaccacgacgaccgtaaccgtacgtacggacgacgacgccgccgtcgg

SEQ ID NO: 420954 - DNA, 596 bp, Homo sapiens
  misc_feature: GZ8MTXP02GEKUD.52.37.D04.1.454.CMB.2.raw
  modified_base (245)..(245): a, c, t, g, unknown or other
  modified_base (251)..(251): a, c, t, g, unknown or other
tcagcgcagtacgacacgaccggtgctcgatttagtagcatactgttgggtttgggcacgaccggtgctcgatttagtagcatactgttgggtttgggggcgtggtccagcctgggaggtccctgagactctcctgtgcaggctctgcattttcccttcagtaactatgctatcgattgggtccgccaggctccaggcaagggctggagtgggtgcagttatatcagctgatggagcagtaaatnttacgnagattctgcgagggccgattcaccatatccagagaccaactcccaaagatatgatatatctaacaaatgaaacagcctgacgacctgaggacacggctagtatattattgtgcgtcgagggggcagtgcgtagcacgtgatgtctttgtatttcgtggggtccgaaaggggtactaagttcgtcgtacccggttccttccctccgtacgcccttacccgaacccgaaaccgggccccgtaacgttcccggtcctttccccccgttcgggaccctacccccgttccctacccgaaacgccgacctaacccgttcgacgggggccaaccgacgccggcccgtcgggg

SEQ ID NO: 420955 - DNA, 624 bp, Homo sapiens
  misc_feature: GZ8MTXP02GOVOM.52.37.D04.1.454.CMB.2.raw
  modified_base (376)..(376): a, c, t, g, unknown or other
tcagcgcagtacgacacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgactattggtacttataattctgtctcctggtaccaacaaactaccccggcaaacgtcccccaaactcaactgactctttgaggtcagtgatcggcccgcgtaggggtttctcactcgtcttcccgtccgctccaagtctggcngcacggcctcctgaccatctcgtcgggctccgaggctgacggacgagtcgtagtattactttacgcgacacgtactacctataactaaacaaaacgtaacgaaaacgtaccggtttaggggtcggtttaccgggaccggggtaccgggaaacctaaaacggtccgtaacccgtacccgtacggtacgaccgacccgaaacggtccctaccggtcccccgtacggtaccgtaccgttccgtttccccgg

SEQ ID NO: 420956 - DNA, 564 bp, Homo sapiens
  misc_feature: GZ8MTXP02GMAG8.52.37.D04.1.454.CMB.2.raw
  modified_base (370)..(370): a, c, t, g, unknown or other
tcagcgcagtacgacacgaccggtgctcgatttagtagcatactgttgggtttggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaaatgacattggtacttataattctgtctcctggtaccaacaataccccggcaaacgtccccaaactcatgatctttgaggtcagtgatcggcccgcaggggtttctcatcgtcttccctccggtcctccaacgtctcggcncgcacgcctcctcgacactctctggctccagctgagacgagctgatattactgcagctcatataacaaacaagaaactaacgttggtacgttcggcggacgggaaccgaaacgttacgacccggttacctacgtaccgaacgacccgaaacggtccgtaccgtcccccgtccggtaccaccgtaccgtttcccg

SEQ ID NO: 420957 - DNA, 537 bp, Homo sapiens
  misc_feature: GZ8MTXP02HUBMV.52.37.D04.1.454.CMB.2.raw
  modified_base (183)..(183): a, c, t, g, unknown or other
  modified_base (246)..(246): a, c, t, g, unknown or other
  modified_base (356)..(356): a, c, t, g, unknown or other
tcagcgcagtacgacacgaccggtgctcgatttagtagcatactgttgggtttgggcacgaccggtgctcgatttagtagcatactgttgggtttggggcgtggtccagcctgggaggtccctgagactctcctgtgcaggctctgcatttcccttcagtaactatgctatcgattgggtccnccaggctccaggcaagggactggagtgggtggcagttatatcagctgatggaggcagtaaatnttacgcagattctgcgaggggccgattcaccatatccagagacaactcccaaagatatgatatatctacaaatgaaacagcctgacgacccctgagacacggctagtatnttattgtgcgtgagggggcagtgctggcacgtgatgtcttttgatttcgtgggccaagggtctattcgtcaccgtctcctcacgcctccacgaacggcccagtccggtccttccccgtggccaccccttccacccgaacgacgccaaccgtcgtcggggcacgacggccggcccgtcgggg

SEQ ID NO: 420958 - DNA, 534 bp, Homo sapiens
  misc_feature: GZ8MTXP02FU4LH.52.37.D04.1.454.CMB.2.raw
  modified_base (364)..(364): a, c, t, g, unknown or other
tcagcgcagtacgacacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctcctggtaccaacaataccccggacaaacgtccccaaactcatgatctttgagtcagtgatcggcccgcaggggtttctcatcgcttccctccggctcaagtctggcngcacggcctccctgaccatctctgggcctcgaggctgaggacgaggctgattattactgcagctcatataacaaacagaaactagttgggtagttcgggcggacgggaaccaaacgtcgacccgtctacgtcacgcccaaggcctcgcccccgtggtccacgtcttcccg

SEQ ID NO: 420959 - DNA, 535 bp, Homo sapiens
  misc_feature: GZ8MTXP02GN5YM.52.37.D04.1.454.CMB.2.raw
tcagcgcagtacgacacgaccggtgctcgatttagtagcatactgttgggtttgggggggtctcaggaggcagcgctctctggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctcctggtaccaacaataccccggcaaacgtccccaaactcatgatctttgaggtcagtgatcggccgcgtaggggtttctcatcgccttctccggctcaagtctggcagcacggcctccctgaccatctcgtgggctcgaggccgtgacggacgaggctgattattactgcagctcaatataacaaacagaaaactagttagggtgttcgggacggcgggacaaacgtcgaccgtcctacgtcacgaaccgacgctacgcccctcggtccacgttcccg

SEQ ID NO: 420960 - DNA, 599 bp, Homo sapiens
  misc_feature: GZ8MTXP02JN0W1.52.37.D04.1.454.CMB.2.raw
  modified_base (327)..(327): a, c, t, g, unknown or other
  modified_base (337)..(337): a, c, t, g, unknown or other
  modified_base (364)..(364): a, c, t, g, unknown or other
tcagcgcagtacgacacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttatattctgtctctgtaccaacaactaccccggacaaacgtaccccaaactcaatgatctttgaggtcagtgatcggcccgngtagggttcncatcgcttcctccgctcaagtctggcngcaccggcctccctgacctatcctcgtcggcctcgacggctagaggaccgaggactgtaacttagttactcgactagctacaataactaaacaaaacgaagaaaacgtacgttagggttcggtacggacggtaccgggaaaacctaaacgtccgtaaccgtaccgtacgtaccgaaccgacccgaaacggtccctaccgtacccccgtcggtaccctacgtcccgtttaaccccg

SEQ ID NO: 420961 - DNA, 773 bp, Homo sapiens
  misc_feature: GZ8MTXP02I5JPO.52.37.D04.1.454.CMB.2.raw
  modified_base (228)..(228): a, c, t, g, unknown or other
tcagcgcagtacgacacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcaatgactattggtacttatattctgtctctgtaccaacaactaccccggcaaacgtccccaaactcatgactcgtttgaggtcaggtgacgtccggcccgcgtacggggtttctcatcggtcttcccgtcccggctaccgaacgttctcggcacggtccaccggtccctcccgtacgacctacgttcccgtcgtcggggtccctaccgaacgggtccgttacggggaacgggacccggtaagggtcccgttacggttaatttaacgtttaccgtcggacctaacggtccttaccgaatttaaaccgtaaaacccaaaacgtaaacggtaaaacccgttaacgggttttgggggttaaccggtttcccgggggaacccggggtaaccggggtaaaaccccgttaaaaacggttcccgggtaaaccccggttacccggttaaccgtaccggaacccggttaaccccgaaacgggtccccgtttaccccgggaacccccccggtttcgggttaacccctacccggttttccccggtttaacccccg

SEQ ID NO: 420962 - DNA, 538 bp, Homo sapiens
  misc_feature: GZ8MTXP02GM2YE.52.37.D04.1.454.CMB.2.raw
  modified_base (336)..(336): a, c, t, g, unknown or other
  modified_base (425)..(425): a, c, t, g, unknown or other
tcagcgcagtacgacacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctcctggtaccaacaactaccccggcaaacgtccccaaactcatgatctttgaggtcagtgatcggcccgcaggggtttcncatcgcttcctccgctccaagtctggcagcacggcctccctgaccatctctggcctccagctgacggcgaggctgattatactgcagcncatataacaacagaaacacgttgggtgttcggcggtacgggaccaaaactcgaaccgtacctacgtacgacgacccgaaggcccttcggccccctcggcctacctcgttcccg

SEQ ID NO: 420963 - DNA, 579 bp, Homo sapiens
  misc_feature: GZ8MTXP02G6A3B.52.37.D04.1.454.CMB.2.raw
  modified_base (284)..(284): a, c, t, g, unknown or other
  modified_base (327)..(327): a, c, t, g, unknown or other
  modified_base (337)..(337): a, c, t, g, unknown or other
  modified_base (369)..(369): a, c, t, g, unknown or other
  modified_base (427)..(427): a, c, t, g, unknown or other
tcagcgcagtacgacacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaaatgactattggtaacttataattctgtctcctgtaccaacaactaccccgganaaacgtccccaaatcatgatctttgagtcagtgatcggcccgngtagggttcncgatcgtcttcctccggctacgaagtctggcngcacggcctcctgaccatctgtcggctcgaggcaggagaccgagctagattattacgngacatctacaataaacaaacaaaacgtaagtaaacgtacggttgggtacggtcgggacgggtaaccggtaaccaaacgtacgtaccgtaccgtaccgtacgaaccgaccgaacgtccgtacccgccccgtacgtacctaccgttccgtcccg

SEQ ID NO: 420964 - DNA, 553 bp, Homo sapiens
  misc_feature: GZ8MTXP02IU5K3.52.37.D04.1.454.CMB.2.raw
  modified_base (236)..(236): a, c, t, g, unknown or other
  modified_base (327)..(327): a, c, t, g, unknown or other
  modified_base (338)..(338): a, c, t, g, unknown or other
  modified_base (349)..(349): a, c, t, g, unknown or other
  modified_base (396)..(396): a, c, t, g, unknown or other
  modified_base (506)..(506): a, c, t, g, unknown or other
tcagcgcagtacgacacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacnttggtacttataattctgtctctggtaccaacaactaccccggcaaaacgtccccaaactcatgattctttgagtcagtgatccggcccgnacggggtttcncatcgcttccnccgtctccaagtctggcacgccgacggccctccctcgaccatctcgnggctcagctgagacgagctgatatactgcagctactatactaacaaacagaaactcgttaggcggttaccggacggacgggaacccaaacggtccgaccgttaccgtacnccgacgacccgtaacgctccgccccctacggtccacgttccttcccg

SEQ ID NO: 420965 - DNA, 638 bp, Homo sapiens
  misc_feature: GZ8MTXP02GPV0P.52.37.D04.1.454.CMB.2.raw
tcagcgcagtacgacacgaccggtgctcgatttagtagcatactgttgggtttggggggggtctcaggaggcagcgctctcgggacgtctccaccatggcctgggctctgctattcctcaccctcctcactcagggcacgagggtcctgggcccagtctgccctgactcagcctgcctccgtgtctgggtctcctggacagtcgatcaccatctcctgcactggaaccagacaatgactagttggtaacttataatctgtctctgtaccaaacaactaccccggacaaacgtaccccaaactcatgatctttgaggtcagtgacgtccggacccgtcgtacggggttttcctacgacgtccgtcctttcccgtcccggtacctaccgtaacgttcgtcggacacgccgaccggtcccttccaccgactactccgtcgtcggtcctccgagctggagtccggaagtccgtagtattattacgtgacgtactcctataactaataaaaccgaaaactaaggaaaaccgtacgttaggggtaccggttcggacgggttaaccgaaccgtaacgaccgtaaccgtctaccgtacacgtacccgaaggtcctaccgtccccgtacgtctccgtcttcccccgg

SEQ ID NO: 420966 - DNA, 632 bp, Homo sapiens
  misc_feature: GZ8MTXP02J33Q9.52.37.D04.1.454.CMB.2.raw
  modified_base (361)..(361): a, c, t, g, unknown or other
  modified_base (402)..(402): a, c, t, g, unknown or other
  modified_base (434)..(434): a, c, t, g, unknown or other
  modified_base (455)..(455): a, c, t, g, unknown or other
  modified_base (486)..(486): a, c, t, g, unknown or other
  modified_base (495)..(495): a, c, t, g, unknown or other
tcagcgcagtacgacacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgactcagcctgcctccgtgtctggtctcctgacagtcatcaccatctctgcacgtgaaccagcaatgactagttgtacttataacttctgtcctctacggtaacccaaacaaccgtaccccggactaaaccgtaccccaaactctatgtactttcgtttgagtacaggtgacgtccggacccgtcgttaggggtttccnctactcgtccttccccgccggtcctaccgaagtcgtcggcncgccaccggtccctccctacgacctagttccncgttcgggcctcgacggtcgnggagggacgaggtcttacgtatttaactctnacatcttanaattaacaaacaaaacgtaagtaaactacggggttggtcgggtaccgggaccggaccggaaccaactacggaccccgtactaccgaccacgacccgaagtcccgtccgtccccgtccgtacctcctccgtttccccg

SEQ ID NO: 420967 - DNA, 625 bp, Homo sapiens
  misc_feature: GZ8MTXP02IK8H7.52.37.D04.1.454.CMB.2.raw
  modified_base (416)..(416): a, c, t, g, unknown or other
  modified_base (435)..(435): a, c, t, g, unknown or other
tcagcgcagtacgacacgaccggtgctcgatttagtagcatactgttgggtttggggggggtctcaggaggcagcgctctctggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccagcaatgaactattggtacttataattctgtctctgtaccaacaactaccccgacaaacgtaccccaactcatgatctttgagtcagtgatcgggcccgtcgtaggggtttcctacgactccgtccttccgtccggtacctccgaagttccgttggcctacgccgaccggtccctacccgtcgaaccctntccgtcgtcggcctaccgnggccgtggacggacgtaggctagtacttattactgctagctacaatataaaccgaaacgaacgtaaacgttacggttgggtacggtaccgggtcgggaccgggtaaaccaaacggtcgtaaccccgtacctaccgtaccacggaacccgaacggtcccgtaccgccccgtaccggtactacccgttcccg

SEQ ID NO: 420968 - DNA, 566 bp, Homo sapiens
  misc_feature: GZ8MTXP02IF6BL.52.37.D04.1.454.CMB.2.raw
  modified_base (279)..(279): a, c, t, g, unknown or other
  modified_base (298)..(298): a, c, t, g, unknown or other
  modified_base (337)..(337): a, c, t, g, unknown or other
  modified_base (374)..(374): a, c, t, g, unknown or other
  modified_base (451)..(451): a, c, t, g, unknown or other
  modified_base (459)..(459): a, c, t, g, unknown or other
tcagcgcagtacgacacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttaatattctgtctctgtaccaaacaactacccggnaaacgtccccaaactcatntatctttgagtcagtgacgtccggcccgtgtagggttcnctagtcgtcttccgtcccggtctaccaagtctcggcngccacggccctcccgtgaccatcctcgtggcctcgaggcgtgaggacgaggctagtattatactgcagtctagatanaactaaanagtaaactcggttggtcgtacgggacggtacggaactaaacgtcgaacccgtcgtacgtcacgtaccgaacgtccgtccgtcccccgtggtccctacgtcgttcccg

SEQ ID NO: 420969 - DNA, 713 bp, Homo sapiens
  misc_feature: GZ8MTXP02FZ4WC.52.37.D04.1.454.CMB.2.raw
  modified_base (276)..(276): a, c, t, g, unknown or other
  modified_base (333)..(333): a, c, t, g, unknown or other
  modified_base (372)..(372): a, c, t, g, unknown or other
tcagcgcagtacgacacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttatatctgtctctgtaccaacactaccccggnaaacgtccccaaactcatgatcttgagtcagtgatccggcccgcgtacggggtttcnccgagtccgtcttcccgtccggcctccaacgtctcggcncgccgacggccctcccgtcgaccactcctcgttcggcccttcgaacggcttagggacggaccgaggggtacttaggtactttacgttaacgttcggacaacggtctaccgtaattaaacgtaaaacctaaaacgaaacggtaaaacccgttaagggtttcgggggttaaacggtttcccgggggtaccggggaaccgggggtaaaaccccttaaaaaccggtccgggttaaaccccccgttaacgtttaccccgtaccgtaaccggtaacccccgaacggtacccgtaccccgtccccccggttaacggtccccgtaacctttcccggttttaaccccccg

SEQ ID NO: 420970 - DNA, 570 bp, Homo sapiens
  misc_feature: GZ8MTXP02H0QKL.52.37.D04.1.454.CMB.2.raw
  modified_base (370)..(370): a, c, t, g, unknown or other
tcagcgcagtacgacacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctcctggtaccaacaataccccggcaaagtccccaaactcatgatctttgaggtcagtgatccggcccgcgtacggggtttctctactcgtcttcctccggcctcaagtctggcngccacggccctcccgtgaccatccgtctcgggcctcgacggctggacggtacggaggtctaggtacttataccgtgcagtctacataataacaaaacagtaaaactcgttagggtcgtcgggacggtaccgggaaccaaacgtcgaccgttacctacgtccacgaccaaggcctcgcccccgtggtcctaccgtctcccg

SEQ ID NO: 420971 - DNA, 783 bp, Homo sapiens
  misc_feature: GZ8MTXP02IECBK.52.37.D04.1.454.CMB.2.raw
tcagcgcagtacgacacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccagcaatgacattggtacttataattctgtctctggtaccaaacaactaccccggcaaacgtccccaaactcatgatctttgagtcagtgagtccggcccgcgtacggggtttctaccgacgtcgtcctttcccgtccccggtccttacccgaaaggttccgttacggggcctacgggccccgtaaaccggggtcccccctttcccccgttacgggaaccccctaactttccccgttaccggtttccgggggaaccctttcccggaacgggtaacccggttggaaacggggacccggtaaggggtccgttaccgggtaattttaacgttaacgttccggtccaacggtacccttaccgtaaaatttaactaaaaaccccgaaaaaacctaaggtaaaaccgtaaccggttttgggggtacggtttacccggggaccggggtaaccgggggaaaaccctaaaacggtacgtaaccccggttaccgtaaccgggtcaccggtacccgaacggtcccttcccggacccccgttacggtaccctaaccgtttccgttcccccg

SEQ ID NO: 420972 - DNA, 587 bp, Homo sapiens
  misc_feature: GZ8MTXP02H5B2J.52.37.D04.1.454.CMB.2.raw
  modified_base (228)..(228): a, c, t, g, unknown or other
  modified_base (341)..(341): a, c, t, g, unknown or other
  modified_base (371)..(371): a, c, t, g, unknown or other
  modified_base (384)..(384): a, c, t, g, unknown or other
  modified_base (389)..(389): a, c, t, g, unknown or other
  modified_base (392)..(392): a, c, t, g, unknown or other
  modified_base (419)..(419): a, c, t, g, unknown or other
  modified_base (447)..(447): a, c, t, g, unknown or other
tcagcgcagtacgacacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatctcctgcacgtgaaccngcaatgacattggtacttataattctgtctctgtaaccaacaactaccccggacaaacgtccccaaactcatgacttctttgagtcagtgacgtccggccgtcgtagggttcnctatccgtcttcccgcgctcaagtctagcncgcacgccctccngaccntcncgtacggcctcgacgcgtgacggacgnggtctagtatttagtactgcagtctaanaactaaacaaacaaacgaacgtaacgtcgggttggtacggtacgggaccggtaaccggaacctacggaccgtacccgtacgtaccgacgaccgacccgaacggtccctacccggtcccgtaccgtcctaccgtcctcccg

SEQ ID NO: 420973 - DNA, 529 bp, Homo sapiens
  misc_feature: GZ8MTXP02IDPTE.52.37.D04.1.454.CMB.2.raw
  modified_base (250)..(250): a, c, t, g, unknown or other
  modified_base (327)..(327): a, c, t, g, unknown or other
  modified_base (337)..(337): a, c, t, g, unknown or other
  modified_base (347)..(347): a, c, t, g, unknown or other
  modified_base (358)..(358): a, c, t, g, unknown or other
  modified_base (362)..(362): a, c, t, g, unknown or other
  modified_base (379)..(379): a, c, t, g, unknown or other
  modified_base (382)..(382): a, c, t, g, unknown or other
  modified_base (398)..(398): a, c, t, g, unknown or other
  modified_base (417)..(417): a, c, t, g, unknown or other
  modified_base (437)..(437): a, c, t, g, unknown or other
  modified_base (451)..(451): a, c, t, g, unknown or other
tcagcgcagtacgacacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgaaccagcaatgactattgacttataattntgtctctgtaccaacaactaccccggacaaacgtccccaaactcatgacttctttgaggtcagtgacgtcggcccgngtagggttcncatcgctccnccgctcagtcnggcngcacgcctcctcgaccntcncgtggctccgagtcgngagacgagctatatatacngcatcatataacaacaaaanacgaactgttgggngtccgggacgacggaacacgtcgtaccgtctacgcacgaccgaacgtccacccgcccgtacgtcctaccgttcctccg

SEQ ID NO: 420974 - DNA, 698 bp, Homo sapiens
  misc_feature: GZ8MTXP02IKG4V.52.37.D04.1.454.CMB.2.raw
  modified_base (215)..(215): a, c, t, g, unknown or other
  modified_base (236)..(236): a, c, t, g, unknown or other
  modified_base (483)..(483): a, c, t, g, unknown or other
tcagcgcagtacgacacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctccngcactggaaccagcaataaanctattggtacttataattctgtctctgtaccaaacactacccgacaaacgtaccccaaactcatgatctttgaggtcagtgactccggacccgcgtaggggtttcctcacgtccgtcctttcccgtccccgggtacctacccgaacgttccgtggccacggtcccaccgggtcccctaccccgtcgacctagtcctcgtcgggaccttccgacggcgtaggacggtaccggaggtcttagaactttnttaaaccgtcgacacggtaccttacaattaaacctaaaaccaaacgtaacgtaaaccgttacgggttagggggttacgtttaccgggggaccggggaaaccggtaacccgtaaaacgttaccggtaacccgttacccgttccggtaaaccaccggacccgtaaacggtccccgtacccggtaccccgttcggtaccctacgttcccgtttacccg

SEQ ID NO: 420975 - DNA, 685 bp, Homo sapiens
  misc_feature: GZ8MTXP02IYIY5.52.37.D04.1.454.CMB.2.raw
  modified_base (670)..(670): a, c, t, g, unknown or other
  modified_base (673)..(673): a, c, t, g, unknown or other
  modified_base (676)..(676): a, c, t, g, unknown or other
  modified_base (680)..(682): a, c, t, g, unknown or other
  modified_base (684)..(685): a, c, t, g, unknown or other
tcagcgcagtacgacacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcacatctctgcactggaaccagcaatgactagtttggggttctctactcgtcttcctccggcctcctaagtctggcacgccgaccggccctcccctgaccactctcgtcgggcctccgaggtcgtaggacggacgcggccttagtactttaacttacctcggacacggtccttactaattaaacctaaccgaaaaaccgtaaacggtaaaaccttccgggtttagggggttacgggttaccgggggtacccgggaaaccgggtaaaccctaaacggtcggaaccccgttcgtaccgtacacccggtaacccgaacgggtccgtccccgtacccccggttccggtccctaaccggttccccgttccgtttccccccgtccccttccccttaacgtaccgttaaccgcgttcccggctacgggacggtccccggggacgtcgggaacggacgaccgtacgtaacgcgngcngcncgcnnncnn

SEQ ID NO: 420976 - DNA, 702 bp, Homo sapiens
  misc_feature: GZ8MTXP02IH1H7.52.37.D04.1.454.CMB.2.raw
tcagcgcagtacgacacgaccggtgctcgatttagtagcatactgttgggtttggggggggtctcaggaggcagcgctctcgggacgtctccaccatggcctgggctctgctattcctcaccctcctcactcagggcacagggtcctgggcccagtctcgccctgactcagcctgcctccgtgtctgggtctcctggacagtcgatcaccatctcctgcactggaaccagcaatgactattgtacttatacttctgtctcgtagtaccaaacaacgtaccccgacaaaccgtaccccaaactcatagtatcgtttgagtctaagtgaacgtcccggcccgtaggttacgggttcctacgactccgtccttcccccgtcccggtccttaccgaagttccgtcggacccacggcccgtaaccggtcccccttaccctaccggtacctacgtttcccgttccgggtacggtcccgttaccggacggtacgtacggggaacggtaccgaacggtccgtagttaacttacgtacttcggaccacgtacctacaacttaaacaaacaaactaacgtaaaccgttggtttcggggtacggttcgggaaccgggtaccggtaaaacccaacgttccggtaaccctacgttaccgaccaccggtacccgaagtcccgtcccgtacccgtacggtcctaaccgtcttccccg

SEQ ID NO: 420977 - DNA, 528 bp, Homo sapiens
  misc_feature: GZ8MTXP02FK7ND.52.37.D04.1.454.CMB.2.raw
  modified_base (362)..(362): a, c, t, g, unknown or other
  modified_base (416)..(416): a, c, t, g, unknown or other
  modified_base (423)..(423): a, c, t, g, unknown or other
  modified_base (427)..(427): a, c, t, g, unknown or other
  modified_base (438)..(438): a, c, t, g, unknown or other
tcagcgcagtacgacacgaccggtgctcgatttagtagcatactgttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtaacttataattctgtctctggtaccaacaataccccggcaaagtccccaaactcatgatctttgagtcagtgatcggcccgcaggggtttctcatcgtcttcctccggctcaagtctggcngccacggcctcctcgaccatctcgtcggctccgaggctgagacgaggctgattntactgcngctnatataacaaanacgaaatacgtgggtgttcgggcggaccgggaacaaacgtacgaccgtactacgtcagacccgaagcctcgcccctggtccactctcccg

SEQ ID NO: 420978 - DNA, 664 bp, Homo sapiens
  misc_feature: GZ8MTXP02FRV3Y.52.37.D04.1.454.CMB.2.raw
  modified_base (395)..(395): a, c, t, g, unknown or other
  modified_base (467)..(467): a, c, t, g, unknown or other
  modified_base (619)..(619): a, c, t, g, unknown or other
tcagcgcagtacgacacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatcctcctgccactaggaaccagacaaatgactagttaggtacttatacttctgtctcgtagtaccaaacaacgtaccccggacaaacgtaccccaaactcatgtattcgttagaggtcaggtagacgtccggcccgcgtacggggtttctcgactcgtcttacccgtccgtctaccagtctgcncgcgaccggtccctcccgtcgtaacctcgtcctccggtcggtccaccgaggtcctagggacggacgtacggnttacgttattacttagcacagtcctataacgtaactaaaccgaaactaaacgtaacgttcggttaacgggtcgggttacggggaccgggaaccggtaaaaccaaccggtccggtaccctacgttaccgaacgaccgtaaccggaaccgtccnccccggttacccgtccgtaaccttcccggttccccttaacccccg

SEQ ID NO: 420979 - DNA, 667 bp, Homo sapiens
  misc_feature: GZ8MTXP02HWZYC.52.37.D04.1.454.CMB.2.raw
  modified_base (229)..(229): a, c, t, g, unknown or other
  modified_base (260)..(260): a, c, t, g, unknown or other
  modified_base (338)..(338): a, c, t, g, unknown or other
  modified_base (348)..(348): a, c, t, g, unknown or other
  modified_base (456)..(456): a, c, t, g, unknown or other
tcagcgcagtacgacacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaaccngcaaatgactagttaggtacttataacttcngtctcctaggtaccaaacaactaccccggacaaaacgtccccaaactcaatgattctttgagtcagtgactcggccgngtagggttcncatcgtcttccccgtccgcgtaccagtcgtcggcacgccgtaacggcccttaccacgtaccattctaccgtcgggacctcgacggtcgagacgggtaccgaggttacnccggtaatttacgacgtacggcacgtccttaaactaaataactaaacgaaaaccgtaaacgtaaaccgtacggttacgggtacggtacggggaaccggtaaccggaaaccgtaaccgtaccgtaacccgtaccgttaccgacgtaacccgacccgtaaccggtcccgtaccccggtccccgttaccgtacccgtaccgttccccgtacccg

SEQ ID NO: 420980 - DNA, 697 bp, Homo sapiens
  misc_feature: GZ8MTXP02FY28Y.52.37.D04.1.454.CMB.2.raw
tcagcgcagtacgacacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacctatctcctgcacgtggaaccagcaatgactattgtacttatattctgtctctagtaccaaacaaccgtacccgacaaacgtaccccaaactcatgaattcgtttagaggtcagtgacgccggaccgcgtcgggttacactgtccgtctccccgtccgtcctacgacgttcgtacgacgcgaccgacccggtcctacccgtacgtaacctcgttcccgtcgtcgggtcccttaccggacgggttccgtaaaggggaacgggaaccggtaggtaccggttagttaaaccgtttaaactttaccggcgttaacgacttacctaacgttaaaacgttaaacgtaaaacaaaacggtaaacgtaaaacgtttaacgggtttggggtacccgtcgggaacccgggtaacgaaacgaaacgtcgtaacccgtactacgtccgaaccgaccgtaacgccgttcccgacccgttacggtacctcttaccgttccccg

SEQ ID NO: 420981 - DNA, 602 bp, Homo sapiens
  misc_feature: GZ8MTXP02FMTBK.52.37.D04.1.454.CMB.2.raw
  modified_base (228)..(228): a, c, t, g, unknown or other
  modified_base (281)..(281): a, c, t, g, unknown or other
  modified_base (325)..(325): a, c, t, g, unknown or other
  modified_base (356)..(356): a, c, t, g, unknown or other
  modified_base (368)..(368): a, c, t, g, unknown or other
  modified_base (430)..(430): a, c, t, g, unknown or other
  modified_base (438)..(438): a, c, t, g, unknown or other
tcagcgcagtacgacacgaccggtgctcgatttagtagcatactgttggggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcatggaaccngcaatgacattggtacttatatctgtctcctggtaccaaacactaccccgganaaacgtccccaaactcatgatcttgaggtcagtgatcggcccgngaggggtttctcatccgtctccctccggtcnccaagtctggcngccacggcctccctgactatctcgtcggctccgagctggagaccggaagctgaattattacngcacgcanaactataaccaaaacacgtaaactacgttgggggagttcggggaccggacggggaaaccctaaaacggtacgaacccggttaccctaaccggttaccgaacgaccccgtaacggtaccgtacccgccccccgttcggtaccctaaccgtcccgtttaaccccgg

SEQ ID NO: 420982 - DNA, 713 bp, Homo sapiens
  misc_feature: GZ8MTXP02FSMGN.52.37.D04.1.454.CMB.2.raw
  modified_base (293)..(293): a, c, t, g, unknown or other
  modified_base (323)..(323): a, c, t, g, unknown or other
  modified_base (334)..(334): a, c, t, g, unknown or other
tcagcgcagtacgacacgaccggtgctcgatttagtagcatactgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgactattgtacttatatctgtctctgtacacaactacccggacaacgtaccccaaatcangtatctttagagtcagtgtagccggcccgngtcgggtttcncatcgtccttcccgtccggcctacgaacgttcgtgggcctacgcgacccggtcctacccctacgacctactcctccgtcgggtccctcgaacggtcgtacggaacgggaccggacggtccgttagtaaacgttacgttaacgttccgacgtaaccgcttaccctaaaagttaaacaaaacccttaaaacaaacggtaaaaacgttacggggtttcggggttaacgggggttaccggggaccggggtaaacccgggtaaaccgtaaaaccgtaccggggtaaccccgttaacccgttaaacggtaccaaccgggaacccgtaacggtcccgtaacccgtcccccggttacggtaccctaaccgtttccctttaacccccg

SEQ ID NO: 420983 - DNA, 767 bp, Homo sapiens
  misc_feature: GZ8MTXP02J13CK.52.37.D04.1.454.CMB.2.raw
  modified_base (201)..(201): a, c, t, g, unknown or other
  modified_base (232)..(232): a, c, t, g, unknown or other
  modified_base (320)..(320): a, c, t, g, unknown or other
tcagcgcagtacgacacgaccggtgctcgatttagtagcatactgttgggtttggggggggtctcaggaggcagcgctctcgggacgtctccaccatggcctggggctctgctattcctcaccctcctcactcagggcacagggtcctgggcccagtctgccctgactcagcctgcctccgtgtcctgggtctcctggacngtcgatccaaccatctctgcacgtggaaccngcaatgactatttcggactttatattctgttctcgtgaccaacactacccgacaagtccccaaactcatgtacttcttgtacggtacngtgatccggtccgtcgtaggggttctcgtactccgtccttacccgtcccggtctacccgaacgttcgtacggtaccgccggtaccgaacccggtcccctccctacggtaaaccctcgtcccgtccgtaccggggtacctcccggaacgggtccgttacggggacggggtaccgtaccgggtacgtttggtaacgtttaaactttaccggttcgacgttacggccctaacgttaacctaaaccgttaaacaaaccgtaaacgtaaacccggttacggtttaaccgggggttcggtttaacccgggcccgggttaaaccgggaaaaccccgtaaaaccggttccggtaacccgggtttacccaacgggttaccaacccgaccccggaaaggttacccccgacccgttccccgtcccggtttaacctaccccttcccggtttaacccccg

SEQ ID NO: 420984 - DNA, 596 bp, Homo sapiens
  misc_feature: GZ8MTXP01D95CT.51.37.D04.1.454.CMB.2.raw
  modified_base (305)..(305): a, c, t, g, unknown or other
  modified_base (307)..(307): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttggctgagcgtggtttcgtgtagctatatagagtgtccagtgtcaggtgcagctggtggaatctgggggagcttggtcaagcctggaggtccctgagctctcctgtgcagctctggatcactcatggctacttcatgagctgatccgccagctccaggaagggcgtggngngtggtctccactatatagtgtaactaagtggacgaaccaactactacgtacgacgacgtactacgtaggaggaacgggaccgtacgttactacctactacgtaccgacggaacgaaccgaaccgaaacgtaactactactacgtactacgtacgtactaaactaacgtaacgtaacgtaacgtaaacgaacgaaccgaaacggaaccgaccggtaccggttacgttacgttcgttcggtcggtacggtaacggtagggtaggggagggtaacgggttaacggtaacggg

SEQ ID NO: 420985 - DNA, 524 bp, Homo sapiens
  misc_feature: GZ8MTXP01E4AY2.51.37.D04.1.454.CMB.2.raw
  modified_base (312)..(312): a, c, t, g, unknown or other
  modified_base (357)..(357): a, c, t, g, unknown or other
  modified_base (408)..(408): a, c, t, g, unknown or other
tcagcgatcgtatacacgaccggtgctcgatttagtagcatactgttgggtttggggtgggtccaggaggcagaactctgggtgtctcaccatggcctggatccctctacttctcccctcctcactctctgcacaggctctgaggcctcctatgagctgacacagccagcctcggtgtcagtgtccccaggacagacggccaagatcccctgctctggagatgcattgaccaaaacgatttgctttttggtaccaacagaagccaggccaggcccctataataattatatataaagacagtgagaggccctnagggatccctgagcgattctctggcctccagctcagggaacaacngccagttgacgattagtggagtccaggcagaagacgaggctgactattacngtcaatcaggcaagacgacagtggtacttagtggagtattcggcggaagggaaccaaagggttgaccgttcgtagggtcagccaagggctgccccgtggtcacgtcttcgttcccc

SEQ ID NO: 420986 - DNA, 517 bp, Homo sapiens
  misc_feature: GZ8MTXP01EHSWX.51.37.D04.1.454.CMB.2.raw
  modified_base (360)..(360): a, c, t, g, unknown or other
  modified_base (387)..(387): a, c, t, g, unknown or other
  modified_base (403)..(403): a, c, t, g, unknown or other
  modified_base (428)..(428): a, c, t, g, unknown or other
  modified_base (438)..(438): a, c, t, g, unknown or other
  modified_base (441)..(441): a, c, t, g, unknown or other
  modified_base (443)..(443): a, c, t, g, unknown or other
  modified_base (445)..(445): a, c, t, g, unknown or other
  modified_base (489)..(489): a, c, t, g, unknown or other
  modified_base (491)..(491): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtgggttttcctgttgctattatagaaggtgtccagtgtcaggtgcagctggtggaatcgtggggggagctttgggtcaagccgtgggagggtccctgagactctcctgtgcagcctctggatcaccttcagtggctacttcatgagctggactcccgccaggcctccgagggggaagggctgcaggtggctcacatattagtgaacttaaagngggaacaaccacatttcacgcagactnggagaagggcattccncatcacgagacaacgacaagtactnatgatcaganaanananatacaagaacgacgaacgacgacgcgtcgttacgttcgttgtgngnggtggtgggaggtaaggaacggtaag

SEQ ID NO: 420987 - DNA, 511 bp, Homo sapiens
  misc_feature: GZ8MTXP01BKB8V.51.37.D04.1.454.CMB.2.raw
  modified_base (335)..(335): a, c, t, g, unknown or other
  modified_base (351)..(351): a, c, t, g, unknown or other
  modified_base (377)..(377): a, c, t, g, unknown or other
  modified_base (392)..(392): a, c, t, g, unknown or other
  modified_base (397)..(397): a, c, t, g, unknown or other
  modified_base (419)..(419): a, c, t, g, unknown or other
  modified_base (484)..(484): a, c, t, g, unknown or other
  modified_base (486)..(486): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtgggtttcctgttgctattatagaggtgtccagtgtcaggtgcagctggtggaatcgtgggggagcttggtcaagcctggagggtccctgagactctcctgtgcagcctctggatcaccttcagtggctacttcatgagctggatccgcaggctcgagggagggctgcaggtggtctcacatattagngactaaagtggggaanaaacccatatttcacgcagacttcgngaagagggccattcncatcncgagggacaacgccaaggactnactgatcagacaatagtaacagtacaagaagacgacgacgacggcgtcgttacgttcttgtgggngnggtggtgggaggtaaggaacgtaag

SEQ ID NO: 420988 - DNA, 571 bp, Homo sapiens
  misc_feature: GZ8MTXP01DSPT1.51.37.D04.1.454.CMB.2.raw
  modified_base (280)..(280): a, c, t, g, unknown or other
  modified_base (289)..(289): a, c, t, g, unknown or other
  modified_base (303)..(303): a, c, t, g, unknown or other
  modified_base (307)..(307): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtggtttctgtagctatatagagtgtcagtgtcagtgcagctggtggaatctgggggagcttggtcaagcctggaggtccctgagctctcctgtgcaagctctggatcacttcagtggctacttcatgagctgntcgccagcnccaggaagggcggngcgngtgtctccactatatagtgaataagtggacgaacactactactacgacacgactacgtaggaggaacggtacgtacttactacctactaccgtaccgacgaacgaacgaccgaacgtaactactactacgtactacgtacgaactaaataacgtaacgtaacgtaacgtaaacgaacgaacgaaacgaacgaccggtaccgttacgttacgttcgttacgtgtacggtaaggtagggtagggaggtaacggttaacggtaacgg

SEQ ID NO: 420989 - DNA, 533 bp, Homo sapiens
  misc_feature: GZ8MTXP01DBY60.51.37.D04.1.454.CMB.2.raw
  modified_base (337)..(337): a, c, t, g, unknown or other
  modified_base (353)..(353): a, c, t, g, unknown or other
  modified_base (514)..(514): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctggagggtccctgagactctcctgtgcagcctctggatcaccttcagtgctactcatgagctggatccgcaggctcgaggggagggctgcagtggtctccacatattagngactaaagtggggaanaaacccatattccacgcagacttcgtgtggaacgggcctattcctccatcctaccgagggacaacgccaaaggactcactgtatctagacaaaatcgaaactagtcctaaaggaacgccgaaagaccacgggtcctgttaccttcgttgtgcgtaagtggngggagtaaggcgtaacggg

SEQ ID NO: 420990 - DNA, 509 bp, Homo sapiens
  misc_feature: GZ8MTXP01CMPDG.51.37.D04.1.454.CMB.2.raw
  modified_base (355)..(355): a, c, t, g, unknown or other
  modified_base (361)..(361): a, c, t, g, unknown or other
  modified_base (477)..(477): a, c, t, g, unknown or other
  modified_base (490)..(490): a, c, t, g, unknown or other
  modified_base (496)..(496): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggaggcttggtcaagcctggagggtccctggagactctcctgtgcagcctctggatcaccttcagtggctacttcatgagctggatccgccaggctccgagggaagggctgcagtgggtctcacatattagtgactaatgggganaaccanattcacgcagactctgagagggccgattctccatctcaggacaacgcaaggactcactgtatctgacaaatgaacagtactaagaagaccgaaagaccacgggccgtgttacttcnggtgcgaagttgngggagnggaacgtaacggg

SEQ ID NO: 420991 - DNA, 565 bp, Homo sapiens
  misc_feature: GZ8MTXP01DUEI7.51.37.D04.1.454.CMB.2.raw
  modified_base (347)..(347): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctggagggtccctgagactctcctgtgcagcctctggatcaccttcagtgctacttcatgagctggatcccgcaggcctccgaggggaaggggctgcaggtgggtctccacattagttagngaacttaagtggggaacaaacccatacttcctacgcagactcgtaggaaggacgggcctattcctccatccaccgaggaacaacgaccaaaggaactcaactgtatctgacaaatgaacagtacaaaggaacgaccgaaaggaccgacggtaccgtcgttacgttcgttggtggacggtaagggttggagggggagaacggggttaaccgttaagggg

SEQ ID NO: 420992 - DNA, 525 bp, Homo sapiens
  misc_feature: GZ8MTXP01AJVWQ.51.37.D04.1.454.CMB.2.raw
  modified_base (355)..(355): a, c, t, g, unknown or other
  modified_base (396)..(396): a, c, t, g, unknown or other
  modified_base (433)..(433): a, c, t, g, unknown or other
  modified_base (489)..(489): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccctgagactctcctgtgcagcctctggatcaccttcagtgctacttcatgagctggatccgccaggctccgaggggaagggctgcaggtgggtctcacatattagtgactaagtgggganaaaccactattctacgcagactctgtgaagggccgatttcncatctaccgagggacacgacaaggaactcgactgtanctgacaaatgaaacagtacaagaagccgaaagaccgaggcccgtagttaccttcgnggtgcgtaaggttggaggggagaagggctaacgggg

SEQ ID NO: 420993 - DNA, 530 bp, Homo sapiens
  misc_feature: GZ8MTXP01BWV8Y.51.37.D04.1.454.CMB.2.raw
  modified_base (261)..(261): a, c, t, g, unknown or other
  modified_base (337)..(337): a, c, t, g, unknown or other
  modified_base (346)..(346): a, c, t, g, unknown or other
  modified_base (352)..(352): a, c, t, g, unknown or other
  modified_base (375)..(375): a, c, t, g, unknown or other
  modified_base (392)..(392): a, c, t, g, unknown or other
  modified_base (398)..(398): a, c, t, g, unknown or other
  modified_base (493)..(493): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggagggtccctgagactctcctgtgcagcctntggatcaccttcagtggctactcatgagctggatccgcaggctcgagggagggctgcaggtggtctcacatatagngaactaagngggganaaaccacattctacgcagactcnggagaagggccattccnccatcnccgaggacaacgccaaggactcactgtactctagacaaatcgaaacagtactaaaggaacgacccgaaagaccgacgggtcccgtgttacttcgngtcgcgtaagtggtgggagtaagggaaccgtaacggg

SEQ ID NO: 420994 - DNA, 523 bp, Homo sapiens
  misc_feature: GZ8MTXP01DHWFB.51.37.D04.1.454.CMB.2.raw
  modified_base (287)..(287): a, c, t, g, unknown or other
  modified_base (344)..(344): a, c, t, g, unknown or other
  modified_base (358)..(358): a, c, t, g, unknown or other
  modified_base (365)..(365): a, c, t, g, unknown or other
  modified_base (492)..(492): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgcttattatagaaggtgtccagtgtcaggtgcagctggtggaatcgtgggggagctttggtcaagcctggagggtccctgagactctcctgtgcagcctctggactcaccttcagtggctacttnatgagctggatcccgcaggctcgagggagggctggcagtggtctcgactatattagngaactaagtggganaacccanattctacgcagactctgagaagggccattcctccatctccgagggacaacgccaaaggactcactgtatctgacaaatcgaacagtacaagaacgcgaagacacggtcctgttaccttgttggtcgnggtaaggtggcgggagtaacggttaacgtgg

SEQ ID NO: 420995 - DNA, 498 bp, Homo sapiens
  misc_feature: GZ8MTXP01EA7JJ.51.37.D04.1.454.CMB.2.raw
  modified_base (368)..(368): a, c, t, g, unknown or other
  modified_base (374)..(374): a, c, t, g, unknown or other
  modified_base (387)..(387): a, c, t, g, unknown or other
  modified_base (392)..(392): a, c, t, g, unknown or other
  modified_base (419)..(419): a, c, t, g, unknown or other
  modified_base (473)..(473): a, c, t, g, unknown or other
  modified_base (491)..(491): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgttgggttttcctgttgctattatagaaggtgtccagtgtcaggtgcagctggtggaatcgtggggggagcttggtcaagcctgggagggtccctgagactctcctgtgcagcctctggatcaccttcagtggctacttcatgagctggatcccgcaggctcgagggagggctgcagtggtctcacatattagtgaactaagtgggacaaccatattcacgnagactntgagaggcattcncatcncgaggacacgcaaggaactcactgtanctgacaaatgaacagtactaagaagacgagacgacgcgtcgttacttcttgtgngaagtggtggaggaaggngtaacgg

SEQ ID NO: 420996 - DNA, 614 bp, Homo sapiens
  misc_feature: GZ8MTXP01DO83P.51.37.D04.1.454.CMB.2.raw
  modified_base (178)..(178): a, c, t, g, unknown or other
  modified_base (262)..(262): a, c, t, g, unknown or other
  modified_base (359)..(359): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtntccagtgtcaggtgcagctgggtggaatcgtgggggagcttggtcaagcctgggagggtccctgagactctcctgtgcagcctntggatcaccttcagtgctacttcatgagctggatcccgcaggctccgagggggaagggctgcaggtggtctcacatatagtgaactaagtggggaanaaccacattctacgcagactcgtggaaggaacgggccgtaattcctaccctatcccgtaccgaaacggggaaccaaaccggaccccaaaaggggtaaacccttcaaaccgttgtaacttcgtagaacctaaaatcggtaaactacgttaacaaaggaacgaccggaaacgaccggaccggtacccgttgttaaccgtttcttaggtggacggtaagggttggggaggggaagtaacgggttaacgttaacggggg

SEQ ID NO: 420997 - DNA, 598 bp, Homo sapiens
  misc_feature: GZ8MTXP01EXDMF.51.37.D04.1.454.CMB.2.raw
  modified_base (243)..(243): a, c, t, g, unknown or other
  modified_base (407)..(407): a, c, t, g, unknown or other
tcagcgatcgtatacacgaccggtgctcgatttagtagcatactgttgggtttgggggtgggtccaggaggcagaactctgggtgtctcaccatggcctggatccctctacttctcccctcctcactctctgcacaggctctgaggcctcctatgagctgacacagccagcctcggtgtcagtcgtccccaggacagacggccaagactcccctgctctggagatgcattgacctaaaacgtnttttgtcttttttaggtaaccaaacagaagccaggccacggcccctaataaataattatataataaaagacagtgagacggccctagagggactcccgtgagcgattctctggccctccagctacgagggaaacaaacgcgaccacgttagaacgtatttaggnggacgtccgaggacaaggaagacggaggactagtactattacgtgtacaatcgaggacaagacgagagtggtacttagtaggtagtagtcgggacggaagggaaccgttttaagggcgtaccgttccgtaggtcgacggccgaacgggtcctccgcccccgtcggtccaccttccgttccgttaacccccg

SEQ ID NO: 420998 - DNA, 512 bp, Homo sapiens
  misc_feature: GZ8MTXP01DD3Z0.51.37.D04.1.454.CMB.2.raw
  modified_base (338)..(338): a, c, t, g, unknown or other
  modified_base (353)..(353): a, c, t, g, unknown or other
  modified_base (360)..(360): a, c, t, g, unknown or other
  modified_base (374)..(374): a, c, t, g, unknown or other
  modified_base (388)..(388): a, c, t, g, unknown or other
  modified_base (393)..(393): a, c, t, g, unknown or other
  modified_base (492)..(492): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccctgagactctcctgtgcagcctctggatcaccttcagtggctacttcatgagctggatccgcaggcctcgaggggagggctgcagtggtctcacatattagngactaagtggggaanaacccanattcacgcagactntgagagggccatcncatcncaggacacgcaaggactcactgatctgacaaaatgaaacagtactaaagaacgaccgaaagaccacgggccgtgttacgttcaggtgacgaaggttggnggggaagtgggaacttaagg

SEQ ID NO: 420999 - DNA, 663 bp, Homo sapiens
  misc_feature: GZ8MTXP01DQR0G.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtggggggagtcttggtcaagcctggagggtccctgagactctcctgtgcagcctctggatcaccttcagtgctacttcatgagctggactccgcaggcctccgagggggaaggggctggcgaggtgggtctcgactattaattagtgaactaaagtggggaaactaaacccactaatttccaaacggcaaaggtaccttgtaagggaacggaaacggggccctaatttcctacccattcccgaccgaaacggggaacccaaaacgggcccctaaaagtaaccctcgtaaaccgtttagttaactccgtaacgaaactaaaacgtaaacgtaaacgtaaacgtaaacgtaaacggaacggaaccggaaacggaaccgaccggtaccggttacgttacgttcgttcggtggtacggtaagggtgggtaggggacgggtaacgggttaacggtaacggg

SEQ ID NO: 421000 - DNA, 517 bp, Homo sapiens
  misc_feature: GZ8MTXP01E10QV.51.37.D04.1.454.CMB.2.raw
  modified_base (265)..(265): a, c, t, g, unknown or other
  modified_base (361)..(361): a, c, t, g, unknown or other
  modified_base (376)..(376): a, c, t, g, unknown or other
  modified_base (486)..(486): a, c, t, g, unknown or other
  modified_base (491)..(491): a, c, t, g, unknown or other
  modified_base (493)..(493): a, c, t, g, unknown or other
  modified_base (498)..(498): a, c, t, g, unknown or other
  modified_base (517)..(517): a, c, t, g, unknown or other
tcagcgatcgtatacacgaccggtgctcgatttagtagcatactgttgagctctgggagaagagccccagtcccagaattcccaggagtttccattaggtgatcagcactgaacacagaggactcaccatggagtttgggctgagcttgggttttccttgttgctattatagaaggtgtccagtgtcaggtgcagctgggtggaatcgtggggggagtcttgggtcaagcctgggagggtccctaagactctcctgtgcagcctntggattcaccttcagtggctacttcatgagctggactccgcaggctcgagggggagggctgcagtggtctcacatatagtgactaaaagtgggaanaaaccatattcacgnagactcagagaggccatcaccatcacgaggacaacgacaaagactcactgtaactctagacaaatgaactagtacctaaagcgaacgaagacacggttccgtgtacttgngttgngngtggngggagaggtaacttcgggn

SEQ ID NO: 421001 - DNA, 557 bp, Homo sapiens
  misc_feature: GZ8MTXP01B4RD3.51.37.D04.1.454.CMB.2.raw
  modified_base (340)..(340): a, c, t, g, unknown or other
  modified_base (527)..(527): a, c, t, g, unknown or other
  modified_base (539)..(539): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaggtgtccagtgtcaggtgcagctggtggaatcgtgggggagcttggtcaagcctgggagggtccctgagactctcctgtgcagcctctggatcaccttcagtgctactcatgagctggactccgccaggctccgagggggagggctgcagtggctcactatagtagngaacttaagtggggaactaaacccactattacacgcaagtactcgtaggaagaacggggccctaattcctaccaattccctaccggaagggaacccaaaccggacccaaaggggaaccttcaacttgtaactctgaacaaaatgaaacagtaccaaaggcgccgaaagcgacggcctagttaccttngtgcgaagtggngggagcggaacgtaaggg

SEQ ID NO: 421002 - DNA, 574 bp, Homo sapiens
  misc_feature: GZ8MTXP01AHCG2.51.37.D04.1.454.CMB.2.raw
  modified_base (252)..(252): a, c, t, g, unknown or other
  modified_base (272)..(273): a, c, t, g, unknown or other
  modified_base (276)..(276): a, c, t, g, unknown or other
  modified_base (278)..(279): a, c, t, g, unknown or other
  modified_base (282)..(282): a, c, t, g, unknown or other
  modified_base (291)..(291): a, c, t, g, unknown or other
  modified_base (302)..(302): a, c, t, g, unknown or other
  modified_base (306)..(306): a, c, t, g, unknown or other
  modified_base (315)..(315): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtggtttcgtgtagctatatagagtgtcagtgtcaggtgcagctggtggaatcgtgggggagcttggtcaagcctggagggtccctgagctctcctgtgcagcctntgatcacttcagtgctactnntgngnngcnccgcgagcncgagggaggcngcgngtgtctcanatagtagtgtaacgtagtggacgaacactacttactacgacacgtactacgtaggtaggtacggtacgtacttactacctactaccgtaccgacgaacgaaccgaccgaacgaactactacgtacgtactacgtagacgtaaactaacgtaacgtaacgtaacgtaacgaacgaaccgaacgaccgaccggtaccgtacgttacgttcgttcggtggtacggtaagggtgggtagggacggtaacggttaacgtaacgg

SEQ ID NO: 421003 - DNA, 577 bp, Homo sapiens
  misc_feature: GZ8MTXP01D34CO.51.37.D04.1.454.CMB.2.raw
  modified_base (416)..(416): a, c, t, g, unknown or other
  modified_base (558)..(558): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtgggttttcctgttgctattatagaaggtgtccagtgtcaggtgcagctggtggaatcgtgggggagcttggtcaagccgtgggagggtccctgagactctcctgtgcagcctcgtggatccacttcagtgctacttcatgagctggactccgcaggctcgaggggaagggctgcaggtggtctcgactatagtagtgaactaaagtggggaacaaacctacatttccacggcacgtacctgtaggtaggaacggggtccctatttccncctaagttcccaccggagggaaccaacgaccgaaaggacttcaacctgtaacttcagaactaaagtgaaacagttacaaaggcgaacggaaacgacgaaccggcgttagttaccgttcgttgtgcgtaaggttggagggganaacgggttaacgtaacggg

SEQ ID NO: 421004 - DNA, 509 bp, Homo sapiens
  misc_feature: GZ8MTXP01EOWJB.51.37.D04.1.454.CMB.2.raw
  modified_base (343)..(343): a, c, t, g, unknown or other
  modified_base (357)..(357): a, c, t, g, unknown or other
  modified_base (396)..(396): a, c, t, g, unknown or other
  modified_base (401)..(401): a, c, t, g, unknown or other
  modified_base (484)..(484): a, c, t, g, unknown or other
  modified_base (486)..(486): a, c, t, g, unknown or other
  modified_base (492)..(492): a, c, t, g, unknown or other
  modified_base (503)..(503): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttgggtcaagcctgggagggtccctgagactctcctgtgcagcctctggatcaccttcagtggctacttcatgagctgatccgcaggctccgaggggagggctgcaggtgggtctcgacatattagngactaagtgggganaaacccatatttcacgcagactctgagacgggccattcncatcncaggacacgccaaggactcatgatctgacaaatgaacagtacaaagaacgaccgagaacgcggccgtagttaccttgagtcgngnggtggngggagtaaggngtaagg

SEQ ID NO: 421005 - DNA, 543 bp, Homo sapiens
  misc_feature: GZ8MTXP01DW2M7.51.37.D04.1.454.CMB.2.raw
  modified_base (238)..(238): a, c, t, g, unknown or other
  modified_base (359)..(359): a, c, t, g, unknown or other
tcagcgatcgtatacacgaccggtgctcgatttagtagcatactgttgggtttggggtgggtccaggaggcagaactctgggtgtctcaccatggcctggatccctctacttctcccctcctcactctctgcacaggctctgaggcctcctatgagctgacacagccagcctcggtgtcagtgtccccaggacagacggccaagatcccctgctctggagatgcattgccaaaaacgntttgctttttggtaccaacagaagccaggccaggcccctataaataattatatataaagacagtgagaggccctcagggatcccctgagcgattctctggcctccagctcagggaacaacngccacgttgacgattagtggagtccaggcagaagacgagctgactatactgtcaaatcaggcagacgacagtggtacttataggagtattcgggcgggagggaaccaaagggttgaccggttccgtaagggtccagcccaaagggcctacgcccccgtgggtccacgtccttcggtttcccccg

SEQ ID NO: 421006 - DNA, 577 bp, Homo sapiens
  misc_feature: GZ8MTXP01BABEC.51.37.D04.1.454.CMB.2.raw
  modified_base (357)..(357): a, c, t, g, unknown or other
  modified_base (423)..(423): a, c, t, g, unknown or other
  modified_base (473)..(473): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgttgggttttccttgttgctattatagaaggtgtccagtgtcaggtgcagctggtggaatcgtgggggagcttggtcaagcctggagggtccctgagactctcctgtgcagcctctggatcaccttcagtggctacttcatgagctggactcccgccgaggcctccgagggggaagggggctgcgaggtgggtctccgactatagttaggngaactaaagtggggaaacaaacccatatttccacgcagacctgtggtagaacggggcctatttccncctaatcctaccgaagggaccaacgccaaaggactcactagtatccgtanaacaaatcgtaaacagtaacgaagaacgacgaaacgaccgaccggtcgtagttaccgttcgttggtgacggtggtcgggtaggggagtaacggaacgtaacggg

SEQ ID NO: 421007 - DNA, 634 bp, Homo sapiens
  misc_feature: GZ8MTXP01BKKRC.51.37.D04.1.454.CMB.2.raw
  modified_base (266)..(266): a, c, t, g, unknown or other
  modified_base (364)..(364): a, c, t, g, unknown or other
  modified_base (420)..(420): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagtcgttggtcaagcctgggacgggtccctgacgactctcctgtgcacgcctntggatcacctcagtgctacttcatgagcgtggactcccgcaggcctaccggagggggaggcagcaggtcggtctacactattagtagtgaacttaagngggaacaaaccactatttaccacgacagacttcgaggtagacgggtccatttaccnccgtatccgaccgaagggaaccaacgacccgaaaggtactaccgatcgtaactcgtacgaactaaagtcgaaacgtacgttaaccgaaaggaacgtaaacccggaaacgaaccccgttacgggttaccccggttaagttacccgtttggttacgggttgaccggggtaaggttggggacggggaagggtaacggttaaccggttaaaccggggg

SEQ ID NO: 421008 - DNA, 563 bp, Homo sapiens
  misc_feature: GZ8MTXP01DTJRG.51.37.D04.1.454.CMB.2.raw
  modified_base (246)..(246): a, c, t, g, unknown or other
  modified_base (385)..(385): a, c, t, g, unknown or other
tcagcgatcgtatacacgaccggtgctcgatttagtagcatactgttgggtttgggggtgggtccaggaggcagaactctgggtgtctcaccatggcctggatccctctacttcctccccctcctcactctctgcacaggctctgaggcctcctatgagctgacacagccagcctcggtgtcagtcgtccccaggacagacggccaagactcccctgctctggagatgcattgaacctaaaacgtntttgtctttttaggtaccaacagaagccaggccaggcccctaataataatatataataaagacagtgagacgccccaggactccgtgagcgtattctctggctcccagctcgaggacaaacagccagttgacgattagnggacgtcagcagaagacgagctagactatactgtacaatcagacagaacgacagtggtaacttagtggaagttgttcgggacggagggaacccgaaagggtcgaccggttccgttagggtacacgacccgaaggccttcggacccctcggtcaccgttcttccgttcccctaaccccg

SEQ ID NO: 421009 - DNA, 585 bp, Homo sapiens
  misc_feature: GZ8MTXP01DSQGP.51.37.D04.1.454.CMB.2.raw
  modified_base (340)..(340): a, c, t, g, unknown or other
  modified_base (356)..(356): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctggagggtccctgagactctcctgtgcagcctctggatcaccttcagtgctacttcatgagctggatccgcaggcctcgaggggaagggctgcaggtggtctcactatattgngaactaagtggggaanaaaccactattcacgcagactcgtggtaggaacggggccctatttcctaccattcccgtaccgaacggggaaccaaacggcccaaaagggtaaaccttcaacttgtaacttccgtagaacaaaatgaaaccaggttaccaaaggaacgacccgaaaggaccaccgggtaccgtgttaacgttcttaggtgacgtaaggttggaggggagaagggttaacccgtaagggg

SEQ ID NO: 421010 - DNA, 610 bp, Homo sapiens
  misc_feature: GZ8MTXP01C21U9.51.37.D04.1.454.CMB.2.raw
  modified_base (242)..(242): a, c, t, g, unknown or other
  modified_base (259)..(259): a, c, t, g, unknown or other
  modified_base (291)..(291): a, c, t, g, unknown or other
  modified_base (296)..(296): a, c, t, g, unknown or other
tcagcgatcgtatacacgaccggtgctcgatttagtagcatactgttgggtttgggggtgggtccaggaggcagaactctgggtgtctcaccatggcctggatccctctacttctcccctcctcactctctgcacaggctctgaggcctcctatgagctgacacagccagcctcggtgtcagtgtccccaggacagacggccaagactcccctgctctggagatgcattgaccaaaacgttntttgtcttttagacaanagacgcagcacgacctaataataatatataanaaganagtagagacgcctagaggactccgtgacgcgtattctcgtcgccctaccagctacgaacggaaaccaacgcgaccgtacgttacgacgtagttaggtaggacgtacgaggacgaaggaacgacggagacgtacgtaacttacttacgtagtactaacgtcgaaggacgaagaacgacgtaggttagttacgttaggtaggtagttacgtcgggacgggaacgggaacgtaagggttacgtaccgttacgtaacggtcgacggcccgacggtcccgtcccgtccccgtcggtccttaccttccgttccgtccccg

SEQ ID NO: 421011 - DNA, 502 bp, Homo sapiens
  misc_feature: GZ8MTXP01AX35E.51.37.D04.1.454.CMB.2.raw
  modified_base (334)..(334): a, c, t, g, unknown or other
  modified_base (349)..(349): a, c, t, g, unknown or other
  modified_base (357)..(357): a, c, t, g, unknown or other
  modified_base (373)..(373): a, c, t, g, unknown or other
  modified_base (387)..(387): a, c, t, g, unknown or other
  modified_base (392)..(392): a, c, t, g, unknown or other
  modified_base (431)..(431): a, c, t, g, unknown or other
  modified_base (469)..(469): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccctgagactctcctgtgcagcctctggatcacttcagtggctactcatgagctggatccgcaggctcgagggagggctgcagtggtctcacatattagngactaaagtgggganaaacccanatttcacgcagactcngagagggccattcncatcncaggacacgcaaggactcactgatctgacaaatgaaacngttacaagaacgccgaaagccacggccgtgttaccttnttgtgcgaagtggtgggagtggaacgtaacggg

SEQ ID NO: 421012 - DNA, 645 bp, Homo sapiens
  misc_feature: GZ8MTXP01DBPY3.51.37.D04.1.454.CMB.2.raw
  modified_base (241)..(241): a, c, t, g, unknown or other
  modified_base (258)..(258): a, c, t, g, unknown or other
  modified_base (290)..(290): a, c, t, g, unknown or other
  modified_base (295)..(295): a, c, t, g, unknown or other
  modified_base (298)..(298): a, c, t, g, unknown or other
tcagcgatcgtatacacgaccggtgctcgatttagtagcatactgttgggtttgggggtgggtccaggaggcagaactctgggtgtctcaccatggcctggatccctctacttctcccctcctcactctctgcacaggctctgaggcctcctatgagctgacacagccagcctcggtgtcagtgtccccaggacagacggccaagactccctgctctggagatgcattgaccaaaacgttntttgtcttttagacaanagacgcagcacgacctaataataatatataanaaganagngagacgcctagaggactccgtgagtcgtattctcgtcgccctccagcgtacgaacggaaaccaacgcgaccgtaacggttacgaacgtaagttacggtacggacgtaccgaaggacgaaggaacgacggaggtactacgtaacttacttacgtacgtacaacgtacgaacggaacgaacggaaacgtacgtaagttacggttaacgttaaggtaggtaacggttacggtacggggaacgggaacgggtaaccgtaacgggttaccggtaccgttacggtacggtaccgaccggaccgacggtccgtcccggtccccgttcgtccttaccgttccgttcccgtccccg

SEQ ID NO: 421013 - DNA, 618 bp, Homo sapiens
  misc_feature: GZ8MTXP01BCFKM.51.37.D04.1.454.CMB.2.raw
  modified_base (240)..(240): a, c, t, g, unknown or other
  modified_base (293)..(293): a, c, t, g, unknown or other
tcagcgatcgtatacacgaccggtgctcgatttagtagcatactgttgggtttggggtgggtccaggaggcagaactctgggtgtctcaccatggcctggatccctctacttctcccctcctcactctctgcacaggctctgaggcctcctatgagctgacacagccagcctcggtgtcagtgtccccaggacagacggccaagatcccctgctctggagatgcattgaccaaaacgttntttgtcttttagacaacagagcagcacgaccctataataatatataataaganagtgagacgcctagaggactcccgtgacgcgtattctcgtcggccctaccgagcgtacgaacgggaaaccaaacgcgacccgtaacggttagaacgtaagttaggtagggacgtaccgaggacgaaggaagacggaggactagtaacttattacgtagtacaatcaggacgaaggacgacgtaggtacgttacgttagtaggtagttaggtcgggacgggaacggaacgtaagggttacgtaccggttacgtaacggtaccgacggcccgaacgggtccgtcccggtccccgttcggtcccttaccgttccgttcccgttccccc

SEQ ID NO: 421014 - DNA, 568 bp, Homo sapiens
  misc_feature: GZ8MTXP01AT3LC.51.37.D04.1.454.CMB.2.raw
  modified_base (253)..(253): a, c, t, g, unknown or other
  modified_base (255)..(255): a, c, t, g, unknown or other
  modified_base (260)..(260): a, c, t, g, unknown or other
  modified_base (269)..(269): a, c, t, g, unknown or other
  modified_base (344)..(344): a, c, t, g, unknown or other
  modified_base (353)..(353): a, c, t, g, unknown or other
  modified_base (544)..(544): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggaggtccctgagactctcctgtncngcctngatcacttnagtgctactcatgagctggatcccgccaggcctccgaggggagggctggcaggtcggtctccactattagttagngaactaagnggggaacaaacccactattcacgcagtactctaggtagaaggggccctattcctaccatccaccgagggaaccaacgacccaaagggactcaactgtaactcgtagacctaaagtcgaaacaggtaacaaggaacgacccgaaagacccgcgggtacccgtgttaccttcgttcggtgcggtaaggttggnggggaggaacggaacgtaacgggg

SEQ ID NO: 421015 - DNA, 501 bp, Homo sapiens
  misc_feature: GZ8MTXP01BZVYN.51.37.D04.1.454.CMB.2.raw
  modified_base (256)..(256): a, c, t, g, unknown or other
  modified_base (345)..(345): a, c, t, g, unknown or other
  modified_base (351)..(351): a, c, t, g, unknown or other
  modified_base (387)..(387): a, c, t, g, unknown or other
  modified_base (427)..(427): a, c, t, g, unknown or other
  modified_base (435)..(435): a, c, t, g, unknown or other
  modified_base (479)..(479): a, c, t, g, unknown or other
  modified_base (481)..(481): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtggtttctgtagctatatagaaggtgtccagtgtcaggtgcagctggtggaatcgtgggggagcttggtcaagcctgggagggtccctgagactctcctgtgcagcctntggatcaccttcagtgctacttcatgagctggatccgcaggctcgagggagggctgcagtggtctcacatattagtgactaagtggganaacccnattcacgcagactgtgtagagggccattcctcatcnccgaagggacaacgcctaaagactacactagtactcaganaatagtanagtacgtagaacgacgacgacgacgtcgtcgttcgttcttgtgngngtggtggaggtaacggcgtg

SEQ ID NO: 421016 - DNA, 672 bp, Homo sapiens
  misc_feature: GZ8MTXP01B9TBG.51.37.D04.1.454.CMB.2.raw
  modified_base (628)..(628): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcgaggtgcagcgtggtaggaatcggtgggggagtcgttggtacaagtccgtgggacgggtccctggacgactctcctgtgcacgcctcgtggatcacttcagtgctacttcatgagcgtggactcccgccgaggcctaccggagggggagggctggcaggtcggtctaccactattagttagtgaacttaaggtggggaaacaaaccctatactttccgaacggcacggacctttagagggaagggaaacggggtcccttaatttccccgtaccgtaacttcccgtaccggaaacggggaacccaaaccggaccccgtaaaaggggtaacccttcctaaccgtttaggttaacttcccggtaaacgaaactaaagtacgaaacgtacgtaaccgaaaggaaccggaaccgaacggaccgaccggtccgttagttaccgttcgnggtcgacgtgggtgggagggaacggtaacggttaacggtaaggg

SEQ ID NO: 421017 - DNA, 669 bp, Homo sapiens
  misc_feature: GZ8MTXP01DT047.51.37.D04.1.454.CMB.2.raw
  modified_base (266)..(266): a, c, t, g, unknown or other
  modified_base (293)..(293): a, c, t, g, unknown or other
  modified_base (340)..(340): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctgggtggaatcgtggggggagtcttggtcaagccgtgggacgggtccctgagtctctcctgtgcagcctntggatccacttcagtgctactcatganctgactccgcagctcgagggaggctgcaggtggtctcatatattagngaactaagtggggaacaaaccactactttccgaacggctaaggtaccttcgtagggtacggaaacggggtccctaagtttcccacctaagttcccgaccggaaacggggaacccaaaccggacccaaaaggggtaacctcgtaaaccttaggtaacttcctaaggaaccctaaaaaagttcgaaaacctaacggttaaccgaaaaggaaccggaaacccgaaaacggacccgttaaccggggtaccccgtttagtttaacccgtttcgttagggttcggaccggtaaggttgggggacggggagtaacgggttaacggttaaccggggg

SEQ ID NO: 421018 - DNA, 504 bp, Homo sapiens
  misc_feature: GZ8MTXP01ARLW2.51.37.D04.1.454.CMB.2.raw
  modified_base (331)..(331): a, c, t, g, unknown or other
  modified_base (339)..(339): a, c, t, g, unknown or other
  modified_base (393)..(393): a, c, t, g, unknown or other
  modified_base (398)..(398): a, c, t, g, unknown or other
  modified_base (477)..(477): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctggagggtccctgagactctcctgtgcagcctctggatcacttcagtggctacttcatgagctggatccgcaggctccgagggaagggctgcagtggtctccanatattagngactaagtggggataaaccacattctacgcagactcgtgagaacgggccattcncatcncagggacaacgccaaggactcgactgtatctgacaaatgaacagtactaaggaacgcgaagcacggcgtgttacttcgngtgcgaagtggtggagtggcgtaaggg

SEQ ID NO: 421019 - DNA, 613 bp, Homo sapiens
  misc_feature: GZ8MTXP01EL2I9.51.37.D04.1.454.CMB.2.raw
  modified_base (244)..(244): a, c, t, g, unknown or other
  modified_base (259)..(259): a, c, t, g, unknown or other
  modified_base (288)..(288): a, c, t, g, unknown or other
  modified_base (293)..(293): a, c, t, g, unknown or other
  modified_base (296)..(296): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcctcactctctgcacaggctctgaggcctcctatgagctgacacagccagcctcggtgtcagtcgtccccaggacagacggccaagactcccctgctctggagatgcattgacctaaaagttnttgtcttttagacanagagcagcacgacctataatatatataanaaganagngagacgccacgaggactcccgtagacgtcgtattcgtcgtcggtcccctccgagccgtacgaacggaaaccaacgaacggaccgtaacggttacggaacgtaagttagggtacgggtacgtaccgaggacgaaggaacggacggacggtactagtaacttaacgtacgtagtaacaacgtcgaaggacgaaggacgaacgtaggttagtaattaggtaggtagtaggtacgggacggaacgggaacgaggttacgtacgttacgtacgtcgacgccgacgtcctccgtcccgtcgtcttaccttccgttccgtcccg

SEQ ID NO: 421020 - DNA, 579 bp, Homo sapiens
  misc_feature: GZ8MTXP01A6B3J.51.37.D04.1.454.CMB.2.raw
  modified_base (255)..(255): a, c, t, g, unknown or other
  modified_base (260)..(260): a, c, t, g, unknown or other
  modified_base (271)..(271): a, c, t, g, unknown or other
  modified_base (347)..(347): a, c, t, g, unknown or other
  modified_base (364)..(364): a, c, t, g, unknown or other
  modified_base (370)..(370): a, c, t, g, unknown or other
  modified_base (379)..(379): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagtcttggtcaagcctggagggtccctgagctctcctgtgcngcctnggatcaccttnagtgctactcatgagctggactcccgccaggcctccggagggggaacgggctggcaggtggtctcactatattagngtaactaaagtgggaanaaccanacttcacgnaagctcgtaggagaacgggcctattccacctatccgacccgaagggaaccaaacgacccaaaggtaaccttcgaaccttgtaactccgtagaactaaagtcgaaactacgttacgaaaggaacgaacccggaaagaccgaccggtccgtgttaccttcaggtcgaggtaaggttggaggggaagtcgggaacgtaacggg

SEQ ID NO: 421021 - DNA, 533 bp, Homo sapiens
  misc_feature: GZ8MTXP01B4OWS.51.37.D04.1.454.CMB.2.raw
  modified_base (342)..(342): a, c, t, g, unknown or other
  modified_base (356)..(356): a, c, t, g, unknown or other
  modified_base (406)..(406): a, c, t, g, unknown or other
  modified_base (432)..(432): a, c, t, g, unknown or other
  modified_base (494)..(494): a, c, t, g, unknown or other
  modified_base (499)..(499): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaaggtgtccagtgtcaggtgcagctggtggaatcgtggggggagcttggtcaagcctgggagggtccctgagactctcctgtgcagcctctggatcacttcagtgctacttcatgagctggatccgccaggctccgaggggaagggctgcagtgggtctcgactatattagngaactaatgggganaaccactattcctacggcagactcgtagagaacgggcctattccacatcnccgagggacaacgaccaaggaacctnactgtatcagacaaatgaactagtactaaagcgacgaagaccgacggtccgtgttaccttgngtcgngtaaggtgggtgggagtaacgggaacgtaacggg

SEQ ID NO: 421022 - DNA, 526 bp, Homo sapiens
  misc_feature: GZ8MTXP01B5R7C.51.37.D04.1.454.CMB.2.raw
  modified_base (260)..(260): a, c, t, g, unknown or other
  modified_base (353)..(353): a, c, t, g, unknown or other
  modified_base (359)..(359): a, c, t, g, unknown or other
  modified_base (369)..(369): a, c, t, g, unknown or other
  modified_base (455)..(455): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaaggcccggagggtccctgagactctcctgtgcagcctntggattcacttcagtgctacttcatgagctggatccgcaggctccgagggagggctgcagtgggctcaccatattagtgctaaaagtgggaanaaccanattctaacgnagactctagaggaagggccattctccatctccagggacaacgcaaagaactcaactgtatctagcaaatgaaactagtactaaagngaacccgaaagttaccgacggccgtagtacttcgttgttgcgagtgtggggagacggaacgttcgggtaag

SEQ ID NO: 421023 - DNA, 689 bp, Homo sapiens
  misc_feature: GZ8MTXP01DW1RZ.51.37.D04.1.454.CMB.2.raw
  modified_base (196)..(196): a, c, t, g, unknown or other
  modified_base (210)..(210): a, c, t, g, unknown or other
  modified_base (546)..(546): a, c, t, g, unknown or other
  modified_base (578)..(578): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagngtggtaggatcggngggggagtcgttggtacaagccgtgggaggtcgccgtgacgtactctccgtgtcgcacgtcctcgtggtacttcctaccctttcgaggttcggtacctttactcatggacgtcgtggacctcccgaccgacgggtccgtaccgggaagggggacggggtcttggacgtacgggttcgggtccctacgtaactaatttaagttaggtacgtaacgttaagggacggggtaaaccaaaccctacttaacttacgtacgactaacgttcttcggtagggtagggaaaccgggtccttaactttccgacctactcccgaccggaaggaaccaaaccccgngtaaaacgtctctacgttagtactccggaaanaaactaacgtagtaaacgtacgtaaacgaaagccgaaacgtaacgcccgtacggtcgttacgttcgttgtggaggtcggtagggtagggagggtaacggttaacggtaacg

SEQ ID NO: 421024 - DNA, 612 bp, Homo sapiens
  misc_feature: GZ8MTXP01BUXRZ.51.37.D04.1.454.CMB.2.raw
  modified_base (578)..(578): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggacggtccctgagactctcctgtgcagcctgtggatccaccttcagtgctacttcatgagctggactcccgcgaggcctaccggaagggggagggctggctaggtcggtctccgactattagtagtgaaactaagtggggaactaaacccatatttccacggcaacgactcgtaggaacggaacgggtccctaatttcccaccctaattcccgaccgaacgggaaacccaaaccgaccccaaagggaaccttcgaacttaggtaactccgtagaacctaaaagtcgaaacctaggtaaccaaaggaacgaccgaaagaccgacggtcctagttacttcgttagtcggngtaaggttgggagggacgtaagggttaacgtggg

SEQ ID NO: 421025 - DNA, 578 bp, Homo sapiens
  misc_feature: GZ8MTXP01B65VF.51.37.D04.1.454.CMB.2.raw
  modified_base (265)..(265): a, c, t, g, unknown or other
  modified_base (277)..(277): a, c, t, g, unknown or other
  modified_base (287)..(287): a, c, t, g, unknown or other
  modified_base (345)..(345): a, c, t, g, unknown or other
  modified_base (535)..(535): a, c, t, g, unknown or other
  modified_base (552)..(552): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagtcttggtcaagccgtgggacgggtccctgacgactctcctgtgcagcctntggatcaccttnagtgctactnatgagctggatcccgcaggctccgaggggagggctgcaggtggtctcgatatattagngaacttaagtggggaacaaacccactattccgtaacgcaagacttcgtaggaacggaacggggccctaatttccctacctattcccgtaccgaacggggaaccaaaccgacccaaaggggaccttcaaccttgtactcgtagaacaaatcgaaacctagtacctaaggaacgacgaaagccgacggcgtnttaccgttgaggtgcgnggtggtgggagtaaggaacgtaaggg

SEQ ID NO: 421026 - DNA, 644 bp, Homo sapiens
  misc_feature: GZ8MTXP01BZH32.51.37.D04.1.454.CMB.2.raw
  modified_base (241)..(241): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcctcactctctgcacagtctctgaggcctcctatgagctgacacagccagcctcggtgtcagtgtccccaggacagacggccaagactcccctgctctggagatgcattgaccaaaagtntttgtcttttgacaacagaagccagccagccctataataattatatataaagacagtgagagcctgagggactcccgtgagcgtattctcgtcggccctccagcgtacgaacgggaaaccaaacgcgaccctaacggttagaaccggtagtttacgggtagggacgttacccgaagggaccaaagggaaacggaaccggaaggggtaccttaggtaaaccttaagttacgtcgttaacaaattcgaacggacgaaggaaccgaacgtaaggttcggttaacttaggtagggtagttaacggttcggggacgggaaggggtaaccgtaaagggttcggaccgttacgtaggtcacggcccgaggtcctccggccccgttggccttacctccgttccgttccccc

SEQ ID NO: 421027 - DNA, 539 bp, Homo sapiens
  misc_feature: GZ8MTXP01BT13W.51.37.D04.1.454.CMB.2.raw
  modified_base (270)..(270): a, c, t, g, unknown or other
  modified_base (332)..(332): a, c, t, g, unknown or other
  modified_base (509)..(509): a, c, t, g, unknown or other
  modified_base (513)..(513): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctggaggtccctgagactctcctgtgcagcctctggatcacttnagtgctactcatgagctggatccgcaggctcgagggaggctgcagtggctcactatattagngaacttaagtggggaacaaacccatacttcacgcagactcgtaggaggaacgggcctaatttccgaccaatccaccgaagggaacaaacgcccaaaggaacttcacgttgtaactcgtgaactaaatgaaactagtacctaaaggaacgaccgaaagacacggtcctgttaccttgngtgngtgtgggaggagtaacgttaacgtgg

SEQ ID NO: 421028 - DNA, 574 bp, Homo sapiens
  misc_feature: GZ8MTXP01A6BGH.51.37.D04.1.454.CMB.2.raw
  modified_base (338)..(338): a, c, t, g, unknown or other
  modified_base (353)..(353): a, c, t, g, unknown or other
  modified_base (360)..(360): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctgggtggaatcgtgggggagcttggtcaagcctggagggtccctgagactctcctgtgcagcctctggactcaccttcagtggctactcatgagctggactccgcaggctccgagggagggctgcagtggtctcacatatagngaactaagtgggganaacccanattctacgcagactctaggagaaggggccctattcctccatccaccgagggacaacgaccaaggaactcactcgtatctgacaaatcgaaacacgtactaaaggaacgaaccgaaaggaccgaccggggtacccgttggttacccctttgttcgggtcggacggtaaggtttcgggggtagggggacggtaagggttaaccggttaaccggggg

SEQ ID NO: 421029 - DNA, 566 bp, Homo sapiens
  misc_feature: GZ8MTXP01EYY6S.51.37.D04.1.454.CMB.2.raw
  modified_base (261)..(261): a, c, t, g, unknown or other
  modified_base (341)..(341): a, c, t, g, unknown or other
  modified_base (406)..(406): a, c, t, g, unknown or other
  modified_base (524)..(524): a, c, t, g, unknown or other
  modified_base (529)..(529): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtggggggagcttggtcaagccgtggaggtccctgagactctcctgtgcagcctntggatcacttcagtgctacttcatgagctggactccgcaggcctccgaggggagggctgcaggtggtctcacattatagngaactaagtgggaacaaaccactattctacgcaacgtctcgtaggaaggaacgggccactttccnccgtaatccctaccgacgggaaccaaacgacccaaaggaactcgaacttgaatctagacaaatcgaaactagtacaaggaacgaaccgaaagaccgaccggtccgttagttacgttcnggcgngtaaggtggtggggaagtaacgggttaacgtaacggg

SEQ ID NO: 421030 - DNA, 502 bp, Homo sapiens
  misc_feature: GZ8MTXP01DDUCB.51.37.D04.1.454.CMB.2.raw
  modified_base (336)..(336): a, c, t, g, unknown or other
  modified_base (350)..(350): a, c, t, g, unknown or other
  modified_base (386)..(386): a, c, t, g, unknown or other
  modified_base (392)..(392): a, c, t, g, unknown or other
  modified_base (421)..(421): a, c, t, g, unknown or other
  modified_base (434)..(434): a, c, t, g, unknown or other
  modified_base (478)..(478): a, c, t, g, unknown or other
  modified_base (485)..(485): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggtttccttgttgctattatagaaggtgtccagtgtcaggtgcagctggtggaatctgggggagcttggtcaagcctggagggtccctgagactctcctgtgcagcctctggatcaccttcagtgctactcatgagctggatccgccaggctccgaggggaagggctgcagtgggctcacatattagngactaatggggaanaaccatatctacgcagactctgtgaagggccattcnccatcnccagggacaacgccaaggaactcatgtanctgcaaatgaaanagtctaaagaagccgaagacacggccgtgttacttcttgtgagnggtgggngggagaacggcgtaagg

SEQ ID NO: 421031 - DNA, 651 bp, Homo sapiens
  misc_feature: GZ8MTXP01DNF7N.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagttgggctgagcttgggttttccttgttgctattatagaaggtgtccagtgtcaggtgcagcgtggtggaatcgtgggggagtcttggtcaagccgtgggacgggtccctgacgtactctcctgtcgcagcctgtggtactccaccttcagtcgtctacttcatgagctggactcccgcgaggccgtaccggaagggggaacgggtctggcgtaggtcggtcctacgactagttagttagtcgaacttaaaggtggggaaacaaacccatactttccgacgcaacgtaaccttcgaagggaacggaacggggtcctatttcctaccgacttcccgaccgaacgggaaccaaaccgaccgaaacggtaactcctagtagtactcgtagaactaaaagtcgaaactagttaaccgaaaggaacggaaccgaaacgtaaccgacggtacccgttgttacccgttgcgggtaagcgggtaaggttggggagggaacggtaacggttaaccggttaaacgggg

SEQ ID NO: 421032 - DNA, 572 bp, Homo sapiens
  misc_feature: GZ8MTXP01CXILJ.51.37.D04.1.454.CMB.2.raw
tcagcgatcgtatacacgaccggtgctcgatttagtagcatactgttgggtttgggggtgggtccaggaggcagaactctgggtgtctcaccatggcctggatccctctacttctcccctcctcactctctgcacaggctctgaggcctcctatgagctgacacagccagcctcggtgtcagtgtccccaggacagacggccaagactcccctgctctggagatgcattgaccaaaacgtatttgtctttttaggtaaccaacagaagccaggccaggcccctataataattatataataaagacagtgagacggccctgagggatcccgtgagcgtattctctggccctccagctacgagggaaaccaacgcgaccaacgtttgacgtattagtgggatccgaggcagaagacgagctagactagttactgtacaatcaggcagacgacagtgtacttagtaggtagtagttcgggacgggagggaaccgaaggttggacccgttcgtaaacggtcaccggccgaaggcctccggccccgttagggtccacgttccgttccgttaaccccc

SEQ ID NO: 421033 - DNA, 542 bp, Homo sapiens
  misc_feature: GZ8MTXP01DZCUY.51.37.D04.1.454.CMB.2.raw
  modified_base (263)..(263): a, c, t, g, unknown or other
  modified_base (342)..(342): a, c, t, g, unknown or other
  modified_base (356)..(356): a, c, t, g, unknown or other
  modified_base (361)..(361): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttggctgagcttgggttttccttgttgctattatagaaggtgtccagtgtcaggtgcagctggtggaatcgtggggggagcttggtcaagccgtgggacgggtccccgagactctcctgtgcagcctntggattcaccttcagtgctacttcatgagctggactccgccaggctccgaggggagggctgcagtggctcacatattgngctaaagtgggaanaaccnattcacgcagactcgtgtggaacgggcctattccacatcctccgaggaccaacgaccaagaactcaactgtactctgacaaatacgaaactgtacgaaagcgaaccgaagaccgacgggttccttagtacttcgttggttgcggtagtgggtagggacgttaggtaacgttaacggtaacg

SEQ ID NO: 421034 - DNA, 575 bp, Homo sapiens
  misc_feature: GZ8MTXP01DHW98.51.37.D04.1.454.CMB.2.raw
  modified_base (169)..(169): a, c, t, g, unknown or other
  modified_base (287)..(287): a, c, t, g, unknown or other
  modified_base (350)..(350): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagttgggctgagcgtggtttctgtgctatatagagtntcagtgtcaggtgcagctggtggaatcgtggggggagtcttgggtcaagccgtgggacgggtccctgagctctcctgtgcagcctcgtggtatccaccttcaggtgctacttcatgancgtgatccgcaggctcgagggagggctgcaggtggtctaccatattagttagtgaacttaagnggggaacaaaccatacttcacggcagacctgagaaggacgggcctattcctacattccgaccgacggaaccacggaccaaacgtactactaactgtaactcgtaacgaactaaatacgaaactacgtaacgaaaggaacgaacgaaacggtaccgaccggtcgttacgttacgttcgttggtcggaggtaaggtggggagggacggtaacggttaacggtaacgg

SEQ ID NO: 421035 - DNA, 739 bp, Homo sapiens
  misc_feature: GZ8MTXP01C7SNX.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgcttattatagaaggtgtccagtgtcaggtgcagcgtggtggaatcgtgggggaggcttggtcaagccgtgggacgggtccccgagacctctcctgtgcagcctctggattcaccttcagtgcttactcatgagctggactcccgccaggcctccggaagggggaacgggggctggctaggttcgggtcctcgaacctattagtttaggtgaccttaaaagtcgggggaacaaaccctagtactttaccgaaccgactaggtacccttcgtaggtacggaaacggggtcctaactttcccaccctagttcccgtaccccggaaagggaaccccaaaccggaccctaaaacggtaacctcctaaacgtttaggttaacctaccgttagaacctaaaagttacggaaaacctaggttaaccgtaaaaggacccggtaaacccggtaaaacggaacccgtacccgggggttacccgtttaacgggttaacttttccggttgggtttagggaaccgggtaaggggtttggggttaagggggaacggttaacgggggtaacccgtttaaccggggggtaacg

SEQ ID NO: 421036 - DNA, 569 bp, Homo sapiens
  misc_feature: GZ8MTXP01CYK9W.51.37.D04.1.454.CMB.2.raw
  modified_base (262)..(262): a, c, t, g, unknown or other
  modified_base (344)..(344): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggacgggtccctgagactctcctgtgcagcctntggatcaccttcagtgctacttcatgagctggactcccgcaggcctcgagggagggctgcaggtggtctcactatagttagngaactaagtggggaacaaacccatattctacggcagtactcgtaggacggaacggggcctattcctccgtattccaccgagggaaccaaccgcccaaaggtactcaacttgtactctagacaaatcgaacaggtacaaggaacgaccgaaagaccgacgggtccttaggttaccttcttggtggacggtggttcgggaggggacggtaacgggaacgttaacggg

SEQ ID NO: 421037 - DNA, 697 bp, Homo sapiens
  misc_feature: GZ8MTXP01DI0PW.51.37.D04.1.454.CMB.2.raw
  modified_base (285)..(285): a, c, t, g, unknown or other
  modified_base (345)..(345): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggcaagcctgggaggtccctgacgactctcctgtgcagcctctgatcactcagtgctacttcatganctggactccgcaggcctcgagggggaacggctgcaggtggtctccgactattattacggngtaacctaaagtcgggggaaacaacccgatactttaccgaacgtcgaacggtaccttcgtaggaacgggtaacggggcccgttaaattccctacctaaagttcccgtaacccggaaacgggggaaacccaaacccggaaccccgaaaacggggtaaaccccttaccgttaaaccgtttaggttaacttacccgttaggaaacctaaaaacgttacgaaaccgtaacgttaacgtaaacgggaacgtaacccggaaacggaaccgttaaccgggtcccgtttgttaaaccgtttcgttaggttggaccggtaaggttcgggtaggggaggtaacgggttaaccgttaaccggg

SEQ ID NO: 421038 - DNA, 531 bp, Homo sapiens
  misc_feature: GZ8MTXP01COKRP.51.37.D04.1.454.CMB.2.raw
  modified_base (261)..(261): a, c, t, g, unknown or other
  modified_base (284)..(284): a, c, t, g, unknown or other
  modified_base (346)..(346): a, c, t, g, unknown or other
  modified_base (382)..(382): a, c, t, g, unknown or other
  modified_base (400)..(400): a, c, t, g, unknown or other
  modified_base (429)..(429): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttgggtcaagccgtggagggtccctgagactctcctgtgcagcctntggatcaccttcagtgctacttnatgagctggactcccgcgaggcctccgaggggaggggctgcaggtgggtctcacatattagngaactaagtggaacaaccacattcacgcagactcgngagagggccatctcatcncaggacacgacaaggactcatgatctganaaatgaacagtcctaaaggcgaccgaaagaccacgggtcccgttgttaccgttcttggtgacggaaggttggtacggggagtaacgggttaaccgtaacggg

SEQ ID NO: 421039 - DNA, 792 bp, Homo sapiens
  misc_feature: GZ8MTXP01B0HAF.51.37.D04.1.454.CMB.2.raw
  modified_base (244)..(244): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcctcactctctgcacaggctctgaggcctcctatgagctgacacagccagcctcggtgtcagtgtccccaggacagaccggccaagactcccctgctctggagatgcattcgaccaaaacgtntttgtctttttaggaccaacagaagccaggccaggcccctataataattatataataaagacagtagagacgccctacgagggtactcccgtgaacgcgtattcctcgtcggtcccctccgagccgtaccgaaggggaaaccaaaccgcggaccctaaaccgggtttaggaaaccggttaagtttagggtacggggacgttacccggaagggaccgaaagggaacggtaacgggaacgggtacccgttaaggtaacctttaaacgtttaaccgttaggttaacctaaacttaccgaaacggggaacccgaaaaggggtaaccggaaacccggttaagggttaacgggtttaaccgtttaaaggttaacgggggttaaggtttaacgggtttaccgggggaaccggggaacgggggttaaaccgaacggggttaccgggaaaccccggttccggtaaacgggtaccgaaccggttccccgaaacgggtcccgtacccggtccccccgttcgggtcccgttacccttcccgttccccggtttcccccccg

SEQ ID NO: 421040 - DNA, 528 bp, Homo sapiens
  misc_feature: GZ8MTXP01DJBYF.51.37.D04.1.454.CMB.2.raw
  modified_base (338)..(338): a, c, t, g, unknown or other
  modified_base (353)..(353): a, c, t, g, unknown or other
  modified_base (508)..(508): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggaggcttggtcaagcctggagggtccctgagactctcctgtgcagcctctggatcaccttcagtggctacttcatgagctggatccgcaggctcgagggagggctgcagtggtctcacatattagngactaagtggggaanaaccactattcctacgcaagactcgtagaggaacgggcctattcctccatcctaccgagggacaacgaccaaaggactcactgtatctgacaaatgaaacagtactaagaagaccgaagaccacggcccgtgttaccttcgttgtgcgaagtggngggagaaggttcgtaacggg

SEQ ID NO: 421041 - DNA, 726 bp, Homo sapiens
  misc_feature: GZ8MTXP01BM5YR.51.37.D04.1.454.CMB.2.raw
  modified_base (263)..(263): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcggtggggggagtcttgggtcaaggccgtgggacgggtccctgacgtactctcctgtncacgcctgtggactcaccttgagtgctacttcatgagctggactcccgcaggctccggagggagggctgcgaggtcggtctcactattagttagtgaacgttaaagtcggggaaacaaaccctatacgtttccacgggctaacgtacttacgtagggaacgggtaaacggggtccctatttaccccgtaccctaacgttacccgtacccgggaaacgggggtaaacccaaaacccgggtacccccaaaaagggggtaaaccccttacgtaaaccgttacggttaaactcccgttaaggaaacctaaaaaagttacgaaaaccgttaggttaaaccgaaagggaaccggtaaccggaaaacggacccgttaccggggtacccgttagtttaaccggttcgttagggtaacggtcgggtaagggttcggggtaggggaaggtaaccgggttaaccggtaacgggg

SEQ ID NO: 421042 - DNA, 519 bp, Homo sapiens
  misc_feature: GZ8MTXP01ANOXH.51.37.D04.1.454.CMB.2.raw
  modified_base (262)..(262): a, c, t, g, unknown or other
  modified_base (341)..(341): a, c, t, g, unknown or other
  modified_base (354)..(354): a, c, t, g, unknown or other
  modified_base (361)..(361): a, c, t, g, unknown or other
  modified_base (396)..(396): a, c, t, g, unknown or other
  modified_base (489)..(489): a, c, t, g, unknown or other
  modified_base (493)..(493): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggagggtccctgagactctcctgtgcagcctcnggatcaccttcagtgctactcatgagctggatccgccaggctcgaggggagggctgcagtgggtctccgacatattagngactaagtggganaacccanattcacgcagactcgtagagaacgggccagttccnccatccaccgagggaccaacgccaaaggactcactgtactctgacaaatgaaacagttacaagaacgaccgaaagcacggccgtgttacttgngtgngtggtgggaggagtaacggttcgtgg

SEQ ID NO: 421043 - DNA, 494 bp, Homo sapiens
  misc_feature: GZ8MTXP01A8343.51.37.D04.1.454.CMB.2.raw
  modified_base (351)..(351): a, c, t, g, unknown or other
  modified_base (373)..(373): a, c, t, g, unknown or other
  modified_base (387)..(387): a, c, t, g, unknown or other
  modified_base (392)..(392): a, c, t, g, unknown or other
  modified_base (423)..(423): a, c, t, g, unknown or other
  modified_base (425)..(425): a, c, t, g, unknown or other
  modified_base (428)..(428): a, c, t, g, unknown or other
  modified_base (430)..(430): a, c, t, g, unknown or other
  modified_base (432)..(432): a, c, t, g, unknown or other
  modified_base (436)..(436): a, c, t, g, unknown or other
  modified_base (471)..(471): a, c, t, g, unknown or other
  modified_base (473)..(473): a, c, t, g, unknown or other
  modified_base (478)..(478): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctggagggtccctgagactctcctgtgcagcctctggatcaccttcagtggctacttcatgagctggatccgccaggctccaggggaagggctgcagtggtctcacatatagtgactaatggganaaaccacatttcacgcagactngagaagggcattcncatcncaggacaacgccaaaggaactcactgatcananaanananatanaagaagacgaagacgacgcgtgttcgttcttgtgngngtggnggagtaagaacgtaag

SEQ ID NO: 421044 - DNA, 911 bp, Homo sapiens
  misc_feature: GZ8MTXP01C03FM.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgcttattatagaaggtgtccagtgtcaggtgcagctggtggaatcgtgggggagcttggtcaagcctgggaggtccctgacgctctcctgtgcagcctctggactcaccttcagtgctacttcatgagtcgtggactcccgccgaggcctccggaagggggaacgggggcctggccgtaggttcgggtacctaccgaactatttagtttaggtgaaacccgtttaaaaggtcgggggaaaacctaaaccccgtaaacttaacgtttaccccgtaaaccggaccgtaaacggtaacccgtttacggttaaacgggaaacgggggtaaaaccgggggtaccccttaacgttttaccccgttaccccgtaaacgtttcccccgttaaaccccgggaaaacggggggaaaccccctaaaaaccccggggaacccccgtaaaaaacgggggttaaaacccccgtttaccgtaaaacccgttttagggtttaaaaccctttccggttaaacggaaaacccttaaaaaaaaggtttaccgggtaaaaaaaccttaacgggtttaaacccgtaaaaaacggggtaaccggaaaccccggggttaaaaacgggtaaccccggaaacccggggtttaccccggtttagggtttaaacccccgttttcggtttagggttaaccgggtaccggggtaaggggttttacgggggtacgggggaaacgggtaaaccgggggttaaacccggtttaaccggggg

SEQ ID NO: 421045 - DNA, 667 bp, Homo sapiens
  misc_feature: GZ8MTXP01ESNV8.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtggggggagctttggtcaaggccgtgggacgggtcccctggacgtactctcctgtgcagcctctggtactccaccttcgaggtggctacttcatgagctggactcccgcaggctccggagggggacgggctgctaggtcggtctcactatagttagtcgaactaagtcggggaactaaacccactactttaccgacgctaagaccttgtaggaacggaacggggtccctaatttcccgacctaacttcccgaaccgaacggggaaccctaaaccgggacccaaaacgggtaacctaccgtaaacttgttaaactccttaggaaacctaaaagtcgaaaactacggtacctaaagggaacgaaccggaaacggaccgaccgggtcccgtagtttaacccgttcgttggttcgggacggtaagggttgggaggggaacggtaacgggttaaccgtaacgggg

SEQ ID NO: 421046 - DNA, 563 bp, Homo sapiens
  misc_feature: GZ8MTXP01BHNBI.51.37.D04.1.454.CMB.2.raw
  modified_base (334)..(334): a, c, t, g, unknown or other
  modified_base (353)..(353): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaaggtgtccagtgtcaggtgcagctggtggaatcgtgggggagcttggtcaagcctggagggtccctgagactctcctgtgcagcctctggatcaccttcagtggctacttcatgagctggatccgcaggctcgagggagggctgcagtggtctcacatatagngactaagtgggacaaccanattcacgcagactcgtggaggaacgggccgattccgtaccatccgtaccgaaggggaccaaaccggaccaaagggaacctcaacgttgtactcctagaccaaaagtcgaaacagtactaaaggaacgacccggaaagaccgaccgggtccgttagttacccgttgttggtgcggtaaggtggtggggagtaacggttaaccgtaacgggg

SEQ ID NO: 421047 - DNA, 597 bp, Homo sapiens
  misc_feature: GZ8MTXP01DB9AR.51.37.D04.1.454.CMB.2.raw
  modified_base (263)..(263): a, c, t, g, unknown or other
  modified_base (361)..(361): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttggctgagctgggttttccttgttgctattatagaaggtgtccagtgtcaggtgcagctggtggaatcgtgggggagcttggtcaagcctgggacgggtccctgacgtactctcctgtcgcagcctntggatcaccttcagtgctactcatgagctggactcccgcaggcctccgagggggagggctgcaggtcggctcacatgtagtgaactaagtggggaaanaacccacgtattccaacgcaagaccttcgtaggaacggacgggcctagttcctcctattcccgaccgaacgggaaccaacgacccaaaggtaacctcgtacctgtactcgtacgaacaaagtcgaaactagtaccgtaaaggaacgccgaaaggaccgacccgggttcgtacggttaccttcgttaggtcggtacggtggtggggtagggagggtaacggaacggttaacccgggg

SEQ ID NO: 421048 - DNA, 613 bp, Homo sapiens
  misc_feature: GZ8MTXP01C18D5.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagccgtgggagggtccctgagactctcctgtgcagcctctggatcacttcagtgctactcatgagctggactccgccaggctcgagggagggctgcagtggtctcacatatagtgaactaagtgggaacaaccactattcctacgcagtactgtggtaggaacgggcctaattcctacccattccgacccgaacgggggaacctaaacccgggacccaaaaggggtaaccctccgtaacttaccggttaatcctaggacctaaaagttcgaaaacctaggtaccaaaagggaacgaccgaaaggaccgaacgggtcccgttagttaacccgttcgttggttcggacgttgggtgggtagggggaaccgtaagggttaacgttaaccgggg

SEQ ID NO: 421049 - DNA, 616 bp, Homo sapiens
  misc_feature: GZ8MTXP01AY07V.51.37.D04.1.454.CMB.2.raw
  modified_base (270)..(270): a, c, t, g, unknown or other
  modified_base (348)..(348): a, c, t, g, unknown or other
  modified_base (363)..(363): a, c, t, g, unknown or other
  modified_base (390)..(390): a, c, t, g, unknown or other
tcagcgatcgtatacacgaccggtgctcgatttagtagcatactgttgagctcgtgggagaagagccccagtcccagaattcccaggagtttccattcggtgatcagcactgaacacagaggactcaccatggagtttgggctgagctgggtttcctgttgctattatagaaggtgtccagtgtcaggtgcagctggtggaatcgtgggggagcttggtcaagcctggagggtccctgagactctcctgtcgcagcctctggatcacttnagtggctactcatgagctggactccggcaggctccgagggggacggggctggcaggtgggtctaccgacagtattagngactaagtggggaanaacccgatatttctaacgctagacctntaggtggaaacggggcctattaccgtccattccgtacccgaagggtaccaaacgacccgaaagggtaaacctctaacgtacgtaactcctaggacctaaaagtcgaaacctagttaccgtaaagaacggacccgaaaggaccaacgggtcccgttaggttaccttcgttagggttgacggtaacggtagggttaggggttacgggaagggttaacggtaaccgggg

SEQ ID NO: 421050 - DNA, 533 bp, Homo sapiens
  misc_feature: GZ8MTXP01CYQCM.51.37.D04.1.454.CMB.2.raw
  modified_base (343)..(343): a, c, t, g, unknown or other
  modified_base (380)..(380): a, c, t, g, unknown or other
  modified_base (402)..(402): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggaggtccctgagactctcctgtgcagcctctggatcaccttcagtgctactcatgagctggactcccgccaggctccgagggaagggctgcaggtggtcctcgactatattagngaactaaagtgggaaacaaccatattcacgcagactntggagagggccatctacatccncgaggacaacgacaaggactcactgtatctagacaaatcgaaactagtacaaaggaacgacgaacgacgcggtccgtgttaaccttgttagtggacgtggtgggtaggggagtaacgggttcgtaacgggg

SEQ ID NO: 421051 - DNA, 650 bp, Homo sapiens
  misc_feature: GZ8MTXP01DH5RX.51.37.D04.1.454.CMB.2.raw
  modified_base (242)..(242): a, c, t, g, unknown or other
  modified_base (366)..(366): a, c, t, g, unknown or other
tcagcgatcgtatacacgaccggtgctcgatttagtagcatactgttgggtttgggggtgggtccaggaggcagaactctgggtgtctcaccatggcctggatccctctacttctcccctcctcactctctgcacaggctctgaggcctcctatgagctgacacagccagcctcggtgtcagtcgtccccaggacagacggccaagactcccctgctctggagatgctattgaccaaaagtnttgtcttttagacacagagcagcacgacctaataataatatataataagacagtagagacgcctagacggtactccgtagacgcgtacttctcgtcgtccctccagcgtacgacggaaacaacncgaccgtacgtacgacgtagttaggtaggacgtacgaggacgaaggaacggacggaggtacgtacgtaacttacgttacgtacgtaactaactacgaacggacgaacggaaccgagtacggttagttaacgttaaggtaggtacggttacggttacgggacggggtaacgggtaaccgtaagggttaccggtaacccgttacggtacggtaccgaaccggttcccgttacggtccctccccggtccccgttcggtacccttaccgttcccgttccccgttcccc

SEQ ID NO: 421052 - DNA, 531 bp, Homo sapiens
  misc_feature: GZ8MTXP01BREJ0.51.37.D04.1.454.CMB.2.raw
  modified_base (339)..(339): a, c, t, g, unknown or other
  modified_base (348)..(348): a, c, t, g, unknown or other
  modified_base (354)..(354): a, c, t, g, unknown or other
  modified_base (454)..(454): a, c, t, g, unknown or other
  modified_base (457)..(457): a, c, t, g, unknown or other
  modified_base (462)..(462): a, c, t, g, unknown or other
  modified_base (505)..(505): a, c, t, g, unknown or other
  modified_base (507)..(507): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctggagggtccctgagctctcctgtgcagcctctggatcacttcagtgctatcatgagctggactccgcaggctccgaggggaagggctgcaggtggtctcgactatattagngaacttaangggganaaaccatattcaacgcaagctctgtagaacggggcctattcctaccaattccaccgaagggaccaaacggtcccaaagggaactccatgtatcctagaanaanataanagtacaagaacgacgacgacgacgcgtcgttcgttcgttgtgngngtggtgggaggtaaggaacgtaag

SEQ ID NO: 421053 - DNA, 554 bp, Homo sapiens
  misc_feature: GZ8MTXP01DBP9Q.51.37.D04.1.454.CMB.2.raw
  modified_base (336)..(336): a, c, t, g, unknown or other
  modified_base (340)..(340): a, c, t, g, unknown or other
  modified_base (354)..(354): a, c, t, g, unknown or other
  modified_base (400)..(400): a, c, t, g, unknown or other
  modified_base (511)..(511): a, c, t, g, unknown or other
  modified_base (517)..(517): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagccgtgggagggtccctgagtactctcctgtgcagcctctggatcacttcagtgctactcatgagctggactccgcaggctccgagggggagggctgcaggtggctcacatntagngaactaatgggaanaaacccatattcacgcagtactcgtggtaggaacgggccgtattcncctatccgtacccgaaggggacaaaccgccaaagggtaacctcgaacttgatcctagacaaatgaaacagtacaagaacgacgaagaccgacgggtccgtgttaccgttgngtcggngtaaggtgggtaggggagtaacgggaacgtaacgggg

SEQ ID NO: 421054 - DNA, 557 bp, Homo sapiens
  misc_feature: GZ8MTXP01A8WKK.51.37.D04.1.454.CMB.2.raw
  modified_base (288)..(288): a, c, t, g, unknown or other
  modified_base (339)..(339): a, c, t, g, unknown or other
  modified_base (355)..(355): a, c, t, g, unknown or other
  modified_base (376)..(376): a, c, t, g, unknown or other
  modified_base (388)..(388): a, c, t, g, unknown or other
  modified_base (393)..(393): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggacgggtccctgagctctcctgtgcagcctctggatcaccttcagtgctactcatganctggatccgcaggctcgaggggaggctgcagtggtctcgactatagttagngaactaaagtgggaanaacccatattcacgcagactngagaggcattcncatcncagacaacgccaaggactcatgatctagacaaatcgaaactagtactaaaggccgaaccggaaacggaccacgggtacccgttagttaacccgttttcgttagggttaacgcgggtaaggtttcgggggaggggacggtaacggggttaacccgttaacggggg

SEQ ID NO: 421055 - DNA, 604 bp, Homo sapiens
  misc_feature: GZ8MTXP01AF9J6.51.37.D04.1.454.CMB.2.raw
  modified_base (243)..(243): a, c, t, g, unknown or other
  modified_base (257)..(257): a, c, t, g, unknown or other
  modified_base (284)..(284): a, c, t, g, unknown or other
  modified_base (289)..(289): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcctcactctctgcacaggctctgaggcctcctatgagctgacacagccagcctcggtgtcagtgtccccaggacagacggccaagactcccctgctctggagatgcattgaccaaaacgttnttgtctttagacanagagcagcacgcctataatatatatanaaganagtgagacgcctagaggactccgtgacgcgtacttctcgtcggccctacgagcgtacgacggaaaccaacgcgaccgtacggttagaacgtagttaggtaggtacgtaccgaggacgaaggaacggacggaggtactagtaacttattacgtagtacaacgtacgaacgggacaaggacgaacgtaggttacgttacgttaggtaggtagttacggtcgggacgggaagggaaccgtagggttcgaccgttcgtacggtacacggccgacggtcctccggccccgttcggtccttaccgttccgttccgttcccc

SEQ ID NO: 421056 - DNA, 581 bp, Homo sapiens
  misc_feature: GZ8MTXP01A6JEO.51.37.D04.1.454.CMB.2.raw
  modified_base (339)..(339): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagccgtgggagggtccctgagtactctcctgtgcagcctcgtggatcaccttcagtcgcttactcatgagctggatccgcaggctcgagggaggctgcagtggtctcactatatagngaactaagtggggaacaaccatacttctaaccgcagaccttcgaggacggaacgggtcctaatttccctaccacttcccgtaccggaacggggaaccaaaccggacccaaacggaccttacgaacttggtaactccgttagacctaaaagtcgaaactaggtactaaaggcgaacccgaaagaccacgggtcctggttaccttgacggtgcgtaagtggtgggagaaggttaacgtaacggg

SEQ ID NO: 421057 - DNA, 653 bp, Homo sapiens
  misc_feature: GZ8MTXP01EUI7I.51.37.D04.1.454.CMB.2.raw
  modified_base (242)..(242): a, c, t, g, unknown or other
  modified_base (258)..(258): a, c, t, g, unknown or other
  modified_base (293)..(293): a, c, t, g, unknown or other
  modified_base (305)..(305): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcctcactctctgcacaggctctgaggcctcctatgagctgacacagccagcctcggtgtcagtgtccccaggacagacggccaagatcccctgctctggagatgcattgaccaaaacgttnttgtcttttagacaanagagcagcacgacctataataatatataataaganagtgagacgccngaggactccgtgacgcgtattctcgtcgccctccagcgtacgaacgggaaacaacgcgaccgtaacgttacgaacgtagtttagggacggacgtaccgaggacgaaggaacggaacggacggacgtacgtaacttaacttaacgttacgtactaactacgacggacgaacggaacgaacgtaacggttacggttaacgttaaggttaggtaggttacggttacgggacggggaacgggtaaccggtaacgggttacggtacccggttaccggtacggtcaagggttccccaaaggggcccctagggccccccttacgggtccccttacgttcccgttcggtttccccg

SEQ ID NO: 421058 - DNA, 666 bp, Homo sapiens
  misc_feature: GZ8MTXP01C7BS9.51.37.D04.1.454.CMB.2.raw
  modified_base (251)..(251): a, c, t, g, unknown or other
  modified_base (263)..(263): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtggtttctgtagctatatagagtgtcagtgtcaggtgcagctggtggaatcgtgggggagcttggtcaagcctggaggtccctgagactctcctgtgcagcctntggatcaccttngtgctactcatgagtcgtgactcccgccgaggccgtaccggaagggggacgggtctgacgtaggtcggtacctaccgaactagttagttaggtacgtaaacgttaaaggtcggggaaactaaacccgtaacgttacgttaccgaacgacgtaacgtaccgttacgtaagggaacggaacgggtcccgttaacttccctacctactccgaccggaacggaaccaaaccgacctaaaacggtaacctacgacgttacgtactctacgaacgtaaacgtaacgtaaacgtaacgtaacgtaaacgaacggaacgaacggaaccgaccggtaccgttacgttacgttcgttcggtggtacggtaacgggtagggtaggggttacgggtaacgggttaacggtaacgg

SEQ ID NO: 421059 - DNA, 558 bp, Homo sapiens
  misc_feature: GZ8MTXP01C6WGL.51.37.D04.1.454.CMB.2.raw
  modified_base (350)..(350): a, c, t, g, unknown or other
  modified_base (375)..(375): a, c, t, g, unknown or other
  modified_base (532)..(532): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccctgagactctcctgtgcagcctctggatcaccttcagtggctacttcatgagctggatcccgcaggctccgagggagggctgcagtggtctcacatatagtgactaagtggganaaaccatattcaacgcagacttcgnggaaggaacgggccctaattcctaccgattccgacccgaagggaccaaacggcccaaagggaacctcgaactgtactctagactaaaatgaaaccagtacctaaaggaacgaccgaaagaccgacggccgtgttaccttgttgtcgcgtggttgggnggggaagaacgggttaacgtaacggg

SEQ ID NO: 421060 - DNA, 581 bp, Homo sapiens
  misc_feature: GZ8MTXP01DITZ8.51.37.D04.1.454.CMB.2.raw
  modified_base (273)..(273): a, c, t, g, unknown or other
  modified_base (346)..(346): a, c, t, g, unknown or other
  modified_base (546)..(546): a, c, t, g, unknown or other
  modified_base (551)..(551): a, c, t, g, unknown or other
  modified_base (558)..(558): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggccaagcctgggagggtccctgagactctcctgtgcagcctctggatcaccttnagtgcttactcatgagctggactccgcaggcctccgaggggaagggctgcaggtggtctcgactattattagngtaactaagtggggaacaaacccagtattccaacgcacgacttcgtaggacggaacgggcctaattcctaccatcctaccgacgggaacaaaccgtacccaaagggtaacctcgacttagactcctagactaaaagtgaaactagtaccgtaaagaacggacccgaaagacccgacgggtccgttgttaccttcgttggngacgnggttggnggggagtaaggaacgttaacggg

SEQ ID NO: 421061 - DNA, 548 bp, Homo sapiens
  misc_feature: GZ8MTXP01D17VJ.51.37.D04.1.454.CMB.2.raw
  modified_base (343)..(343): a, c, t, g, unknown or other
  modified_base (379)..(379): a, c, t, g, unknown or other
  modified_base (457)..(457): a, c, t, g, unknown or other
  modified_base (462)..(462): a, c, t, g, unknown or other
  modified_base (510)..(510): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtggggggagcttggtcaagcctgggagggtccctgacgactctcctgtgcagctctggatcactcagtgctactcatgagctggactccgccaggctaccggagggggagggctgcagtgggtctcactatatagngtaactaagtggggaacaaaccactacttctaacgnacgactctggtagaacgggcctatttccactactcctaccgacgggaacaaacgaccaaaggaactcactgtatcganacaanagaactagtacgaagaacgacgaacgacgacggtcgtgttacgttcgnggtgaggtggtgggagggacggaacggttaacgtaagg

SEQ ID NO: 421062 - DNA, 666 bp, Homo sapiens
  misc_feature: GZ8MTXP01ECT1H.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtggggggagcttggcaagccgtgggacgggtccctgagactctcctgtgcagcctctggatccacttcaggtgctacttcatgagctggactccgcaggctccggaggggacgggctggcaggtcggtctcactattattagtcgaacttaagtggggaaacaaccctactacttccgtacggcaacgtactcgtgggtacggaacggggtccctaatttcccgtacctattcccgacccggaaacggggaacccaaaccgggccccaaaacggggtaacccttaccgtaaccttacggttaaactcccgttagaaacctaaaagtacggaaactaaggttaccgaaaagggaacggaccccgaaagggacccgacggggtcccgttagttaaccgtttcgttagggtccgggacggtgggttacggggaggggaggtaacgggttcggtaaccggggg

SEQ ID NO: 421063 - DNA, 548 bp, Homo sapiens
  misc_feature: GZ8MTXP01DNC1D.51.37.D04.1.454.CMB.2.raw
  modified_base (339)..(339): a, c, t, g, unknown or other
  modified_base (510)..(510): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtggggggagcttggtcaagcctgggagggtccctgagactctcctgtgcagcctctggatcaccttcagtgctacttcatgagctggatccgcaggctcgagggagggctgcagtggtctcgacatattagngaactaagtgggacaaaccactattccacgcacgacttcgagaaggacgggccctattccctaccacttccaccgaacgggaacaaacgaccaaacggaactcactgtaactcgtagactaaatgaacagtacaaagaacgacaaacggacaccggtacgtgttacttcgnggtgcggtgttggaggggacgtaaggcccgttaagggg

SEQ ID NO: 421064 - DNA, 608 bp, Homo sapiens
  misc_feature: GZ8MTXP01ENRD7.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtggggggagcttggtcaagcctgggacgggtccccgagactctcctgtgcagcctctggattccaccttcagtcgctacttcatgagctggactccgcaggctaccgaggggagggctggcgtagtggtctcgacattattagtgacgtaaagtcggggaacaacctacacttcgtacgcagtacttcgtggtacggaacgggcctattccctaccacttccgaccgaagggaccaaacgaccaaagacctcacgttagtactcgtagaactaaagtacgaaactagtacgtaaacggacggaacccgaaacggcgtaccgggttccgttagttaacccttcgttggttcgaacgggtaggtgggtaggggaggttacgggtaaccgttaacgggtaacgg

SEQ ID NO: 421065 - DNA, 577 bp, Homo sapiens
  misc_feature: GZ8MTXP01C1S2D.51.37.D04.1.454.CMB.2.raw
  modified_base (541)..(541): a, c, t, g, unknown or other
tcagcgatcgtatacacgaccggtgctcgatttagtagcatactgttgagctctgggagaagagcccccagtcccagaattcccaggagtttccattcggtgatcagcactgaacacagaggactcaccatggagtttgggctgagcttgggttttccttgttgcttattatagaaggtgtccagtgtcaggtgcagctggtggaatcgtgggggagcttggtcaagccgtggagggtccctgagctctcctgtgcagcctctggatcaccttcagtgctactcatgagctggactcccgccaggcctccggaggggaaggggctgcgagtgggtctcacatattagtgaactaagtggggaacaaaccactaattcctaacgcagactcgtagaaggacgggccgtattctacctatccgtaccgacgggaacaaaccgccaaagggtaacctcgtactagtacttcacgacaaaagtgaaaccgagtaactaaggaacgaccgaaggaccgaacggtccgtgttacgttcgttggtcgnggtaagtgggtagggaggtaacgggaacgtaacggg

SEQ ID NO: 421066 - DNA, 560 bp, Homo sapiens
  misc_feature: GZ8MTXP01AO5V1.51.37.D04.1.454.CMB.2.raw
  modified_base (272)..(272): a, c, t, g, unknown or other
  modified_base (341)..(341): a, c, t, g, unknown or other
  modified_base (356)..(356): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagcctctggatcaccttnagtgctacttcatgagctggatccgcaggctccgaggggaagggctgcaggtggtctcgacatatagtnaactaagtggggaanaacccatattcacgcagactcgtaggaagaaggggccctaattccgcctaatccgtaccgaaggggaaccaacgaccaaagggaactccaacttcgtaatccgtagactaaatgaaaccagttaccaaagcgacccgaaagaccacgggccgtgttacccgttgttggtgcggtaagtgggtgggagtggttaacgtaacgggg

SEQ ID NO: 421067 - DNA, 655 bp, Homo sapiens
  misc_feature: GZ8MTXP01BCDBV.51.37.D04.1.454.CMB.2.raw
  modified_base (257)..(257): a, c, t, g, unknown or other
  modified_base (268)..(268): a, c, t, g, unknown or other
  modified_base (350)..(350): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaaggtgtccagtgtcaggtgcagctggtggaatcgtgggggagcttggtcaagcctgggaggtccctgagctctcctgtgcagcctntggatcacctnagtgctactcatgagctggactcccgccgaggcctccggagggggacgggctgcgtaggtcgggtctaccactatagttagngtaacttaagtggggaaacaacccactacttctaacgcaagtacctcgtaggaacggaacggggtacctaatttcccgtaccctaagttcccgtacccggaaacggggaaccctaaaccgggtacccaaaacggggtaaccctactaaccgttaggttaactaccgtaggtaaccaaaagttcgaaaccgtaagtaccgtaaaggaaccgaccgaaacggaccgttacggtccgttacgttacgttcgttggtaacggtcggtaacgggttgggtacggggaggtaacggttaacggtaacgggg

SEQ ID NO: 421068 - DNA, 602 bp, Homo sapiens
  misc_feature: GZ8MTXP01AIJZZ.51.37.D04.1.454.CMB.2.raw
  modified_base (355)..(355): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagcgtggtggaatcgtgggggagtcttggtcaagccgtgggacgggtccctgacgctctcctgtcgcagcctctggtactcacttcagtgctacttcatgagctgactccgcaggcctaccggagggggacgggctgcaggtcggtctccactatagttagngaactaagtgggaacaaaccacgtactttcgacgcaacgtctacgtggtacggaacgggtcctattccctacgtaactccgtaccgaacgggaacccacggaacccaaagggtacctacgtacttacggtactcgtacgaactaaaatcgaaaccgtagtaaccgtaagaacgaccgaaagacccgacggtcgttcgttaccgttgttgtcggagtaaggtggtagggagtcggttaacgtaacggg

SEQ ID NO: 421069 - DNA, 581 bp, Homo sapiens
  misc_feature: GZ8MTXP01D7B7S.51.37.D04.1.454.CMB.2.raw
  modified_base (347)..(347): a, c, t, g, unknown or other
  modified_base (363)..(363): a, c, t, g, unknown or other
  modified_base (501)..(501): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtggggggagcttggtcaagcctgggaggtccctgagactctcctgtgcacgcctctggatcaccttcagtgctacttcatgagctggactcccgccaggctccgaggggaagggctgcaggtggtctcactatagttagngaactaagtggggaanaacccatattctacgcagactcgtaggagaacggggcctaactttccaccactccgtaccgaacgggaaccaaaccggacccaaagggtaacctacacttagtactcgtagactaaaatgaaactagtacaaggaacnccggaaagaccgacgggtccgttgttaccgtttgttggtcggacggtggtgggtaggggagtaacgggaacgtaacgggg

SEQ ID NO: 421070 - DNA, 571 bp, Homo sapiens
  misc_feature: GZ8MTXP01CWO40.51.37.D04.1.454.CMB.2.raw
  modified_base (252)..(252): a, c, t, g, unknown or other
  modified_base (259)..(259): a, c, t, g, unknown or other
  modified_base (292)..(292): a, c, t, g, unknown or other
  modified_base (530)..(530): a, c, t, g, unknown or other
  modified_base (546)..(546): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctggagggtccctgagactctcctgncagcctntgatcaccttcagtgctactcatgagctggacncccgcaggctcgaggggagggctgcaggtggtctccatatatagtgaactaagtgggaaacaaaccactacttcaacgcaaagtactcgtaggaaggtaacgggcctaagttctacctaatccctaccgaagggaacaaaccgaccaaagggaacctctaactcgtaatccagacaaaatcgaaacagttaccaaagaacggtacccgaaagaccgcgggtacctggttaccctttgngtcgcggaaggttggnggggaagaacgggaacgtaaccggg

SEQ ID NO: 421071 - DNA, 606 bp, Homo sapiens
  misc_feature: GZ8MTXP01EC8IP.51.37.D04.1.454.CMB.2.raw
  modified_base (332)..(332): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggagggtccctgacgactctcctgtgcagcctctggatcaccttcagtgctacttcatgagctggatcccgcaggctcgagggaggctgcagtggctcacatntagtgaactaagtggggaacaacccatatttcgacgcacgtactcgttaggtacgaacggggtcctactttcctacctattccacccgaaggggaaaccaaaccaaccccgaaagggaacccttcgaaccttagtactcctagactaaaagttgaaacctagtactaaaggaacgaccggttaaagaccgaaccggggtccgttacgttaccgttcgttaggtcggtcggtaaggttgggtagggggaacgtaacgggttaacgttaacggggg

SEQ ID NO: 421072 - DNA, 643 bp, Homo sapiens
  misc_feature: GZ8MTXP01CMNQ2.51.37.D04.1.454.CMB.2.raw
  modified_base (272)..(272): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttggctgagctgggttttcctgttgctattatagaaggtgtccagtgtcaggtgcagctggtggaatcgtgggggagcttggtcaagccgtgggacgggtccctggagactctcctgtgcagcctcgtgatcacttnagtgctactcatgagctggactccgcgaggcctacgaggggagggctgcgtaggtggtctccgatattattaggtgaacttaaagtcggggaaactaaaccctatactttcgaacgcaaaggtacccttgaggaaacggaacgggccctaatttcctacccgaatcccgtaccgaaggggaaacccaaacggtaccccaaaaggggtaccctttacgaaccttaggttaaactccgttagaacctaaaagtcggaaaactacgttaacgaaaaggccggtaaaccgaacggtaaccaccggggtcccgtagtttacccgttgttacgggttgcgggtaagttgggagggagtaacccggaagttaacgggg

SEQ ID NO: 421073 - DNA, 589 bp, Homo sapiens
  misc_feature: GZ8MTXP01BAYSR.51.37.D04.1.454.CMB.2.raw
  modified_base (260)..(260): a, c, t, g, unknown or other
  modified_base (375)..(375): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggaggtccctgagactctcctgtgcagcctntggtatcaccttcagtcggctacttcatgagctggactcccgccaggcctaccggagggggaaggggctggcgaggtcggtctaccactatagttagtgaactaagtcggggaanaacccactattcgtaacgcaagactcgtaggaaggaacgggccctattcctccaactccgtaccgaagggaaccaaccgaccaaagggaactctaacgtgtaactccgtagactaaatcgtaaacagtaccaaaggaacgacgaaagaccacgggccgtcgttacttcgttggtcggcgtaaggtgggtgggaagtcgggttaacgtaaccggg

SEQ ID NO: 421074 - DNA, 693 bp, Homo sapiens
  misc_feature: GZ8MTXP01DBEJU.51.37.D04.1.454.CMB.2.raw
  modified_base (246)..(246): a, c, t, g, unknown or other
  modified_base (248)..(248): a, c, t, g, unknown or other
  modified_base (284)..(284): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtggtttcgtgtagctatatagagtgtcagtgtcagtgcagctggtggaatcgtgggggagcttggtcaagcctggaggtccctgactcgtctcctggtncncgtcctgtacgtactcctacctgacgtcgtctactnagtgagtctgaccgtccgacgaggtccgacggaggggacggtctcgacgtaggttcggtacctaccgactagtttacgttacgtacgtaacttaaaggtcgggaactaaaccctacgtacttccgacgctacgtacgtcgtacggaaggtaccggtccgttacttcctaccgtacgtacccgtaaccggaacggtaaccctaaaccgaccgtaaacgtaaccctacgtaacgttattaactccgtacgtaacgtaaacgtaaacgtaaacgtaacgtaacgtaaacggtaaacggaaaccggaaaccggtaaaccggttaccggttaccggttaccgttaccgttcgttcggtaacggtacggtaacgggtacgggtacgggttacggtaaccgggttaacggtaacgg

SEQ ID NO: 421075 - DNA, 648 bp, Homo sapiens
  misc_feature: GZ8MTXP01CDWWJ.51.37.D04.1.454.CMB.2.raw
  modified_base (273)..(273): a, c, t, g, unknown or other
  modified_base (340)..(340): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtggggggagcttggtcaagcctgggacggtccctgagactctcctgtgcagcctctggatcaccttnagtgctactcatgagctggatccgcaggctccgaggggagggctgcagtgggtctcacatagttagngaactaagtgggacgaaacccagtattccgtacggacagaccttcgtaggacggaacggggcccgtaatttccctacccattccgtacccgaacgggggaaccaaaccggaccccaaaacggggtaacctactaaccgttaggttaactcccttaggaactaaaacgttacggaaacctaaggttaaccctaaagggaacgaccccggaaaggtaacccgaccgggtacccgttacggttaaccttcgttagggtggacggtaagggttgggtagggggttaaggaacgggttaacgttaaccggggg

SEQ ID NO: 421076 - DNA, 641 bp, Homo sapiens
  misc_feature: GZ8MTXP01C0P9H.51.37.D04.1.454.CMB.2.raw
  modified_base (520)..(520): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagccgtgggacggtccctgacgactctcctgtgcagcctcgtgatcacttcagtcgctactcatgagctggactcccgcaggcctccggaagggggagggctaggctaggtggtcctacgactattagttagtgaaaccttaaaggtcgggggaaactaaaccctaacgttactttaccgaaacggctaaagtaccctttgaggaaacgggaacggggccttaacttcctaccctaattccccgaccggaaagggaacccaaaccggacccaaaggtaacccttctaaactgttacnccgttagaactaaagttcgaaaacctgtaaccaaaggccgaacgttaaagccgacgggtccgttgttaccgttcgagggtgacggaaggttgggagggaagtcggttaacgttaaccgggg

SEQ ID NO: 421077 - DNA, 584 bp, Homo sapiens
  misc_feature: GZ8MTXP01BNFOC.51.37.D04.1.454.CMB.2.raw
  modified_base (396)..(396): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtggtttctgtgctatatagaggtgtccagtgtcaggtgcagctggtggaatcgtggggggagcttggtcaagcctggagggtccctgagactctcctgtgcagcctctggatcaccttcagtgctacttcatgagctggatccgcaggctcgagggggaggctgcaggtcggtctcactatagtagtcgacttaagtggggacaaaccacatttcacgcaagacctgtgaaggtaagggcctattcccnccattccaccgagggacaacggccctaaagggaaccttcacctgtaactcgtacgactaaagtacgaaactacgtacgaaaggaaccgaaccggaaacgaccgaccggtaccgttcgttaccgtttcgttaggtcggacggtaacgggtagggtacggggttacgggtaacgggttaacggtaacggg

SEQ ID NO: 421078 - DNA, 641 bp, Homo sapiens
  misc_feature: GZ8MTXP01EZK2V.51.37.D04.1.454.CMB.2.raw
  modified_base (361)..(361): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagcgtggtggaatcgtggggggagtcttgggtcaaggccgtgggacgggtccctggagtactctcctgtgcagcctcgtggactcaccttcagtggctacttcatgagctggactcccgcaggcctccgagggggagggctgcgaggtcggtctccactattattagngaacttaaagtggggaaacaaaccactatttaccaacggcaaacggtactcgtagggaacgggtaaacggggtccctaattttccccacctaactcccgtaccggaaacggggaaaccaaaaccggaccccaaaagggtaaccttacgaaccttagtaactcctaggaactaaatggaaactacgtactaaagcggaaccgaaagccgaacgggtcgttacttacgttcgttggtaaggcgtaaggttgggagggggacgaacgggttaacgtaacgggg

SEQ ID NO: 421079 - DNA, 525 bp, Homo sapiens
  misc_feature: GZ8MTXP01EM3KF.51.37.D04.1.454.CMB.2.raw
  modified_base (261)..(261): a, c, t, g, unknown or other
  modified_base (337)..(337): a, c, t, g, unknown or other
  modified_base (345)..(345): a, c, t, g, unknown or other
  modified_base (351)..(351): a, c, t, g, unknown or other
  modified_base (390)..(390): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggagggtccctgagactctcctgtgcagcctntggatcaccttcagtgctactcatgagctggactccgcaggctcgagggggaggctgcagtggtctcatatattgnaactaagngggaanaaccatattcacacagactcgagagaacggcctattccncatccgacgaggaccaacgaccaaaggactcactgatctagactaaaagtcgaaacagtacaaaggaacgacccgaaagaccgacgggtctgttaccttgcgtgacgtggtggagggagtaacggcgtaaccggg

SEQ ID NO: 421080 - DNA, 566 bp, Homo sapiens
  misc_feature: GZ8MTXP01ANUGJ.51.37.D04.1.454.CMB.2.raw
  modified_base (351)..(351): a, c, t, g, unknown or other
  modified_base (533)..(533): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctggacggtccctgagactctcctgtgcagcctctggatcaccttcagtggctacttcatgagctggatccgcaggctcgagggaggctgcagtggctcgacatatagtgaactaagtggggaanaacccatattcctaacgcaagcctcgtaggaaggacggggcctattccgccatccgtaccgaagggaccaaaccgccaaaggaacctcaacgtgtaactccgtagaccaaaatcgaaaccagttacgaaagaacgtaacccgaaagaccgaccggtccgtgttaccgttgttggtcgtaggnggttgggtggggagaaggttaaccgtaacgggg

SEQ ID NO: 421081 - DNA, 552 bp, Homo sapiens
  misc_feature: GZ8MTXP01EC6QT.51.37.D04.1.454.CMB.2.raw
  modified_base (263)..(263): a, c, t, g, unknown or other
  modified_base (350)..(350): a, c, t, g, unknown or other
  modified_base (405)..(405): a, c, t, g, unknown or other
  modified_base (434)..(434): a, c, t, g, unknown or other
  modified_base (495)..(495): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtggggggagcttggtcaaggcctgggagggtccctgagactctcctgtgcagcctntggatcaccttcagtggctacttcatgagctggactcccgcaggctccgagggggagggctgcaggtggtctaccactatattagtnaactaaagtggggaataacccatattcacgcagtactctggagacgggccattcncatccacgaggacaacgtccaaaggactnactgatcctagactaaactgaaacctagtacaagaacgaaccggaagaccgacggtccgtnttacgttcgttaggtgacgtaagttcgggaggggactaacgggttaacgtaacgggg

SEQ ID NO: 421082 - DNA, 609 bp, Homo sapiens
  misc_feature: GZ8MTXP01EIHS4.51.37.D04.1.454.CMB.2.raw
  modified_base (346)..(346): a, c, t, g, unknown or other
  modified_base (568)..(568): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagccgtggagggtccctgagactctcctgtgcagcctctggactcaccttcagtgctacttcatgagctggactcccgccaggctccgaggggaagggctgcaggtggtctcactatattagngaactaaagtggggaacaaccacatttcacgcaagtactcgtaggaaggaacggggtccctaaatttcccgtacctaaattcccgaccgaaacggggaaaccaaaccggacccaaagggtaaaccttcgaacttacgtaatcctaggaactaaaagtgaaaccgtagtaccaaaggaacgccgaaagacgacggtccgttagttacgttcgttggtaacggngtaagggttggcggggaagtaacgggttaacgtaaccgggg

SEQ ID NO: 421083 - DNA, 584 bp, Homo sapiens
  misc_feature: GZ8MTXP01BKRXR.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagtcttggtcaagcctgggacgggtccccagactctcctgtgcagcctctggacttcaccttcagtgctacttcatgagctgactccgccgaggctccgagggggaacgggctgcgaggtggtctcacctatagttagtgacgtaaaagtgggaacgaaacccagtactttcctacgcaagacttcgtggtaggaacggggcctaattctaccactctacccgaagggaccaacgacaacgactcactgtatctagcaaatgaacgattaccgaaagcggaaccgaaagaccgtaccgggttcgttacgttacgttccgttggttcggaacgtaggtggggtgggggagacgggtaaccgttaaggggccg

SEQ ID NO: 421084 - DNA, 533 bp, Homo sapiens
  misc_feature: GZ8MTXP01EGYKO.51.37.D04.1.454.CMB.2.raw
  modified_base (293)..(293): a, c, t, g, unknown or other
  modified_base (320)..(320): a, c, t, g, unknown or other
  modified_base (341)..(341): a, c, t, g, unknown or other
  modified_base (349)..(349): a, c, t, g, unknown or other
  modified_base (355)..(355): a, c, t, g, unknown or other
  modified_base (361)..(361): a, c, t, g, unknown or other
  modified_base (369)..(369): a, c, t, g, unknown or other
  modified_base (395)..(395): a, c, t, g, unknown or other
  modified_base (420)..(420): a, c, t, g, unknown or other
  modified_base (462)..(462): a, c, t, g, unknown or other
  modified_base (486)..(486): a, c, t, g, unknown or other
  modified_base (493)..(493): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtggggggagtcttggtcaagccgtgggacgggtccccgagactctcctgtgcagcctctggattcaccttcagtgctactcatganctggactccgcaggctcgagggagggntgcagtggtctcacatatagnactaaagngggaanaaccanattcacgnagctgtgagaggcctattctacatcnccgaagggaccaacgacaaagactnactgactcagacaaatgaactgtactaagagaacccggaaanccgacggttccgtagtaacttcgngttacgnggtagtgggtaggggagacgggtaacgttaacgggtaacg

SEQ ID NO: 421085 - DNA, 628 bp, Homo sapiens
  misc_feature: GZ8MTXP01A3D4B.51.37.D04.1.454.CMB.2.raw
  modified_base (261)..(261): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggagggtccctgagactctcctgtgcagcctntggatcaccttcagtggctacttcatgagctggactccgccaggcctccgaggggagggctgcaggtggtctcgactatatagtgaacttaagtggggaaacaaaccctagtactttccacgcaacgtacttcgtaggtaggaacggggccctatttcctaccctattcccgtaccgaacgggaaccaaaccggacccaaacggaaaccttcaaccttagtaacttccgtagacctaaaatcgaaacctaggttaccaaagggaaccaacccgggaaacgaccgaccgggtacccggttagttacccttcgttgggtaacggcggtaaggttggggagggggacgtaagggttaaccgttaacgggg

SEQ ID NO: 421086 - DNA, 592 bp, Homo sapiens
  misc_feature: GZ8MTXP01BCCN7.51.37.D04.1.454.CMB.2.raw
  modified_base (340)..(340): a, c, t, g, unknown or other
  modified_base (350)..(350): a, c, t, g, unknown or other
  modified_base (358)..(358): a, c, t, g, unknown or other
  modified_base (364)..(364): a, c, t, g, unknown or other
  modified_base (369)..(369): a, c, t, g, unknown or other
  modified_base (543)..(543): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagtcttggtcaagccgtgggacgggtccccgagactctcctgtgcagcctcgtggacttcaccttcgagtggctacttcatgagctggactccgccgaggctcgaggggagggctggcaggtggtcncacatattgnactaaagngggaanaaccntattcctacgctagtactcgtagtacggaacgggcctattcctacccattccgaccgaagggacccaaaccgaccgaaagtaacctctaacgttagttactccgtagaacctaaagtacgaaactaggtactaaggacgaaccgaaagaccgaccgggttccgttagtcttcgnggttcggcggtaggtgggtaaggggagacgggtaaccgttgggaaccgg

SEQ ID NO: 421087 - DNA, 710 bp, Homo sapiens
  misc_feature: GZ8MTXP01A5W6S.51.37.D04.1.454.CMB.2.raw
  modified_base (362)..(362): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggacggtccctgagctctcctgtgcagcctctggtactcaccttcgagtggcttacttcatgagcgtggactcccgccaggcctaccgagggggaagggctgcgtaggtcgggtctaccgactattagttaggngtaacttaaggtgggggaaacaaaccctactactttccgaacggctaagaccgttcgagggaacgggaaacggggtcctaatttccctacctacgtacccgtacccgaaacgggggaaacccaaaccggaccccgtaaaacggggtaacccttacctaaacgttcggttaacttacccgttaaggaaactaaaaaccggttggtaaaaccctaggttaaccgaaaggaaccgggaaccggttaaacggaccgaaccgggtcccgtttagttaaccgttcggttaggttaacggccgggtaagggttcggggtaagggggacggtaacggggttaacccgttaaggggg

SEQ ID NO: 421088 - DNA, 653 bp, Homo sapiens
  misc_feature: GZ8MTXP01CXVUK.51.37.D04.1.454.CMB.2.raw
  modified_base (245)..(245): a, c, t, g, unknown or other
tcagcgatcgtatacacgaccggtgctcgatttagtagcatactgttgggtttgggggtgggtccaggaggcagaactctgggtgtctcaccatggcctggatccctctacttcctcccctcctcactctctgcacaggctctgaggcctcctatgagctgacacagccagcctcggtgtcagtgtccccaggacagacggccaagactcccctgctcgtggagatgcattcgacctaaaacgtntttgtctttttaggtaccaacagaagccaggccaggcccctaataataattataataataaagacagtagagagccctagagggactcccgtgagcgtattctcgtcgccctccagctacgagggaaaccaacgcgacctacgttagaacgtattacggtagggacgtccgaggaccgaaggaacgacggaggtctaggaacttaattacgtagtacaaacttcgaacgggacgaacggacggacgtaaggttacggttaactttaaggtgggtaacgttacgggttacgggaccggggtaacgggaaccgtaaagggttcggtaaccccgttcgtaaacgggtccgaacggcccgaacggtcctaccgccccgtacgggtccttaactcccgttcgtttaacccccc

SEQ ID NO: 421089 - DNA, 572 bp, Homo sapiens
  misc_feature: GZ8MTXP01D5GVV.51.37.D04.1.454.CMB.2.raw
  modified_base (342)..(342): a, c, t, g, unknown or other
  modified_base (360)..(360): a, c, t, g, unknown or other
  modified_base (367)..(367): a, c, t, g, unknown or other
  modified_base (546)..(546): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctggagggtccctgagactctcctgtgcagcctctggatcaccttcagtggctacttcatgagctggatccgccaggctccgaggggaagggctgcaggtggtctcacatattagngaactaaagtgggggaanaaacccnattctaacgcaagacctcgtgaggaacggggcctaatttcctaccaatcctacccgaaggggaccaaacgcccaaaagggaacctcaacttgtatcctgacaaaagtgaaacaggttacaaagaacgccgaaagaccacgggtccgtagttaaccttcgttaggtgacggaaggttggngggggagtaacggaacgttaacgggg

SEQ ID NO: 421090 - DNA, 579 bp, Homo sapiens
  misc_feature: GZ8MTXP01BT5NQ.51.37.D04.1.454.CMB.2.raw
  modified_base (354)..(354): a, c, t, g, unknown or other
  modified_base (370)..(370): a, c, t, g, unknown or other
  modified_base (413)..(413): a, c, t, g, unknown or other
  modified_base (536)..(536): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagtcttggtcaagccgtgggacgggtccctgagtactctcctgtgcagcctctggatcacttcagtgctacttcatgagctggactcccgcaggcctccggagggggacgggctggctaggtggtctccgactatattagngaacttaagtgggaanaacccatacttcacgcagactcgaggagaacgggcctattccnccagtccaccgaagggaaccaacgaccaaaggacctcaactgtaactccgtagaactaaagtgaaaccgtagtacgtaaagaacgaaccgaaagtaccgaccggtcccgttgttacccgttgnggtaacgcggtaaggttgggagggaaggtcggaacgtaacggg

SEQ ID NO: 421091 - DNA, 758 bp, Homo sapiens
  misc_feature: GZ8MTXP01ELSZR.51.37.D04.1.454.CMB.2.raw
  modified_base (276)..(276): a, c, t, g, unknown or other
  modified_base (456)..(456): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttcctgttgctattatagaaggtgtccagtgtcaggtgcagctgggtggaatcgtgggggagtcttggtcaagccgtgggacgggtccctgagtactctcctgtgcagcctctggatcacttnagtgctacttcatgagtctggactcccgcaggcctccggaagggggagggcctggcgtaggtcgggtacctacgactattagttagtcgaaacttaaaggtcggggaaactaaaccctacgtactttaccgaacggctaaacgtactcgtaggaacgggaacgggccctaattttacccnccctaagttaccccgaccggaaacggggaacccaaaacccggacccgtaaaacggggtaaacccttccgtaaaccgtttacggttaaaccttaccggttaaacgaaacctaaaagttcggaaaaacccgttaggttaaacccgtaaaaggggaacccggtaacccgggttaaaacggaccccggttaacccgggggtacccgtttaacgtttaaccccgtttcggttaaggggttccggaacgggttaacggggttggggtaacggggaagggttaacgggttaacccggtttaaccggggg

SEQ ID NO: 421092 - DNA, 796 bp, Homo sapiens
  misc_feature: GZ8MTXP01DR2HJ.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcgttggcaagccgtgggacggtccctgacgactctcctgtgcagcctctggatcactcagtcgctacttcatgagcgtggactccccgaccaggccgtacccggaaggggggtaacggggcttggccgtaggttcggggtacctacccgtaatatttagtttaacggtgtaaacccgttaaaagggttcgggggaaaacctaaaaccccaaccgttaacgttttacccgaaaccgggctaaaacggtccccgttaggtacgggaaacggggaaaccgggggtcccttaaacttttccccgtacccctaaagtttcccccgtaaccccgggaaagggggaaacccctaaaacccgggaacccccaaaaacggggttaaaaccccttccttaaaccgttaggtttaactacccgttagaaaccctaaaaagttccggaaaacttacggttaaactaaaacggggaaccgaaacccgggaaacgtaccccggttaaaccggggttcccgtttcggtttaacttccgttagggttccgacggggttgtcggggtaggggacggtaacgggaacgttaaccggggg

SEQ ID NO: 421093 - DNA, 627 bp, Homo sapiens
  misc_feature: GZ8MTXP01D0ETH.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagttggctgagcttgggttttccttgttgctattatagaaggtgtccagtgtcaggtgcagctggtggaatcgtgggggagcttggtcaagccgtgggacgggtccctgacgtactctcctgtgcagcctctgatcaccttcagtgctactcatgagctgatcccgcaggctcgaggggaggctgcaggtggtctcgactagttattagtcgaaacttaagtggggaaactaaacccactactttccaacgcaagtaccttcgaggaacgaacggggtcctaaatttccacctattccaccggaacgggaaccaaaccggacccaaagggaacctcgtaacgttgtacgtcacgactaaaagtcgaaacgtagtacgtaaaggaacggaccccggaaagaacccgttacggtcccgttagttacccgtttcgttggttggaccgggtaaggttacggggaggggttacggtaacggttaaccggtttaaccgggg

SEQ ID NO: 421094 - DNA, 513 bp, Homo sapiens
  misc_feature: GZ8MTXP01ER7G4.51.37.D04.1.454.CMB.2.raw
  modified_base (344)..(344): a, c, t, g, unknown or other
  modified_base (357)..(357): a, c, t, g, unknown or other
  modified_base (363)..(363): a, c, t, g, unknown or other
  modified_base (377)..(377): a, c, t, g, unknown or other
  modified_base (394)..(394): a, c, t, g, unknown or other
  modified_base (400)..(400): a, c, t, g, unknown or other
  modified_base (443)..(443): a, c, t, g, unknown or other
  modified_base (481)..(481): a, c, t, g, unknown or other
  modified_base (500)..(500): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctggggttttccttgttgctattatagaaggtgtccagtgtcaggtgcagctggtggaatcgtgggggaggcttgggtcaagcctggagggtccctgagactctcctgtgcagcctctggatcaccttcagtggctacttcatgagctggatccgcaggctccgaggggaagggctgcagtgggtctccacatattagngactaagtggganaaaccnattcacgcagactntgtgaacgggccattcncatccncgaggacaacgccaaggactcactgtatctgacaaatgaaacngtactaagcgccgaaagccacgggccgtagttacttcnggtgcgaagtggtgggagnggaacgtaacggg

SEQ ID NO: 421095 - DNA, 616 bp, Homo sapiens
  misc_feature: GZ8MTXP01C71QJ.51.37.D04.1.454.CMB.2.raw
  modified_base (244)..(244): a, c, t, g, unknown or other
  modified_base (298)..(298): a, c, t, g, unknown or other
tcagcgatcgtatacacgaccggtgctcgatttagtagcatactgttgggtttgggggtgggtccaggaggcagaactctgggtgtctcaccatggcctggatccctctacttctcccctcctcactctctgcacaggctctgaggcctcctatgagctgacacagccagcctcggtgtcagtcgtccccaggacagacggccaagactccctgctcgtggagatgcattgacctaaaacgttntttgtcttttagacaacagacgcacgcacgacctataataatatataataaganagtagagacgcctagacggtactccgtgagcgtacttctcgtcggccctccgagcgtacgaacggaaacaacgcgacctacggttacgacgtagttaggtggacgtacgaggacgaaggaacgacgacggactacgtaactattacgtagactaactacgaggacgaggaacgacgtagtacggttacttaggtaggtagtacggtcgggacggaacgggtaacgagggttccggtaccgttacgtacggtcgaaccggcccgaacggtcccgtacccgtccccgttcgtacccttaccgttcccgttcccgttcccc

SEQ ID NO: 421096 - DNA, 586 bp, Homo sapiens
  misc_feature: GZ8MTXP01EVSEK.51.37.D04.1.454.CMB.2.raw
  modified_base (262)..(262): a, c, t, g, unknown or other
  modified_base (289)..(289): a, c, t, g, unknown or other
  modified_base (339)..(339): a, c, t, g, unknown or other
  modified_base (362)..(362): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggacgggtccctgagactctcctgtgcagcctntggatcaccttcagtgctactcatganctggactccgcaggctcgagggagggctgcagtggtctcactatattagngtaactaagtgggaacaaaccanattccaacgcagactgtaggaagggaaacgggcctaattcccacctaattccaccggaacgggaaccaaaccgtaccaaagggaacttcaaccttagtactcctagaacaaaatcgaaactagtaacctaaaggaagaacccgaaagacccgttaacgggcccgttagttaccttcgaggtcggacgtaaggttggaggggagtaacgggttaacgtaacgggg

SEQ ID NO: 421097 - DNA, 529 bp, Homo sapiens
  misc_feature: GZ8MTXP01CQ4JE.51.37.D04.1.454.CMB.2.raw
  modified_base (258)..(258): a, c, t, g, unknown or other
  modified_base (394)..(394): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaaggtgtccagtgtcaggtgcagctggtggaatcgtgggggagcttggtcaagcctggacgggtccccagactctcctgtgcagcctntggattcacttcagtgctacttcatgagctggatccgcaggctccgagggagggctgcagtggtctcaccatattagtgactaaaagtgggaacaaacccagtatttcacgcagactcgtgtagaagggccattcncatctaccgaggacaacgcaaagactcaactgtaatctgacaaatgaaactagtacaaagcgaaccgaaagaccgacgggccgttacgtacttcgttgttgcggagtggtggggagagggtaacgttaagggtcg

SEQ ID NO: 421098 - DNA, 594 bp, Homo sapiens
  misc_feature: GZ8MTXP01DTU8W.51.37.D04.1.454.CMB.2.raw
  modified_base (571)..(571): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggacgggtccctgacgactctcctgtgcagcctcgtggatcaccttcagtcgctactcatgagctggactccgcaggctcgagggaggctgcagtcggtctcacatagttagcgaacttaaagtggggaactaaacccatactttccacggcaagactcgtaggaaggaacggggcctaattcctaccaattccgaccgaaggggaacccaaaccggacccaaaacggggtaaccttccaaacgttcgtaaactccgtagaactaaaatcgaaacacgttacaaaggaacgaaccgaagaccgacggtccgttagttaccttgaggtgacggtaagttgggnggggagaagggaaccgtaagggg

SEQ ID NO: 421099 - DNA, 571 bp, Homo sapiens
  misc_feature: GZ8MTXP01BBIAM.51.37.D04.1.454.CMB.2.raw
  modified_base (275)..(275): a, c, t, g, unknown or other
  modified_base (285)..(285): a, c, t, g, unknown or other
  modified_base (345)..(345): a, c, t, g, unknown or other
  modified_base (368)..(368): a, c, t, g, unknown or other
  modified_base (517)..(517): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagccgtgggacgggtccctgagactctcctgtgcagcctctggatcaccttnagtgctactnatgagctggactccgcaggcctcgagggagggctgcaggtggtctccgactatagttagngtaactaagtgggaacaaacccntactttcgaacgctaagactcgtaggaaggaacggggccctattccaccatcctacccgaagggaaccaacgccaaacgggaactcaactgtatcgacgactaaatcgaaacagtactaaaggaaccgaccgaaagccgacggtccgtnttaccttcgttagtggcgtaaggttgggaggggagaacggttaacgtaacgggg

SEQ ID NO: 421100 - DNA, 536 bp, Homo sapiens
  misc_feature: GZ8MTXP01DP2UJ.51.37.D04.1.454.CMB.2.raw
  modified_base (275)..(275): a, c, t, g, unknown or other
  modified_base (343)..(343): a, c, t, g, unknown or other
  modified_base (359)..(359): a, c, t, g, unknown or other
  modified_base (395)..(395): a, c, t, g, unknown or other
  modified_base (400)..(400): a, c, t, g, unknown or other
  modified_base (420)..(420): a, c, t, g, unknown or other
  modified_base (499)..(499): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtggggggagtcttggtcaagcctgggagggtccctgagactctcctgtgcagcctctggatcaccttnagtgctacttcatgagctggactcccgcaggctcgaggggagggctgcagtggtctcactatattagngaactaagtggggaanaaaccacattcacgcagactcagagacggctattcncatcncgaggacaacgcaaagactnactgtatctgaacaaatcgaaacagtaacaaagaacgacccgaaagaccgacggtccgtagttaccttcgttaggtcgnggaaggttgggaggggagtaacgggaaccgtaagggg

SEQ ID NO: 421101 - DNA, 607 bp, Homo sapiens
  misc_feature: GZ8MTXP01BVK61.51.37.D04.1.454.CMB.2.raw
  modified_base (271)..(271): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtggggggaggcttggtcaagcctggagggtccctgagactctcctgtgcagctctggatcactnagtgctacttcatgagctggatcccgcaggctcgaggggaggctgcaggtggctcactatattagtcgaactaagtggggaacaaacccgatatttccgtacgctaacgacttcgtaggaaggaacggggccctaatttccccgtacctaagtccctacccggaaagggggaacccaaacgggaccccaaaaggggtaacctccaaaccttggtaactcgtagacctaaaagtgaaacctaggtacctaaaggaacgacccgaaagccgacgggtccctaggttaccttcgttaggtcgcgtaaggttcggaggggacgtaaggttcgtaaccggg

SEQ ID NO: 421102 - DNA, 553 bp, Homo sapiens
  misc_feature: GZ8MTXP01EV31S.51.37.D04.1.454.CMB.2.raw
  modified_base (360)..(360): a, c, t, g, unknown or other
  modified_base (404)..(404): a, c, t, g, unknown or other
  modified_base (507)..(507): a, c, t, g, unknown or other
  modified_base (531)..(531): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggagggtccctgagctctcctgtgcagcctctggatcacttcagtgctactcatgagctggatcccgcaggctccgagggggaggctgcaggtggtctcactatatagtgaactaagtgggaacaaacccngtattcgtacgcaggactcgtggtaggaacgggcctatttcccncctatccgtaccgagggaaccaaccgaccaaaggactcaacctgtaactcgtgactaaagtgaaactagtacgtaaaggaacgaccgaaagccgacggccgtnttacgttcgttggtgcgtggtggngggagaacggttcgtaacgggg

SEQ ID NO: 421103 - DNA, 592 bp, Homo sapiens
  misc_feature: GZ8MTXP01EKK8I.51.37.D04.1.454.CMB.2.raw
  modified_base (268)..(268): a, c, t, g, unknown or other
  modified_base (321)..(321): a, c, t, g, unknown or other
  modified_base (332)..(332): a, c, t, g, unknown or other
  modified_base (488)..(488): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtgggtttcctgtgctatatagagtgtccagtgtcaggtgcagctggtggaatcgtgggggagtcttggtcaagcctggacgggtcctgagactctcctgtgcagcctcgtggactcacttnagtcgctactcatgagctggatccgcaggctacgagggaggctgcagtggtcncacatatagtnactaagtgggacgaaacccactattccgtaacgcgacgtactcgtaggaaggtaacgggccgttattacctactactccgaccgaacgggacaaaccgaccaaacgggaactactacttcggtaattcccagaaccaaagtgtaaaccgacgttanaaacggaacggacccgttaaaggaccgcggggtaccttacggttctttaccgttggtaagcggtaaggttgggagggttacggtaacgggttaacgttaacggg

SEQ ID NO: 421104 - DNA, 616 bp, Homo sapiens
  misc_feature: GZ8MTXP01D5ODU.51.37.D04.1.454.CMB.2.raw
  modified_base (413)..(413): a, c, t, g, unknown or other
  modified_base (483)..(483): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtggggggagcttggtcaagcctgggagggtccctgagactctcctgtgcagcctgtgatcaccttcagtgctacttcatgagctggactcccgcaggctccgaggggagggctgcaggtggtctccacattatagtgaactaagtgggagaaacccacgtattaccgtacgctaacggacctgtggaagacgggaccgtaatttccnccgtaactccgtaccgaacgggaccaaaccgacccgaaagggtaaaccctcaaacgtacgtaacttccgngtaacaaaagtccgaaacgtacgtaccgttaaaggaacccgaacggaacgaaccgacggtccgttacgttaccgtttccgttaggttcgacggtggttcgggtacggggaggtaacgggaaccgttaacgggg

SEQ ID NO: 421105 - DNA, 675 bp, Homo sapiens
  misc_feature: GZ8MTXP01D7LFP.51.37.D04.1.454.CMB.2.raw
  modified_base (247)..(247): a, c, t, g, unknown or other
  modified_base (259)..(259): a, c, t, g, unknown or other
  modified_base (278)..(278): a, c, t, g, unknown or other
  modified_base (330)..(330): a, c, t, g, unknown or other
  modified_base (365)..(365): a, c, t, g, unknown or other
tcagcgatcgtatacacgaccggtgctcgatttagtagcatactgttgagctctggggagaagagccccagtcccagaattcccaggagtttccattcggtgatcagcactgaacacagaggactcaccatggagtttgggctgagcttgggttttccttgttgctattatagaaggtgtccagtgtcaggtgcagctgggtggaatcgtggggggagcttggtcaagcctgggacgggtccctganacgtctcctgtncagcctctggatcaccttnagtgctacttcatgagctggactccgccaggctcgagggggaggctgcaggnggtctcactatatagtgaactaaagtgggggaaanaaacccatactttaccgacgtcgaagtaaccctgtaggaaggaaacggggtccctaatttccctacctaacttacccgtacccggaaacgggggaaacccaaaccggtaccccaaaaaggggtaaacccttctaaaccgttaggttaacttccttaggaaacctaaaaacttgggaaaacctaaggttaacccgaaagggaaccgaccggaaaggaacccgaaacggggtcccgttaagttacgttccgttagggttcgggacggtaagggttgggagggggacgtaaggggttaaccgttaaccggggg

SEQ ID NO: 421106 - DNA, 587 bp, Homo sapiens
  misc_feature: GZ8MTXP01AJPDB.51.37.D04.1.454.CMB.2.raw
  modified_base (262)..(262): a, c, t, g, unknown or other
  modified_base (340)..(340): a, c, t, g, unknown or other
  modified_base (356)..(356): a, c, t, g, unknown or other
  modified_base (407)..(407): a, c, t, g, unknown or other
  modified_base (554)..(554): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagtcttggtcaagccgtgggagggtccctgagactctctgtgcagcctntgatcacttcagtgctacttcatgagctggactccgcaggctccgaggggaggctgcaggtggtctcatatagttagngtaactaagtgggganaaacccatacttctacgcagactcgtaggaaggaacggggtcctagttccncctatccaccgagggaaccaaaccggaccaaacgggaacctcaacgttcgtaactactcgaaccaaaagttcgaaactaggtaactaaagggaaccaccggaaaggaccgacgggtcccgttagttaccgttcgttaggtggacggnggttgggaggggaggtaacggttcgtaacgggg

SEQ ID NO: 421107 - DNA, 632 bp, Homo sapiens
  misc_feature: GZ8MTXP01EPPBS.51.37.D04.1.454.CMB.2.raw
  modified_base (252)..(252): a, c, t, g, unknown or other
  modified_base (281)..(281): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaaggtgtccagtgtcaggtgcagctggtggaatcgtgggggagcttggtcaagcctgggagggtccctgagactctcctgtncagcctctggatcacttcagtgctacttnatgagctggactccgcaggcctacggaggggagggctgcaggtcgggtctccgactatagttagtcgaacttaaagtcggggaaactaacccgactacttttccgaacggctaacggtactcgtaaggaacgggtaacggggtcccgtaatttacccgtacctaacgttcccgacccgggaaacggggaaccaaaccgacccaaaggggtaaccttcaaccgttgtactacgtacgacaaaagtcgaaacctaggtacctaaacgggaacgaccgaaagaccgaccggtccgttagttacgttcgttgggtcgacggtaagttggaggggacaacgggttaacgtaacggg

SEQ ID NO: 421108 - DNA, 617 bp, Homo sapiens
  misc_feature: GZ8MTXP01D3QDC.51.37.D04.1.454.CMB.2.raw
  modified_base (178)..(178): a, c, t, g, unknown or other
  modified_base (290)..(290): a, c, t, g, unknown or other
  modified_base (348)..(348): a, c, t, g, unknown or other
  modified_base (513)..(513): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtntccagtgtcaggtgcagcgtgggtggaatcgtggggggagtcttggtcaaggcctgggacgggtccctggacgactctcctgtgcagcctctggatcacttcagtgctactnatgagctgactccgcaggcctcgagggaggctgcaggtcggtctcgactatacgttgngaacttaaagtggggaacaaacccatactttccgacgctaaggcctgtaggaacgaacggggccctaatttcccacctaagttccaccgaacggggaacctaaccgaccctaaaaggggtaccttaccaacttaggttaactccgtagaaactaaagtcgtaaanagtacaaaggaacgaacgaaagtccgttacggtccgttacgttcgttcgttaggtcggtacggtaagggttcgggaggggacgtaaccgggttaacgtaacggg

SEQ ID NO: 421109 - DNA, 745 bp, Homo sapiens
  misc_feature: GZ8MTXP01B9ZCD.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttggctgagcttgggttttccttgttgctattatagaaggtgtccagtgtcaggtgcagcgtggtggaatcgtgggggagtctttggtacaaggcccgtgggacggggttcccctggacgtaccttctcctggtcgcaggccctcgtggtatccaccttcaggttggaccttacttcatggagcgtaggactcccggaccgagggccgtaccggaagggggaacggggtcttacggacgtagggtcggggtctaccccgataagttattaggtgtaaccttaaaggtggggaaactaaacccacgtactttacgacggacaggtaccttagaggaacggaaacggggcctaagttaccctaccgtattaccgacccggaaacgggaaccaaaccgacccgaaaacggggtaaccttacctaaaccgtttaggttaacttaccgtacggaaacctaaaagttcgggaaaacctacgggttaaccaaaggggaaaccgacccggaaacggaaccgttaacccgggtcggttcgtttaaccgttcgttgggttaacggacgggttaagggttaggtagggggttaaggaacgggttaacccgggttaacgggg

SEQ ID NO: 421110 - DNA, 636 bp, Homo sapiens
  misc_feature: GZ8MTXP01DT28N.51.37.D04.1.454.CMB.2.raw
  modified_base (346)..(346): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggacgggtccctgagtactctcctgtgcagcctcgtggatcaccttcagtgctactcatgagctggactccgcaggctcgaggggagggctgcaggtggtctcgactattagttagngtaactaagtgggggaaactaaacccataactttccgaacgcaaggtaccttcgtaggtacgggaaacggggtccctaatttcctaccctaattccctacccggaaacggggaacccaaaacccgggccccaaaaggggtaaacccttccgtaaaccgttggttaactccgtagaacctaaaaagttcgaaactaggtacctaaagggaacgacccggaaaggacccgaacggtccgtgttactttcgaggtgcggtaaggttgggagggagtaagggttcgtaacgggg

SEQ ID NO: 421111 - DNA, 602 bp, Homo sapiens
  misc_feature: GZ8MTXP01C4TBB.51.37.D04.1.454.CMB.2.raw
  modified_base (548)..(548): a, c, t, g, unknown or other
  modified_base (563)..(563): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggacggtccctgagtactctcctgtgcagcctctggactcaccttcaggtgctacttcatgagctggactcccgccaggcctacggagggggaaggggctggcaggtgggtcctaccactattagttagcgaacttaaagtggggaaacaaacccactatttccaacggcaacgtacgttcgtaggaacggtaacggggccctaattccgtaccaattcccgtaccgaagggaaccaaaccggaccaaaggtaacctcgaacttgtactctagactaaagtgaaacagtacaaggaacgacgaagaccgacggtccgtnttaccgttcgttggnggtacgtaagggtggtacggggagtaacggcggtaacgg

SEQ ID NO: 421112 - DNA, 676 bp, Homo sapiens
  misc_feature: GZ8MTXP01BOW1S.51.37.D04.1.454.CMB.2.raw
  modified_base (272)..(272): a, c, t, g, unknown or other
  modified_base (357)..(357): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctggagggtccctgagactctcctgtgcagcctctggatcaccttnagtgctactcatgagctggatccgcaggctccgagggagggctgcgagtgggtctcactatattagtgaactaaagtgggggaanaaacccactatttcctaacggcaaggacttcgtggtacggaaacggggcccgtaatttccctaccctaattcccgtaccgaaacgggggaacccaaaaccgggacccaaaaggggtaacccttacaaacccgtttggttaaacttcccgttaaggaacctaaaaagttcggtaaaaacttacggttaaacccgtaaaaggaaccggaaccccggaaaaggacccgttaaaccgggtcccggttaggttaacccgtttcgttgggtaacggcggtaaggttgggtacgggggaaggaacgggttaaccgttaaccggggg

SEQ ID NO: 421113 - DNA, 524 bp, Homo sapiens
  misc_feature: GZ8MTXP01DIL3M.51.37.D04.1.454.CMB.2.raw
  modified_base (340)..(340): a, c, t, g, unknown or other
  modified_base (354)..(354): a, c, t, g, unknown or other
  modified_base (379)..(379): a, c, t, g, unknown or other
  modified_base (399)..(399): a, c, t, g, unknown or other
  modified_base (445)..(445): a, c, t, g, unknown or other
  modified_base (495)..(495): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggaggtccccgagactctcctgtgcagcctctggattcaccttcagtggctacttcatgagctggatccgccaggctccgaggggaagggctgcagtggtctcacatattagngctaaatggggaanaaaccacattctacgcagactctgngaagggccattctccattcnccagggacaacgcaaacgtactcacgtgtactctgcaaatgaaacngtacctaagagaacccgaagaccgtacggccgtgtacgttcttgttcggngagtggagggagaggtaacgttaacggtg

SEQ ID NO: 421114 - DNA, 645 bp, Homo sapiens
  misc_feature: GZ8MTXP01ERD3R.51.37.D04.1.454.CMB.2.raw
  modified_base (271)..(271): a, c, t, g, unknown or other
  modified_base (356)..(356): a, c, t, g, unknown or other
  modified_base (363)..(363): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctggagggtccctgagctctcctgtgcagcctctggatcaccttnagtgctacttcatgagctggactcccgcaggcctccgagggggaagggctgcaggtcggtctcactattattagtgaacttaagnggggaanaaacccatacttcacgcacgactcgtaggaaggaacggggccctaatttccctaccgtaattcccgtaccggaacggggaaccaaaccgggaccccaaaaggggaacccttcgaaaccgttggtaaacttccgaggaaccaaaagttcgaaaaccgtaggttaacgaaaggaacgaacccggaaaggaccgttaccgggtaccgttacgttaacccgtttcgttagggtcggacgggtaaggttggggtagggggagtaacggggttaaccgttaacggggg

SEQ ID NO: 421115 - DNA, 729 bp, Homo sapiens
  misc_feature: GZ8MTXP01B6M1N.51.37.D04.1.454.CMB.2.raw
tcagcgatcgtatacacgaccggtgctcgatttagtagcatactgttgagctctgggagaagagccccagtcccagaattcccaggagttttccattcggtgatcagcactgaacacagaggactcaccatggagtttgggctgagcttgggttttccttgttgctattatagaaggtgtccagtgtcaggtgcagctggtggaatcgtgggggagtcttggtcaagccgtgggacgggtccctgacgctctcctgtgcagcctcgtggatcaccttcagtgctacttcatgagctgactccgcagctcgagggaggctgcaggtggtctcacattagttagtgaacttaagtggggaacaaaccactaactttccaacggccaaggtaccttcgtagggaacgggaaacggggcccgttaatttcccgtaccctaagttccccgtaccgaaacgggggaaccaaaacccggaccccgaaaacggggtaaacccttccgtaaaccgtttacggtttaaacttccgttaacggaaacctaaaaagttaccggaaaaccgtaacggtttaaacccgtaaaagggaacccgggaaaccccggaaaagggaaccccggaacccggggttaccccgtttagggtttaaaccctttccggttagggttaacgggacgggtaagggttcgggggtagggggaaacgggtaacgggttaaaccggtttaacgggggg

SEQ ID NO: 421116 - DNA, 594 bp, Homo sapiens
  misc_feature: GZ8MTXP01B2Y28.51.37.D04.1.454.CMB.2.raw
  modified_base (243)..(243): a, c, t, g, unknown or other
  modified_base (288)..(288): a, c, t, g, unknown or other
  modified_base (293)..(293): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcctcactctctgcacaggctctgaggcctcctatgagctgacacagccagcctcggtgtcagtcgtccccaggacagacggccaagactcccctgctctggagatgcattgaccaaaagttnttgtcttttagacacagacgcagcacgcctataataatatataanaaganagtagagacgcctagacggtactacccgtagacgtacgtacttctcgtcggtccctccagtccgtacgaacgggaaaccaacgcgaccgtaacggttacgaacgtagttaggtacggacgtacgaggacgaaggaacgacggacgactagtacttattacgtagtacaatacgaggacgaacgaacgacgtagtagtacgttagtaggtacgtggtacggacgggaggaaccgtaaggttcgtaccgttcgtacgtcgacgccgacgcctccgccccgtcgtcttacctccgttccgtccc

SEQ ID NO: 421117 - DNA, 539 bp, Homo sapiens
  misc_feature: GZ8MTXP01EHVGC.51.37.D04.1.454.CMB.2.raw
  modified_base (325)..(325): a, c, t, g, unknown or other
  modified_base (362)..(362): a, c, t, g, unknown or other
  modified_base (403)..(403): a, c, t, g, unknown or other
  modified_base (409)..(409): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtggggggagcttggtcaagccgtgggacgggtccctgagactctcctgtgcagcctctggtactcaccttcagtggctactcatgagctggactccgcaggctcgaggggaggctgcnggtggtctcactatagtagtgaactaagtcggggaanaaccatattacacgcagactcgtagaggacgggcctattcnctatcncgaggacaacgcaaggactcactgtactctagacaaatgaactagtaccaaggaacgacgaagacgaccggtctagttacgttcgttggtgcggtaaggttgggagggacgtaacggttaacgtaacggg

SEQ ID NO: 421118 - DNA, 545 bp, Homo sapiens
  misc_feature: GZ8MTXP01EVKIK.51.37.D04.1.454.CMB.2.raw
  modified_base (262)..(262): a, c, t, g, unknown or other
  modified_base (342)..(342): a, c, t, g, unknown or other
  modified_base (357)..(357): a, c, t, g, unknown or other
  modified_base (401)..(401): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttgggtcaagcctgggagggtccctgagactctcctgtgcagcctntggatcaccttcagtgctacttcatgagctggactccgcaggctcgaggggagggctgcaggtggtctcactatattagngactaagtggggaanaaccatattcacgcagactcgtggaaggaacgggcctatttccncatccacgagggaccaacgccaaaggactcactgtactctgacaaatgaaacagtacaaagcgaaccgaagaccgacggtccgttagttacgttcgttaggtcgcggtaaggtgggtaggggagtcgggttaaccgtaacgggg

SEQ ID NO: 421119 - DNA, 715 bp, Homo sapiens
  misc_feature: GZ8MTXP01AEZDP.51.37.D04.1.454.CMB.2.raw
  modified_base (264)..(264): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagccgtgggacgggtccctgacgactctcctgtgcagcctntggatcacttcagtggctactcatgagctggactcccgcgacggcctccgagggggacgggctgcgtaggtcgggtctacgacattagttaggtgtaaactaaaggtcggggaaactaaacccaattacgtttaccgacgacacggtaccttccgtgggtacgggtaaacggggtcccgtagtttcccacctacgttccgacccggtaaaggggaacccaaaccgggaacccaaacggggtaacctccgtaacgttacgttactaccgtacgaaccttaaagtacgggaaactacgggttaacgtaaaggaaccggaaccgaaacgggaaccccgttaacggggtcccggtttaacgttaacgttttcccggttagggttaacccgggcgggtaaggggtttcggggacgggggttaagggtaacgggttaacccgggtttaaccgggggg

SEQ ID NO: 421120 - DNA, 535 bp, Homo sapiens
  misc_feature: GZ8MTXP01BWAFL.51.37.D04.1.454.CMB.2.raw
  modified_base (333)..(333): a, c, t, g, unknown or other
  modified_base (499)..(499): a, c, t, g, unknown or other
  modified_base (507)..(507): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggaggtccctgagactctcctgtgcagcctctgatcacttcagtgctacttcatgagctggatccgcaggctcgagggagggctgcaggtggtctcgacatatgngactaagtggggaacaacccatacttcgtacgcagtactctaggaggaacggggtccaattccctcaatcctaccggaagggacaacgtccaaaggtaactcaactgtactctgacaaatgaactagtactaagaacgcgaaagaccgcggtcgtgttacttccgngtaacggngtaaggtggagggacgtaacggcgtaag

SEQ ID NO: 421121 - DNA, 645 bp, Homo sapiens
  misc_feature: GZ8MTXP01DN5UH.51.37.D04.1.454.CMB.2.raw
  modified_base (354)..(354): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggagggtccctgagactctcctgtgcagcctctggatcaccttcagtggctacttcatgagctggactcccgcaggctccgagggggaggggctggcaggtgggtcctcgactattagtttacgngaacttaaagtgggggaactaaacccacgtacttcctaacgcaagtactcgtaggtacggaacgggtcctatttcctcctaatcccgaccgaggggaacccaaacgggacccaaaaggggtaaccttaccaacgttacgtaaatccttaggaactaaaattcggaaaacctaggtaacctaaagggaacgtaacccgaaacggaccgaacccggggtcccgttaggttaccctttcgttgggtcgtacgggtggtagggtagggggagtaacggggttaacgtaacggggg

SEQ ID NO: 421122 - DNA, 611 bp, Homo sapiens
  misc_feature: GZ8MTXP01C3XVD.51.37.D04.1.454.CMB.2.raw
  modified_base (262)..(262): a, c, t, g, unknown or other
  modified_base (352)..(352): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggcaagccgtggacgggtccctgacgactctcctgtgcagcctntggatcacttcagtgctactcatgagctggactcccgcgaggcctccgagggggacgggctgcgaggtggtctaccgactattagttagngaaccttaaaggtggggaaacaaaccctatactttaccgacgctaagaccttcgtaggaagggaacgggcctaattcccactactccgtaccgagggaaccaacggaccaaaggaacctctaaacgttcgtaatcctagaactaaaagtcgaaactagtaccgaaaggaacgaaccgaaaggacccgacggtcccgttagttacccgttggttaggtcgacggtaaggttgggagggacgtaacgggttcgtaacgggg

SEQ ID NO: 421123 - DNA, 603 bp, Homo sapiens
  misc_feature: GZ8MTXP01E1XEE.51.37.D04.1.454.CMB.2.raw
  modified_base (351)..(351): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagcgtggtggaatcgtgggggagcttggtcaagcctgggaggtccctgagactctcctgtgcagcctctggatcaccttcagtgctacttcatgagctggactcccgcgaggcctacggagggggacgggctgcaggtcggtctacactatagttagngaacttaagtggggaaacaaacccatactttacgacgcaagtacctgtaggtagggaacgggtcctaatttcccaccacgttcccgaccggaacggggaaacccaaaccggacccaaaaggtacccttacgaaccttgtaaactccgtagaacctaaagtgaaacctagtacaaaggcgaccgaaagccgacggtcgttacgttacgttcgttggcggacgtaaggttggaggggagtaacggcgtaacggg

SEQ ID NO: 421124 - DNA, 537 bp, Homo sapiens
  misc_feature: GZ8MTXP01CAL6L.51.37.D04.1.454.CMB.2.raw
  modified_base (342)..(342): a, c, t, g, unknown or other
  modified_base (357)..(357): a, c, t, g, unknown or other
  modified_base (373)..(373): a, c, t, g, unknown or other
  modified_base (378)..(378): a, c, t, g, unknown or other
  modified_base (392)..(392): a, c, t, g, unknown or other
  modified_base (491)..(491): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttgggtcaagcctgggacgggtccctggagactctcctgtgcagcctctggatcaccttcagtggctacttcatgagctggatccgcaggcctccgagggaggctgcagtggtctccacatatagngaactaagtgggganaaacccatattcacgnagctntgagacggcattcncatcacagggacaacgccaaagactcactgtatcgtagactaaagtgaaactagtacctaaagaacgaccgaagaccgacgggtccgtgttacgttcgnggttggacggtaaggttgggaggggagaacgggttaacgtaacggg

SEQ ID NO: 421125 - DNA, 537 bp, Homo sapiens
  misc_feature: GZ8MTXP01E16TK.51.37.D04.1.454.CMB.2.raw
  modified_base (291)..(291): a, c, t, g, unknown or other
  modified_base (355)..(355): a, c, t, g, unknown or other
  modified_base (362)..(362): a, c, t, g, unknown or other
  modified_base (368)..(368): a, c, t, g, unknown or other
  modified_base (400)..(400): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggaggcttgggtcaagcctgggagggtccctgagactctcctgtgcagcctctggatcaccttcagtggctacttcatganctggatccgcaggctccgagggggagggctgcaggtgggtctccactatattagtgacttaagnggggaanaaccanattcacgcagactcagagaagggccgattccncatccacagggacaacgccaaggactcactgtatcgtgacaaatgaaactagtaccgtaaaggaacgacgaagaccgcgggtccgtagttcgttcgttggtgcgtggttcggaggggacgcgggttaacgtaacggg

SEQ ID NO: 421126 - DNA, 559 bp, Homo sapiens
  misc_feature: GZ8MTXP01AVNFU.51.37.D04.1.454.CMB.2.raw
  modified_base (336)..(336): a, c, t, g, unknown or other
  modified_base (349)..(349): a, c, t, g, unknown or other
  modified_base (369)..(369): a, c, t, g, unknown or other
  modified_base (403)..(403): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggagggtccctgagactctcctgtcgcagcctctggatcaccttcagtgctacttcatgagctggactcccgcaggcctccgagggggagggctggcaggtcggtcnccatatagttagngaactaagcgggacaaaccntactcacgcagactgaggaggaaggcctattccncatccacgagggaccaacgccaaaggactcgactagtatcgtagaacaaatgaaacagtaccaaaggaacgaccgaaagaccgcgggtcccgtagttacccgttgttggtaacggcggtaagtggggtgggaagtaacgggttaaccgtaacgggg

SEQ ID NO: 421127 - DNA, 602 bp, Homo sapiens
  misc_feature: GZ8MTXP01DPBMG.51.37.D04.1.454.CMB.2.raw
  modified_base (255)..(255): a, c, t, g, unknown or other
  modified_base (425)..(425): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggtttttccttgttgctattatagaaggtgtccagtgtcaggtgcagcgtggtggaatcgtggggggagcttggcaagcctgggacggtccctgagtctctcctgngcagcctgtggtatcaccttcagtggcttacttcatgagctggactcccgcgaggcctacggagggggagggctgcgaggtcggtctaccatatagttagtcgaactaagtgggaaacaaacccagtacttcgacgcagtacctgtaggaacgaacgggctattccaccngttcccaccggaacggaaccaaacggacccaaaggtaaccctcgtaactcgtaatccagaacaaaagtgaaacctagtacctaaaggccgaaccgaaggacccgttaaccggtccgttgttacccgttgcgggtaacgaggtgggtgggtagggaggtaacggttaacgtaacgggg

SEQ ID NO: 421128 - DNA, 718 bp, Homo sapiens
  misc_feature: GZ8MTXP01BV0PB.51.37.D04.1.454.CMB.2.raw
  modified_base (347)..(347): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttgggtcaagcctggagggtccctgagactctcctgtgcagcctctggactcaccttcagtggctacttcatgagctggactcccgcaggctccgagggggagggctgcaggtgggtctcgacatagttagnggaaactaaagtgggggaaacaaacccgactaacgttttccgaacggacaaacggtacccttccggtaagggaaacgggaacggggggtacccctaagttttaccccgtaccctaaagttccccgtacccggaaacggggggaaacccaaaacccgggacccctaaaagggggtaaaacccttacctaacccggttaggtttaaactcccggtaagtaaccctaaaaagttcggaaaaccctaaggttacccttaaaaggggaaccggaacccggaaaggtaacccgaaccgggttcccgtaggttacctttcgttggtcggtacggtaaggtaggggttggggaaggtaacggttaacccggttaagggg

SEQ ID NO: 421129 - DNA, 628 bp, Homo sapiens
  misc_feature: GZ8MTXP01BLIH4.51.37.D04.1.454.CMB.2.raw
  modified_base (243)..(243): a, c, t, g, unknown or other
  modified_base (257)..(257): a, c, t, g, unknown or other
  modified_base (290)..(290): a, c, t, g, unknown or other
  modified_base (293)..(293): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcctcactctctgcacaggctctgaggcctcctatgagctgacacagccagcctcggtgtcagtgtccccaggacagacggccaagactcccctgctctggagatgcattgaccaaaacgttnttgtctttagacanagagcagcacgcctataatatatataataaganagngagacgcctagacggtactcccgtgacgtcgtattcgtcgtcggtccctccgagtcgtacgaacggaacaacgcgtacccgtaacggttagacgtagttaggtacgggtacgtaccgaggacgaaggtaacggacggaggactagtacttagtacgtgtacaatcgacggacgaagaacgacgtaggttacgtacgttaggtaggtagttacggtacgggacgggaacgggaaccggtaagggttccggacccgttcggtacggtaccgacggcccgaacgggtccctacccggtcccccgttcggtaccttacccgttccgttcccgttccccg

SEQ ID NO: 421130 - DNA, 619 bp, Homo sapiens
  misc_feature: GZ8MTXP01EYRSM.51.37.D04.1.454.CMB.2.raw
  modified_base (361)..(361): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagccgtgggacggtccctgagtactctcctgtgcagctctggtatcacttcagtgctactcatgagctggactccgcaggctccgaggggaggctgcaggtggtctacactatagttagtcgaactaagtggggaaanaaaccctacgtaacttcctacggcaagaccttcgtaggaagggaacgggcctaatttccctacctattcccgaccgaacggggaacccaaaccgacccgaaagggaacccttcgtaaacttggtaactcgttacggaactaaaacgtcggtaaaactacgtaacgtaaaggaacgtaaccgaaacggacgaccgggtcccgtgttacccttgttagtcggagtaaggttgggaggggaagtcgggttaacgtaacggg

SEQ ID NO: 421131 - DNA, 658 bp, Homo sapiens
  misc_feature: GZ8MTXP01DVEQJ.51.37.D04.1.454.CMB.2.raw
  modified_base (291)..(291): a, c, t, g, unknown or other
  modified_base (349)..(349): a, c, t, g, unknown or other
tcagcgatcgtatacacgaccggtgctcgatttagtagcatactgttgagctctggggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtggggggagtcttggtcaagccgtgggaggtccctgagtactctcctgtgcagcctcgtggactcaccttcagtggctacttnatgagctgatcccgcaggctccgagggggaggctgcgtagtggtctcactatattagngtaactaaagtggggaactaacccacttatacgtacggctaagaccttcgtaggaacgggaacgggtcctaattccaccaagtcccgtaccggaacggggaaccaaaccgcccgaaaaggggtaaccctcgtaacgttacgttactacgttacgaacctaaaaagttcgaaaaccgtaggttaacccgtaaaaggaaccggaacccggaaaggaacccgttaaacggggtcccgttacgttaaccgtttcgttagggtggaaccggtggtaggggtacggggaaagtcggggttaaccgttaacggggg

SEQ ID NO: 421132 - DNA, 719 bp, Homo sapiens
  misc_feature: GZ8MTXP01AN06C.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagtcttggtcaagcctgggagggtccctgagctctcctgtgcagcctcgtggatcacttcagtgctacttcatgagctggactcccgccgaggcctccggagggggaacgggggctggacgtaggtcggggtctcccgaactagttagtttaggcgtaaacttaaaggtgggggaaacaaaccccgtactactttaccgtaacggctaacgtaccttcgagggaacggtaaacggggcccttaattcccgtacctacgttcccgacccgggaacgggaaaccctaaaccgggaccccaaaacggggtaacccttctaacgttcgttaactccttaggaaaccctaaaagttcggaaaacctaacggttaacgaaacgggaacgtaacccggaaagaaacccggttcccggggtaccgtttacggtttacccgtttcggttgggtccggtacgggtgggtttagggggtagggggaacggtaacgggggttaaccgttaaccggggg

SEQ ID NO: 421133 - DNA, 571 bp, Homo sapiens
  misc_feature: GZ8MTXP01AOXNX.51.37.D04.1.454.CMB.2.raw
  modified_base (261)..(261): a, c, t, g, unknown or other
  modified_base (483)..(483): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaaggcctgggagggtccctgagctctcctgtgcagcctntggatcaccttcagtgctacttcatgagctggactccgcaggcctccggaagggagggctgcgaggtgggtctccgactatagttaggtcgacttaaagtggggaacaaacccatacgtttcacggcaacgacttcgaggaacggaacgggcccgtaattccacctaatcccgtacccgaagggaaccaaccggacaaacggggaacttcacttgtactccngacaaatgaaccagtacaaggaacgaccgaaagcgacggcgtgttacttcgttgtgcgtaaggttgaggggagtaacggcgtaacggg

SEQ ID NO: 421134 - DNA, 567 bp, Homo sapiens
  misc_feature: GZ8MTXP01ARC9N.51.37.D04.1.454.CMB.2.raw
  modified_base (334)..(334): a, c, t, g, unknown or other
  modified_base (534)..(534): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggaggtccctgagactctcctgtgcagcctctggatcacttcagtgctacttcatgagctggatccgcaggctcgagggagggctgcaggtggtctcactatatgngaactaagtgggaacaaccatacttctacgcatacctgtggtacgggaacgggcctattcctacctatccgtaccgaacgggaaccaaccggaccaaagggtaactctaacttagtacttcgagaacaaagtagaaaccgtagtaactaaaggaacgacccggaaagaccgacggtcgttaggttaccttgttaggtcgngtaaggtgggagggacgtaaggaacgtaacggg

SEQ ID NO: 421135 - DNA, 626 bp, Homo sapiens
  misc_feature: GZ8MTXP01AR7SM.51.37.D04.1.454.CMB.2.raw
  modified_base (253)..(253): a, c, t, g, unknown or other
  modified_base (255)..(255): a, c, t, g, unknown or other
  modified_base (260)..(260): a, c, t, g, unknown or other
  modified_base (268)..(268): a, c, t, g, unknown or other
  modified_base (334)..(334): a, c, t, g, unknown or other
  modified_base (350)..(350): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctggagggtccctgagactctcctgtncngcctngatcactnagtgctactcatgagctgactccgcagctcgagggaggctgcaggtcggtctcactattagttagngaactaagtcgggaanaaccatacttcgacgcagactcgtggaaggtacgggcctagtttccacctatccgtaccgaaggggaaccaacgaccgaaacgggtaacctactacgttacgtattccgtagaactaaaagttcgaaactacgttacgaaaaggaaccggaacccgaaagggtacccgacccggggtaccgtttacgtttaacccgtttcggttgggttaacggggccggtaaggggtttacggggagggggaacgggtaaacgggttaaccccggttaacggggg

SEQ ID NO: 421136 - DNA, 624 bp, Homo sapiens
  misc_feature: GZ8MTXP01DRJ5H.51.37.D04.1.454.CMB.2.raw
  modified_base (259)..(259): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagccgtggaggtccctgagctctcctgtgcagcctntggtatcacttcagtcgctctcatgagctggactcccgcgaggctccggaggggagggctgcaggtggtctcactatatagtgaacttaagtgggaacaaacccacgtatttaccgacgcaagtcctagtaggaaggaacggggtcctaatttccgtcctaatcctaccgaacgggaaccaaacgacccaaaggacctcaacgttacgtatcgtacgaacaaaagtcgaaactacgtacgtaaaggaacccggtaaccgaaacgggtaaccgttaccgggtccgtttacggttaacccgtttcggttgggtaaccggaggtaagggttggggacgggagggtaacgggttaaccgttaacggggg

SEQ ID NO: 421137 - DNA, 682 bp, Homo sapiens
  misc_feature: GZ8MTXP01BGT5B.51.37.D04.1.454.CMB.2.raw
  modified_base (252)..(252): a, c, t, g, unknown or other
  modified_base (259)..(259): a, c, t, g, unknown or other
  modified_base (360)..(360): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtgggtttcctgttgctattatagaagtgtcagtgtcaggtgcagctggtggaatcgtggggggagcttggtcaagcctgggagggtccctggagactctcctgtncagcctnggatcacttcagtgctacttcatgagctggactcccgcaggctaccgagggggaagggctggcaggtggtctacccatatattagtgactaagtggggaanaaacccactactttcgaacgcaacgacttacgaggaagggaacggggccctaaatttcccgtacccgtaatttcccccgtaaccggaaacgggggaacccaaaaccgggttacccccaaaaaggggtaaaccccttacccgtaacccttagggttaaacttcccggtaaacgtaaacctaaaagtaccgtaaaacgtaagttaaccgaaaggaacccggaaccgaaacggtaacccgacgggttacccgttacgttaccgttcgttcggtggtacgggtaagggttggggtacggggaggtaacgggttaaccggtaacggg

SEQ ID NO: 421138 - DNA, 697 bp, Homo sapiens
  misc_feature: GZ8MTXP01ADU8B.51.37.D04.1.454.CMB.2.raw
  modified_base (643)..(643): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagccgtgggacgggtccctgacgacctctccgtgtcgcacgtcctgtggtactcctaccttgaggtcgtaccttactcagtggacgtcgtaggacctcccgaccgacggtcccgtaccgggaagggggacggggtctcggacgtagggtcggtacctaccgaactagttagttagcggtaaacttaaggtcggggaaaccaaacccgtataccttacgacgactagtaccctagtaggaaggaaccgggccttattccctacacgttacccgaccggaaacggggaacctaaacccgtaccgaaaacgggtaccctaccgtaacgttacggtaactaccgagaaactaaacgtacgaaacgtagtaacgaaacgggaacaccggaaacgaccggacccggttcgtaacgttcgtttcggngggtaacggaggtaacgggtggggacggttacggtaaccggttaacggtaacgg

SEQ ID NO: 421139 - DNA, 685 bp, Homo sapiens
  misc_feature: GZ8MTXP01A0NH9.51.37.D04.1.454.CMB.2.raw
  modified_base (361)..(361): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtggggggagcttggtcaagcctgggacgggtccctgagactctcctgtgcagcctctggtatcaccttcagtgctacttcatgagctggactcccgccaggctccgagggggagggctggcgtaggtcggggtactaaacccgtattagtttagngaccgttaaaaagtggggaaccaaaccctatactttaccgtacggcgaagtaccttcgtaggtacgggaaacggggtcccgtagtttaccctacccgtagttacccgtcccggaaacgggaacccgtaaaccgaccccgtaaaaggaacccgttacaaccgttaggttaactccgtaaggaactaaacgtacggaaacttaggtaacctaaaggacggaaccccggaaaggacccgtaccgggaccgttgttaaccgttgttcggttcgtccggtagggtcgggttgggggaggttaacgggtaaccggttaacggggtaaccg

SEQ ID NO: 421140 - DNA, 509 bp, Homo sapiens
  misc_feature: GZ8MTXP01DNNHM.51.37.D04.1.454.CMB.2.raw
  modified_base (283)..(283): a, c, t, g, unknown or other
  modified_base (333)..(333): a, c, t, g, unknown or other
  modified_base (348)..(348): a, c, t, g, unknown or other
  modified_base (388)..(388): a, c, t, g, unknown or other
  modified_base (433)..(433): a, c, t, g, unknown or other
  modified_base (435)..(435): a, c, t, g, unknown or other
  modified_base (438)..(438): a, c, t, g, unknown or other
  modified_base (442)..(442): a, c, t, g, unknown or other
  modified_base (485)..(485): a, c, t, g, unknown or other
  modified_base (487)..(487): a, c, t, g, unknown or other
  modified_base (490)..(490): a, c, t, g, unknown or other
  modified_base (493)..(493): a, c, t, g, unknown or other
tcagcgatcgtatacacgaccggtgctcgatttagtagcatactgttgagctctgggagaagagcccccagtcccagaattcccaggagtttccattcggtgatcagcactgaacacagaggactcaccatggagtttgggctgagcgtggtttctgtagctatatagagtgtccagtgtcaggtgcagctggtggaatcgtggggggagcttggtcaagcctggagggtccctgagactctcctgtgcagcctctggatcaccttcagtgctacttcatganctggatccgcaggctccgagggaagggctgcagtggtctcacatattagngaactaagtgggganaacccatattcacgcagactctagtgaagggcctattccnccattccaccgagggacaacgccaaaggaactcactgtatcgtananaanatanagtacgagaacgacgacgacgacgcgtcgttcgttcgttgtgngnggnggnggaggtaaggcgtaag

SEQ ID NO: 421141 - DNA, 619 bp, Homo sapiens
  misc_feature: GZ8MTXP01BF4WH.51.37.D04.1.454.CMB.2.raw
  modified_base (261)..(261): a, c, t, g, unknown or other
  modified_base (282)..(282): a, c, t, g, unknown or other
  modified_base (337)..(337): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagccgtgggaggtccctgagtctctcctgtgcagcctntggatcacttcagtgctactnatgagctggatccgcaggcctcgaggggaggctgcaggtggtctccactatatgngactaaagtggggaacaaaccatactttccgaacgcagtacctcgtagggtaggaacggggcctatttcccgaccgtatcccgtaccggaaaggggaacccaaaccgggacccaaaaggggtacctaccgtaaccttaggtaaactcctaggacccaaaagtcgaaaacctggttaactaaaggaacgtaaccggaaaggacccttacggggccgttagttacccgttgttcgggttgacggtaaggtgggtgggggaacgaacgggttaacgtaaccgggg

SEQ ID NO: 421142 - DNA, 606 bp, Homo sapiens
  misc_feature: GZ8MTXP01ASFXK.51.37.D04.1.454.CMB.2.raw
  modified_base (293)..(293): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttgggtcaagcctggacgggtccctgagactctcctgtgcagcctctggtactcaccttcagtggctacttcatganctggactccgcaggctcgagggagggctgcaggtggtctccgactatattagtcgaacttaagtgggaaacaacccactatttcaacggcaagacctcgtagaacgggaacggggcctaagttcccacctaattcccgaccggaaacggggaccaaaaccgggacccaaacgggggtaaccttcgaaccgttaggtactctacgacaaagtcgaaaccgtagtacgtaaagcgaccgaaagacccacgggtcccgtgttaccttcgttacggtggcgtaagggtgggtagggacgtaacggaacggtaacggg

SEQ ID NO: 421143 - DNA, 679 bp, Homo sapiens
  misc_feature: GZ8MTXP01DTV57.51.37.D04.1.454.CMB.2.raw
  modified_base (248)..(248): a, c, t, g, unknown or other
tcagcgatcgtatacacgaccggtgctcgatttagtagcatactgttgggtttgggggtgggtccaggaggcagaactctgggtgtctcaccatggcctggatccctctacttcctccccctcctcactctctgcacaggctctgaggcctcctatgagctgacacagccagcctcggtgtcagtcgtccccaggacaggacggccaagactcccctgctctggagatgctattcgacctaaaacgtntttgtctttttaggacaacagaagccaggccacgaccctaataataattataataataaagacagtgagacggccctagagggactcccgtagacgcgtacttctcgtacggtcccctaccgacgtctacgaacggggaaaccaaacgcgaccgtaacggttagaacgtagttaggtacgggacgtacccgaaggacgaaggaacggtacggaaggtactaggtaacttagttacgtagtacaaagtcaagggacgaaggacgaacgtaggtgttaacgttagtagggtagttaggttcggggacgggaacgggtaacgtaacgggttcggtaccccggttaccgtaagggtaccgaacccggttcccggaaacggtcccgtcccggcccccgttcggtacccttaccgttcccgttcccgttaacccccc

SEQ ID NO: 421144 - DNA, 665 bp, Homo sapiens
  misc_feature: GZ8MTXP01CWGUT.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagtcttgggttttccttgttgctattatagaaggtgtccagtgtcaggtgcagctgggtggaatcggtggggggagtcgttggtacaagcccgtggggacgggtccctggacgtacctctcctggtgcagcctctggactccaccttcagtgcttactcatgagcgtggactcccgccgaggcctccggagggggagggctggcgtaggttcgggtcctaccgactagttacgttagtgaacgttaaagtggggaaactaaacccacttacttccaacgcaaagtacctcgtagggaaggtaaccgggcctattacctaccacgtcccgtaccgaaacggggaaccaaccgtaccaaacgggtaacctacacgttacgtactccaggaaacctaaagtcgaaacgtaagtaccgaaggaacgaacccggaaggacccgacgggtccgttggttaacccttgggttacggtggacggtaagggttgggtacggggaaggtaacgggttaacggttaaccgggg

SEQ ID NO: 421145 - DNA, 601 bp, Homo sapiens
  misc_feature: GZ8MTXP01CCEIT.51.37.D04.1.454.CMB.2.raw
  modified_base (449)..(449): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcctcactctctgcacaggctctgaggcctcctatgagctgacacagccagcctcggtgtcagtcgtccccaggacagacggccaagactcccctgctctggagatgcattgaccaaaagttttgctttttaggaccaacagaagccaggccagaccctaataataattataataataaagacagtagagacggccctacgagggtactcccgtagacgtcgtattctcgtcggcccctccagctacgagggaaacaacgcgacctaacggttagacgtagttaggaggacgtaccgaggacgaaggaagacgaggactagactatacngtacaatcgaggacagacgacagtagtacttagtaggagtagtcggaggagggaacctaagggttcgaaacccgttcgtaaacggtcaaccgcccggaacgccgtacccgcccccgttcggtccacccgttaaccgttcccgttaacccccg

SEQ ID NO: 421146 - DNA, 563 bp, Homo sapiens
  misc_feature: GZ8MTXP01BO0BE.51.37.D04.1.454.CMB.2.raw
  modified_base (357)..(357): a, c, t, g, unknown or other
  modified_base (498)..(498): a, c, t, g, unknown or other
  modified_base (511)..(511): a, c, t, g, unknown or other
  modified_base (520)..(520): a, c, t, g, unknown or other
  modified_base (528)..(528): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctggagggtccctgagctctcctgtgcagcctctggatcacttcagtgctactcatgagctggactcccgcaagcctacgagggggagggctgcaggtggtctccacatagtagtgaactaagtggggaanaaacccactattaccgtacgcaagactacgtaggaaggaacgggcctatttaccctaccattccaccgaagggacaaacgcccaaaggaacctcgactagtactcagacaaaagtgaaacagtacaaggaacgccggaaanaccgcggtcgttnttacgttcnggtaacgngaaggtgggtagggagtaacgggaacgtaacgggg

SEQ ID NO: 421147 - DNA, 625 bp, Homo sapiens
  misc_feature: GZ8MTXP01A0NA9.51.37.D04.1.454.CMB.2.raw
  modified_base (178)..(178): a, c, t, g, unknown or other
  modified_base (286)..(286): a, c, t, g, unknown or other
  modified_base (582)..(582): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtntccagtgtcaggtgcagcgtggtggaatcggtgggggagtcttggtcaaggccgtgggacgggtccctggacgtactctcctgtcgcacgcctgtggtactcaccttnagtcgcttactcatgagtcgtggactccgcgaggcctaccggagggggacgggtctgcgaggtggtctacactatagttagtgtaaactaagtcgggaacaaccctacgtactttaccgaacggctaacgtacctgtacgggaagggaacgggtccttaatttccctactactcccgtaccggaacgggaaccaacgacccaaagggtacctctaaccttgtaactcgtacaacaaagtacgaaactagtacgaaaggaacgacgaaagccgacgggtccgttagttactttcggnggtaagcggtgggtgggagggacgtaacggttaacggtaacgg

SEQ ID NO: 421148 - DNA, 641 bp, Homo sapiens
  misc_feature: GZ8MTXP01BM3X0.51.37.D04.1.454.CMB.2.raw
  modified_base (275)..(275): a, c, t, g, unknown or other
  modified_base (357)..(357): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcggtgggggagcttggtcaagccgtgggaggtccctgagtctctcctgtgcagcctgtggatccaccttnaggtgcttacttcatgagctggactcccgcgaggcctccggagggggagggctggcgtaggtgggtctcactattagttagngaactaagtcggggaaacaaacccgatactttcaacgcagtacctgtaggtacggaaacggggtccttaatttccctacctaagttcccgtacccggaaacgggtacccaaaacccggaccccaaaaggggtaacccttaccgtaaccgttaggttaacctccgttaacgaacctaaaagtcgaaacctagttacgaaaggaacgaaccgaaagaccacgggtaaccctagttacggttcttcgtggtcggcgtagggtggttagggggaagaacgggtaacgg

SEQ ID NO: 421149 - DNA, 693 bp, Homo sapiens
  misc_feature: GZ8MTXP01DPH03.51.37.D04.1.454.CMB.2.raw
  modified_base (266)..(266): a, c, t, g, unknown or other
  modified_base (292)..(292): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggtttttccttgttgctattatagaaggtgtccagtgtcaggtgcagcgtggtggaatcgtgggggagtcttggtcaagcctgggacggtccctgacgtactctcctgtgcagcctntggatcacttcagtgctactcatganctggactcccgcgaggcctaccggagggggaacggggctggaccgtaggtcgggtcctacgaactattagtttaggtgaaaccgttaaagtcggggggaaacaaacccctaacttacgtttaccgaaccggcgtaacgacccgtttacgtagggaaacggggaaacggggcccttaaatttccctacccaatttccccgacccggaaacggggaacctaaaccggacccaaaaggggtaacccttaccaacgttagttactccgtagaactaaaatcgaaactacgttaaccgaaaggaaccggaccgaaagaccgttaccgggtcccgttaggttaccctttcgagggtggaccggtgggttggggtacggggaaggtaacggttaaccggttaacgggg

SEQ ID NO: 421150 - DNA, 515 bp, Homo sapiens
  misc_feature: GZ8MTXP01DKOJN.51.37.D04.1.454.CMB.2.raw
  modified_base (200)..(200): a, c, t, g, unknown or other
  modified_base (253)..(253): a, c, t, g, unknown or other
  modified_base (336)..(336): a, c, t, g, unknown or other
  modified_base (344)..(344): a, c, t, g, unknown or other
  modified_base (350)..(350): a, c, t, g, unknown or other
  modified_base (388)..(388): a, c, t, g, unknown or other
  modified_base (410)..(410): a, c, t, g, unknown or other
  modified_base (417)..(417): a, c, t, g, unknown or other
  modified_base (456)..(456): a, c, t, g, unknown or other
  modified_base (464)..(464): a, c, t, g, unknown or other
  modified_base (473)..(473): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggnggaatcgtgggggagcttggtcaagcctggaggtccctgagctctcctgtgcngcctctgatcactcagtgctatcatgagctggactcccgcaggcctcggaggggaggctgctaggtggtctcactattatagnaactaagngggaanaaacccatattccacgcagacttgagagacggcattcncatcacgagacacgcaagactnactgtancgtagacaaatcgaaactgtacaagaacgccaagacccnggccgttnttaccgttnaggtcgtaggaaggtggtacgggaatcgggaaccgtaacggg

SEQ ID NO: 421151 - DNA, 639 bp, Homo sapiens
  misc_feature: GZ8MTXP01DSEB0.51.37.D04.1.454.CMB.2.raw
  modified_base (251)..(251): a, c, t, g, unknown or other
  modified_base (261)..(261): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagtcttggtcaagccgtggacggtccctgagtctttcngtgcagcctntggacttcaccttcagtggcttacttcatgagctggactccgcaggctaccgaggggaacgggctgcgtaggtggtctcgaactattattagtgacctaaaaggtcgggaacaaacccatacgttacctaacgctaaacggtactcgttaggtacgggaaacgggcccgtaaatttccctaccgtacttacccgtaccgaaacggggaacccaaaccggaaccctaaaaccggtaactacctaaccgttgtaactcgtacggaactaaaagttaccggaaactattacggaaagcggaaaccggaagaccgacgggttcccgttaagtcttacgttggttagcggtaagtgggtagggagagggtaaccgttggaacg

SEQ ID NO: 421152 - DNA, 655 bp, Homo sapiens
  misc_feature: GZ8MTXP01B1GLV.51.37.D04.1.454.CMB.2.raw
  modified_base (262)..(262): a, c, t, g, unknown or other
  modified_base (273)..(273): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggacggtccctgagactctcctgtgcagcctgnggtatcacttnagtgctactcatgagctggactcccgccaggccgtaccggagggggaacggggctggcgaggttcgggtcctccgaactagttagtttaggtggtaaacttaaagggtcgggggaaactaaacccctatacgtttaccgaacggctaacgtacccttgtagggaaacgggaacgggtccctaatttccctaccgaacttcccgaccgaagggaacccaaacgacccgaaacggtaacctaccgtacttacgtaattccgtagaactaaaagtcgaaactagtaacctaaaggaaccgaacggaagacccgacgggtaccgtttagttaccgttcgttggaacggtcggtaaggttgggagggagtaacgggaacgtaacggg

SEQ ID NO: 421153 - DNA, 683 bp, Homo sapiens
  misc_feature: GZ8MTXP01BNB80.51.37.D04.1.454.CMB.2.raw
  modified_base (273)..(273): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggacggtccctgagactctcctgtgcagcctctggatcaccttnagtgctacttcatgagctggactcccgcaggcctaccggaggggagggctgctaggtcggtctaccgactattacgttaggtcgaaccttaaaggtgggggaaactaaacccctactaacttttcccgaacgggctaaggtaccttcgttagggttacgggaaacgggggtcccctaagttttaccccgtacctaacgtttcccgacccggaacgggggaacccttaaacccgggaaccccaaaggggtaaccccttctaaaccgttggttaacgttcctaggaactaaaagtcgtaaaccgtagttaacccgaaaggaaccgaaccgaaaggtacccgacgggtcccgttagttaccgttcgttggtcggcgtaagggttcgggagggagtaacggttcgtaaccgggg

SEQ ID NO: 421154 - DNA, 561 bp, Homo sapiens
  misc_feature: GZ8MTXP01AYRH9.51.37.D04.1.454.CMB.2.raw
  modified_base (275)..(275): a, c, t, g, unknown or other
  modified_base (348)..(348): a, c, t, g, unknown or other
  modified_base (502)..(502): a, c, t, g, unknown or other
  modified_base (513)..(513): a, c, t, g, unknown or other
  modified_base (523)..(523): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagccgtgggacgggtccctgagactctcctgtgcagcctctggatcaccttnagtggctacttcatgagctggactccgcaggctccgagggggaggctgcgaggtggtctcgactatagttagngaactaagtggggaaacaacccatacttctacggctagactcgtaggaaggacgggccctattccacctactcctaccgagggaaccaaccgaccaaaggtactcgacttgtaatcctagactaaagtgaaactagtacaagaacgacggaaanccgcggtcgtnttacgttcgnggtggcgtggtggtggggagtaacgggaacgtaacggg

SEQ ID NO: 421155 - DNA, 587 bp, Homo sapiens
  misc_feature: GZ8MTXP01AKOCW.51.37.D04.1.454.CMB.2.raw
  modified_base (340)..(340): a, c, t, g, unknown or other
  modified_base (540)..(540): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggaggtccctgagactctcctgtgcagcctctggatcaccttcagtggctacttcatgagctggatccgcaggctcgaggggagggctgcaggtggtctcgactatattagngaactaagtgggaacaaccactattccgtacgcaagtacctcgtaggaaggacggggcctatttccacctatccgtaccgaacggggaaccaaaccggaccaaacgggtaacctacgacttacggtaactcgtagacctaaagtcgaaacctagtaccaaggaacgaccgaaagaccgcgggtaccgtgttaccgttcgnggtgacggtaaggttgggaggggagtaacgggttaacgtaaccgggg

SEQ ID NO: 421156 - DNA, 647 bp, Homo sapiens
  misc_feature: GZ8MTXP01D30E9.51.37.D04.1.454.CMB.2.raw
  modified_base (261)..(261): a, c, t, g, unknown or other
  modified_base (621)..(621): a, c, t, g, unknown or other
tcagcgatcgtatacacgaccggtgctcgatttagtagcatactgttgagctatgggagaagagccccagtcccagaattcccaggagtttccattcggtgatcagcactgaacacagaggactcaccatggagtttgggctgagctgggttttccttgttgctattatagaaggtgtccagtgtcaggtgcagctgggtggaatcgtgggggggagtcgttggtcaagccgtgggacggtccctgacgtactctcctgtncacgcctcgtggacttccaccttcgagtggtcttacttcagtgagcgtggactcccgcgaggcctaccggagggggagggctgcgtaggtgggtctcactattagttagtgaactaagtggggaacaaaccctactactttccgacgactagtaccttcgtaggtagggaaccggggtccttaattccctaccaatcccgtaccggaacgggaaccaaaccgggacccaaagggtaaccctctaaccgttgtaactcttagaacctaaaagtcgaaactacgttacgaaaggaacgaaccggaagacccggttacgggtcccgtttagttaccgttcgttaggtcggacggtggttgggnggggaagaaccgggttcgtaacgggg

SEQ ID NO: 421157 - DNA, 555 bp, Homo sapiens
  misc_feature: GZ8MTXP01DETRU.51.37.D04.1.454.CMB.2.raw
  modified_base (261)..(261): a, c, t, g, unknown or other
  modified_base (339)..(339): a, c, t, g, unknown or other
  modified_base (469)..(469): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggcaagcctgggagggtccctgagtactctcctgtgcagcctntggatcacttcagtgctacttcatgagctggatcccgcaggctcgaggggaggctgcaggtggtctcactatattagngaactaagtggggaacaaacccacgtacttaccacggcagactcgtaggaaggaacgggcctaattcctccatccaccgagggaacaacgaccaaggtaacctcaactgtactcgtgacaaaatcgaaanacgtacaagaacgacgttaagacgaccggccgttgttacttcttaggtcgagtaaggtgggagggagtaacgggaacttaacgggg

SEQ ID NO: 421158 - DNA, 609 bp, Homo sapiens
  misc_feature: GZ8MTXP01CKCQQ.51.37.D04.1.454.CMB.2.raw
  modified_base (252)..(252): a, c, t, g, unknown or other
  modified_base (255)..(255): a, c, t, g, unknown or other
  modified_base (265)..(265): a, c, t, g, unknown or other
  modified_base (274)..(274): a, c, t, g, unknown or other
  modified_base (345)..(345): a, c, t, g, unknown or other
  modified_base (564)..(564): a, c, t, g, unknown or other
  modified_base (586)..(586): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagccgtgggagggtccctgagtactttcngtncagcctgtgnttcaccttnagtgctactcatgagctggactccgcaggctcgagggggagggctggcaggtcggtctcactatagttagngactaaaagtgggaacaacccactatttccgacgacagtacctcgtaggtacggaacgggtccctaatttcctacccgtaatcccgtaaccgaaggggaacccaaaccggaccgtaaaagtaaccctcgtaaaccgttgtaactcctagaacctaaagttacgaaacctaggtacgtaaacggcggaaccgaaagccgaacggttcgttagtctttcgngttggcgtaggtggtagggganacggggtaacttaacgggtaacg

SEQ ID NO: 421159 - DNA, 599 bp, Homo sapiens
  misc_feature: GZ8MTXP01CDW4S.51.37.D04.1.454.CMB.2.raw
  modified_base (319)..(319): a, c, t, g, unknown or other
  modified_base (340)..(340): a, c, t, g, unknown or other
  modified_base (355)..(355): a, c, t, g, unknown or other
  modified_base (542)..(542): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagtcttggcaagccgtgggacgggtccccgagcctctcctgtgcagcctctggattcacttcagtgctacttcatgagctggactccgcaggctcgagggagggcngcagtggtctcacatattagngactaaagtgggaanaaccgatattcacgcagtactcgtaggtacggaacgggcctattcctacctactaccgtccgaaggggaccaaaccggaccaaaaggtacctacgtaacgttacgtactcctagaaccaaagttacgaaacctagttacaaagggcgaacccggaaagaccggacccggttcgtacgttctttacgngttcggtaacggtaggtggggtaggggaggttacgggtaaccgttaacgggaaccgg

SEQ ID NO: 421160 - DNA, 767 bp, Homo sapiens
  misc_feature: GZ8MTXP01CY5WY.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcggtgggggagcttggtcaagccgtggaggtccctgagactctcctgtgcacgcctgtggatccacttcgagtcgtctactcatgagtctggactcccgaccgaggcctaccggagggggacgggctaggcgtaggtggtcctaccgactagttagttacggtgtaaaccgttaaggtcggggaaacaaacccgtaacgttacgtttaccgaacggcaacggtaccttcgtaagggaacggtaaaccgggggtcccttaacgtttcccgttaaccctaacgttccccgtaaccccggaaaggggaaccccaaaccggtaacccgtaaaagggtaacccttaccgtaaacgtttacggttaacttaccggtaacgtaaaccgtaaaaagttcgaaaaacgttacggtaaccgtaaaagggaacccgggaaacccggttaaaggtaacccggaccggggttaacccggtttacggtttaaccgtttcggttacgggttggaaccggggttcgggttacgggggttaggggaaacgggtaaccgggttaaaacccggggttcggg

SEQ ID NO: 421161 - DNA, 593 bp, Homo sapiens
  misc_feature: GZ8MTXP01EROIL.51.37.D04.1.454.CMB.2.raw
  modified_base (263)..(263): a, c, t, g, unknown or other
  modified_base (352)..(352): a, c, t, g, unknown or other
  modified_base (555)..(555): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagccgtgggacgggtccctgagactctcctgtgcagcctntggatcactcagtgctactcatgagctggactcccgcgaggctaccggagggggaagggctggcaggtcggtctacactattagttagngtaactaagtgggaacaaaccactattcctacgcagactcgtaggaggaacgggccctatttcccactacgtcctaccgacgggaaccaaccgaccaaaggaccttacgacttagtactccgtagacctaaaagtcgaaacgtacgtacgaaaggaacgtaccgaaagaccgaccggtccgtagttacccgttgttaggtcgngtaaggtgggaggggaacgaacggttaacgtaacgggg

SEQ ID NO: 421162 - DNA, 660 bp, Homo sapiens
  misc_feature: GZ8MTXP01AM4G3.51.37.D04.1.454.CMB.2.raw
  modified_base (260)..(260): a, c, t, g, unknown or other
  modified_base (272)..(272): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggcaagcctgggagggtccctgagactctcctgtgcagcctntggatcaccttnagtgctactcatgagctggactccgcaggcctcgaggggagggctggcaggtggtctccactatattagtgaacttaagtgggggaacaaacccactaacttttccgaacggactaaggaccttcgtagggaagggtaacgggggcccctatttacccgtccctaattcccgtacccgaacggggaacccaaaccggtaccccaaaacggggtaacccttcctaaaccgttggttaactcgtacgaacaaaagttacgaaaccgtaggttaccaaagggaacgaaccccggaaagacccgaaccgggtacccgttgttaccgtttcgttgggttcggaccggtaagggttggggtagggggagaacggggttaacccgttaacggggg

SEQ ID NO: 421163 - DNA, 556 bp, Homo sapiens
  misc_feature: GZ8MTXP01C0UV0.51.37.D04.1.454.CMB.2.raw
  modified_base (327)..(327): a, c, t, g, unknown or other
  modified_base (338)..(338): a, c, t, g, unknown or other
  modified_base (524)..(524): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctggagggtccctgagactctcctgtgcagcctctggatcacttcagtgctactcatgagctggactccgcaggctcgagggggaagggctgcagtggtcncacattatagngaacttaagtggggaacaaaccactattccgacgacagactctaggtaggaacggggcctaattcctaccatcctacccgagggaaccaaaccgaccaaaggaacctcactagtaactcgtagaacaaagtcgaaactagtacaaggaacgacgaaagaccgacggtccgtgttacgttgttgtgngtggtggagggacgtaacggttaacgtaacgg

SEQ ID NO: 421164 - DNA, 672 bp, Homo sapiens
  misc_feature: GZ8MTXP01DDHNP.51.37.D04.1.454.CMB.2.raw
  modified_base (644)..(644): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtgggtttcctgtgctattatagaaggtgtccagtgtcaggtgcagctggtggaatcgtgggggagcttggtcaagcctgggagggtccctgagtactctcctgtgcagcctctggatcaccttcagtgctacttcatgagctggactccgcaggctcgagggaggctggcagtggtctacgactatgttagtcgaacttaagtgggggaacaaacccatactttaccgacggactaggaccttacgtaggaacgggaaacgggggtaccccgttaagttcccttaccctaacgtttacccgtaccccggaaacgggggaaacccaaaaccgggaccccaaaacggggtaaaccccttccgtaaacctttacggtacttacgttaacggaacctaaaaagttcgggtaaaacacggttaaccgaaaggaacggaaaccgaaacggaccccgaacggggtcccgttagttaccgttcgttggttccggaggtggtgggnggggaagtaacggttaacggtaaccggg

SEQ ID NO: 421165 - DNA, 632 bp, Homo sapiens
  misc_feature: GZ8MTXP01BBXJW.51.37.D04.1.454.CMB.2.raw
  modified_base (292)..(292): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctgggtggaatcggtggggggagtcgtttgggtcaaggcccgtagggacgggtccctggacgaccttctcctgtgcacgcctgtggtactcaccttnagtgcttactcatgagcgtggactcccgcaggccgtaccggagggggacgggctgcgtaggtcggtctaccgactatattagcgaactaagtgggaacaaaccctatacttacacgctagacctgtggacgggacggcctatttccactactccgtaccggaaggaacccaacgtacccaaagggtaacctcacgttactaatccgagaactaaagtcgaaacgtacgttaacgaaagccggaacgaaacggaccgttaccgggccgtttaacgttacccgtttgggcggtcggacggtgggtagggtacggggaacggtaacgggttaaccgtaacggg

SEQ ID NO: 421166 - DNA, 654 bp, Homo sapiens
  misc_feature: GZ8MTXP01BTPSB.51.37.D04.1.454.CMB.2.raw
  modified_base (273)..(273): a, c, t, g, unknown or other
  modified_base (333)..(333): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggacgggtccctgagctctcctgtgcagcctctggatcaccttnagtgctacttcatgagctggactcccgcaggcctcggagggggagggctgcaggtggtcncgactatagttagtcgaactaagtggggaaacaaaccctatacttccacggacacgacctgtaggaaggaacggggccctaattcctaccaatccgtaccgacggggaaccaaaccggacccaaaagggaacccttcaaccgttagtaacttccgtagaaactaaaagtcgaaacgtacgttaaccaaagggaacgaaccggaaacggaacccgttaccggggtacccgttacggtttaacccgtttggttaccggttcgggacgggtaacgggttcgggggtagggggaacgtaacggggttaaccggtttaaccggggg

SEQ ID NO: 421167 - DNA, 691 bp, Homo sapiens
  misc_feature: GZ8MTXP01C213E.51.37.D04.1.454.CMB.2.raw
  modified_base (269)..(269): a, c, t, g, unknown or other
  modified_base (368)..(368): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagtcttggtcaaggccgtgggacgggtccctgacgtacctctcctgtgcacgcctntggatcaccttcagtggctacttcatgagctggactcccgcaggcctccggaagggggacgggctggcgaggtcgggtcctaccactagttagttaggngtaactaaggtcgggaaactaaacccatacttccgaacgtcaacggtactcgtaggaacggacgggtccctaacttccgtacctacgttcccgtaacccgaaggggaacccaaaccggaacccgtaaaacgggtaaaccttacccgtaacgttacggttaacttacccgttaggaaacctaaaagttcgaaaacgtacgttaaccgaaagggaaccgaacccggttaaacggacccgttaaccgggttaccgttcgtttaaccgttcggttaggtcggacggtaaggtcgggtaggggaacgtaacgggaacgttaaccgggg

SEQ ID NO: 421168 - DNA, 818 bp, Homo sapiens
  misc_feature: GZ8MTXP01ADPNT.51.37.D04.1.454.CMB.2.raw
  modified_base (279)..(279): a, c, t, g, unknown or other
  modified_base (294)..(294): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagcgtggtggaatcggtggggggagtcttgggtcaaggccgtggggacgggttcccctggacgtaccttcctcctgtgcagccctntggactcctaccttnaggtgcttacttcatgacgctggactcccgcacggcctcggagggggagggctggcgaggtcgggtctaccactattagttacggtgaacttaaagggtcgggggaaactaaacccctaacgttaactttaccgtaaccggactaaaccgtacgttaccgtagggaacggggtaaacggggtcccttaagtttccccaccctagtttaccccgtaacccgggaacgggggaaaccctaaaaccccgggacccgtaaaacggggtaaacccctttaccaaaccgtttacggttaaacctccggtttaacggaaactaaaaaacgttcggaaaaacccgttagggttaaacccgaaacgggaaccggtaaacccccgggaaaagggtacccccggttaaccggggttcccggtttaacggttttaccccgtttcgggtttaccggggtgggacccgggggttaaggggtttcggggggtaggggggaaccggttaacgggggttaaccccggtttaacccgggggg

SEQ ID NO: 421169 - DNA, 731 bp, Homo sapiens
  misc_feature: GZ8MTXP01A6OXQ.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagtcttgggttttccttgttgcttattatagaaggtgtccagtgtcaggtgcagcgtggtaggaatcggtggggggagtcgttggtcaagccgtggacggtccctgagtactctcctgtcgctacgcctcgtggtactccaccttcgagtcggtccttactcagtgacgcgtcgacgtcccgacgaggccgtacggagggggacggtctagcgtaggtcggtctaccactattacgttagcgtaaacgttaaggtcggggaaactaaccccgtaactacgtttaccgaacggtacgtaacgacccttagggtagggaaacgggaaccggggttcccttaaatttcccctaccactttacccggaacccggaaggggtaaccccaaaccggacccctaaaagggggttaccccttacgtaaccgttagttaaacgtcccgtaaaggtaactaaaacgttcgaaaaccggttacgttaaccggaaagggaacccggtaccgaaaaggccccgttaccggggttaccttagttaccgttggttcggaagtagggtaacgtgggggtaggagttaaccggaacgtaacgggg

SEQ ID NO: 421170 - DNA, 713 bp, Homo sapiens
  misc_feature: GZ8MTXP01AVXFE.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtaggaatcggtggggggaggtcttggtcaagccgtgggacgggtccctggagtactctcctgtcgcagtcctgtggactcaccttcagtggtcttacttcattgagctggactcccgccgaggcctccggaggggaacggggctggcaggtcgggtcctccgactatacgttagtcgaaacttaaggtggggaactaaacccactacttccgtaacgctaacgtaccttagtagggtacgggaaacggggccctaatttccctacctacgttcccgaccggaacgggaacccaaaccggacccaaacggggtaaaccttccgtaaccttacggttaaactccgtacgtaacctaaaagttaccgaaacgtacggttaaccgtaaagggaaccgaaccggaaacggtacccgttacccgggtaccgggttaacgttacccgtttggttacggttaacgggacggtaaggggttacgggacgggggaaggtaacgggttaaccggttaaccggggg

SEQ ID NO: 421171 - DNA, 549 bp, Homo sapiens
  misc_feature: GZ8MTXP01CYTSZ.51.37.D04.1.454.CMB.2.raw
  modified_base (262)..(262): a, c, t, g, unknown or other
  modified_base (341)..(341): a, c, t, g, unknown or other
  modified_base (355)..(355): a, c, t, g, unknown or other
  modified_base (375)..(375): a, c, t, g, unknown or other
  modified_base (392)..(392): a, c, t, g, unknown or other
  modified_base (427)..(427): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagccgtgggagggtccctgagactctcctgtgcagcctntggatcaccttcagtgctactcatgagctggactccgcaggctcgaggggagggctgcaggtggtctcactatattagnaactaagtgggaanaccactatcacgcagactgngtgaacgggcctattcnccatccacgaggacacgaccaagactcaactgtanctagactaaatcgaaacagtaccaaaggaacgacccgaaagacccgacgggtacccgttgttaccgttcgttgggtgacgggtaaggttggggaggggaggtaacgggttaacgtaacgggg

SEQ ID NO: 421172 - DNA, 603 bp, Homo sapiens
  misc_feature: GZ8MTXP01B3974.51.37.D04.1.454.CMB.2.raw
  modified_base (256)..(256): a, c, t, g, unknown or other
  modified_base (261)..(261): a, c, t, g, unknown or other
  modified_base (352)..(352): a, c, t, g, unknown or other
  modified_base (562)..(562): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagccgtgggacggtccctgagctctcctgtgcngcctntgatcacttcagtgctacttcatgagctggatcccgccaggcctccggaggggacggggctggcgtaggtcgggtctccactattattagngtaactaagtggggaaacaacccatactttctacgcaacgacttcgtaggaaggaacgggtccgtaatttccctaccgtactccgtacccgaacgggaaccaacgaccccgaaaggtaaccttctaccgtagtactccgtagactaaaagtcgaaacgtacgtactaaaggaacgaccgaaagccgttaccggtcgttagttacgttcgnggtaagcgtaaggtgggtagggaggtaacggaacgtaacgg

SEQ ID NO: 421173 - DNA, 600 bp, Homo sapiens
  misc_feature: GZ8MTXP01E28YS.51.37.D04.1.454.CMB.2.raw
  modified_base (262)..(262): a, c, t, g, unknown or other
  modified_base (292)..(292): a, c, t, g, unknown or other
  modified_base (366)..(366): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgcttattatagaaggtgtccagtgtcaggtgcagctggtggaatcgtgggggagcttggtcaagccgtgggaggtccctgagactctcctgtgcagcctntggtatcaccttcagtggctacttcatganctggactcccgcaggcctccggaggggaagggctggcgaggtgggtctccgactatagttagtgaacttaaagnggggaaacaaaccacactttacacgcaagtactcgtaggaacggaacggggtccaactttcctaccgattcccgtaccgaaggggaaacccaaaccgacccgaaacggtaacctaccgacttagtacttcgagaacaaatacggaaactaagttacaaagaacgacgaagaccgacggtccgttagttacgttcgttgtgcgtaagtcggtagggagtaagggaactaacgggg

SEQ ID NO: 421174 - DNA, 601 bp, Homo sapiens
  misc_feature: GZ8MTXP01APX2C.51.37.D04.1.454.CMB.2.raw
  modified_base (370)..(370): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttcctgttgctattatagaaggtgtccagtgtcaggtgcagcgtgggtggaatcggtggggggagtcgttggtcaaggccgtggggacgggtccctgacgtactctcctgtgcagcctctggtactccaccttcgaggtggccttacttcatgagctggactccgcaggctccggagggggacgggctggcgaggtcgggtctacactatagttagngaacttaagtggggaacaaaccactattccgtacgctacgaccttgtagggtaggaaacgggtcctatttcccactacgtccgtaccgaacggggaacctaaacgacccaaagggtaacctcgtaactaggttactcgtagacctaaagtcgaaactagtacaaggaacgacgaagacgcggtcctgttaccttgcgtgcggtgtcggaggggataagggttccgtaaggg

SEQ ID NO: 421175 - DNA, 591 bp, Homo sapiens
  misc_feature: GZ8MTXP01EDW9G.51.37.D04.1.454.CMB.2.raw
  modified_base (343)..(343): a, c, t, g, unknown or other
  modified_base (352)..(352): a, c, t, g, unknown or other
  modified_base (358)..(358): a, c, t, g, unknown or other
  modified_base (514)..(514): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggcaagcctgggagggtccctggagactctcctgtgcagcctctggacttcaccttcagtcggctacttcatgagctggatccgcaggctcgaggggaggctgcaggtggtctcactatattagngaactaagngggaanaaaccacgtattccgtacgctagactcgtaggtaggaacgggcctattacctaccatccgtaccgaacgggaacaaccgacccaaagggtaaccttcaacgttagtaactcctagaacaaaatcgaaactaggtacctaaaggaacgacccgaaanacccggacggtcccgttagttaccgttcttagggtcgtaggtaaggttgggaggggagtaacggaaccgttaagggg

SEQ ID NO: 421176 - DNA, 589 bp, Homo sapiens
  misc_feature: GZ8MTXP01E0V01.51.37.D04.1.454.CMB.2.raw
  modified_base (245)..(245): a, c, t, g, unknown or other
  modified_base (376)..(376): a, c, t, g, unknown or other
  modified_base (546)..(546): a, c, t, g, unknown or other
tcagcgatcgtatacacgaccggtgctcgatttagtagcatactgttgggtttgggggtgggtccaggaggcagaactctgggtgtctcaccatggcctggatccctctacttcctccccctcctcactctctgcacaggctctgaggcctcctatgagctgacacagccagcctcggtgtcagtcgtccccaggacagacggccaagactcccctgctcgtggagatgctattgaccaaaagtntttgtcttttaggaccaacagaagccaggccaggcccctataaataattaatataataaagacagtgagacgccctagagggctcccgtgagcgattctcgtcggccctccagctacgagggaaaccaacncgtaccaacgttagaacgtaagttaggtggacgtaccgaaggacaaggaaggacgaggtcgtagaccttagttacctgtaaccaatacgaggacaaagacgacgtaggtcgtaatttagaggtagtagttcgggcggaagggaaccgagggttcgaccgttcgaggtacncggccaaggctccgccccgtggcttacgtccttcgtaaccccc

SEQ ID NO: 421177 - DNA, 615 bp, Homo sapiens
  misc_feature: GZ8MTXP01ELJ5S.51.37.D04.1.454.CMB.2.raw
  modified_base (261)..(261): a, c, t, g, unknown or other
  modified_base (347)..(347): a, c, t, g, unknown or other
  modified_base (370)..(370): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggacggtccctgagactctcctgtgcagcctntggatcactcagtgctactcatgagctggactcccgccgaggctaccgagggggaagggtctgcgaggtggtctcactatagttgngaactaagtggggaataaacccntattcacgctagacctagtgaaggaacgggcctatttaccacctaattcccgaccgaacggggaacccaaaccgaacccgaaacgggaaaccttcgaaccgttagttactaccgtacgaactaaaagttcgaaaccgtagttacccgaaaggaacggacccggaaagaccggttaccggacccgtttaggttaccttcgttaggtgtcggtaagttgggaggggaagtaagggaaccgtaagggg

SEQ ID NO: 421178 - DNA, 599 bp, Homo sapiens
  misc_feature: GZ8MTXP01AK06S.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagccgtgggagggtccctgagactctcctgtgcagcctctgatcacttcagtgctacttcatgagctggactccgcaggcctaccggagggggagggctagcgaggtcggtctccgacattagttagtgtaactaagtcggggaacaaacctactatttcacgcaagactcgtaggaacggaacgggccctattcccaccatccctaccgaacggggaaccaaaccggaccaaagggtaacctacgaaccttgtaactccgtagaaccaaagtcgaactagttaacaaaggaacggaaccggaaagaccgaccgggtcccgttgttacgtttcgcggtgcggtaaggtgggaggggagtaacgggaacgttaacggg

SEQ ID NO: 421179 - DNA, 581 bp, Homo sapiens
  misc_feature: GZ8MTXP01DXIBV.51.37.D04.1.454.CMB.2.raw
  modified_base (335)..(335): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtggggggagtcttggtcaagcctgggaggtccctgagctctcctgtgcagcctctggatcacttcagtgctactcatgagctgactcccgcaggctcgagggaggctgcagtggctcactattatagngtaactaagtcggggacaaacccgatactttaccgacgacagtaccttcgtaggaaggaacgggcctaactttccaccagtccaccgaagggaaccaaaccgaccaaaggacttcgaacttacgtactccgtagaactaaaagtcggaaacctaggtacaaaggaacgacgaaagaccgacgggtcgtacgttaccgttgaggttcgacggtggttggaggggagtaacgggaacgttaaccgggg

SEQ ID NO: 421180 - DNA, 821 bp, Homo sapiens
  misc_feature: GZ8MTXP01BG0OW.51.37.D04.1.454.CMB.2.raw
  modified_base (423)..(423): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagtcttgggttttccttgttgctattatagaaggtgtccagtgtcaggtgcagcgtgggtggaatcggtggggggaggtcgttgggtacaaggccgtgggacgggtccctgacgtcctctcctgtcgcacgtcctcgtggtacttccgtacccttcgaggtcggtccttacttcattggacgtcgtggacttccccggaccgaacgggtccgtaccggaaggggggaacgggtcgtggcgtaggtcgggtctaccactattagttagtgtaacttaaggnggggaacaaaccctacgtactttaccgtacgcgtaacgtaccttcgtagggaaacggaaccggggtccttaactttcccgacctaacgttaccccgaccggaaacggggtaaacccaaacccggtaaccccgtaaaacggggtaaccccttaccggtaaaaccgtttcgttaaactacccgttaacgaaactaaaaaacgtcgtaaaaccggtaaacgttaaaccgttaaaaacggggaacccggtaaaccccgggaaaacgggaaccccggttaccgggggtttacccggttaacgttttaacccggtttttccgagggggttcccggaacggggttaaggggtttagggggtaggggggaacggtaaccggggttaaaccgggttaaccccggggg

SEQ ID NO: 421181 - DNA, 542 bp, Homo sapiens
  misc_feature: GZ8MTXP01BP1LT.51.37.D04.1.454.CMB.2.raw
  modified_base (241)..(241): a, c, t, g, unknown or other
  modified_base (282)..(282): a, c, t, g, unknown or other
  modified_base (354)..(354): a, c, t, g, unknown or other
  modified_base (373)..(373): a, c, t, g, unknown or other
  modified_base (408)..(408): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcctcactctctgcacaggctctgaggcctcctatgagctgacacagccagcctcggtgtcagtgtccccaggacagacggccaagatcccctgctctggagatgcattgaccaaaacgtntttgctttttggacaacagaagcagcagccctataatatanatataagacagtgagaggccctagagggactccctgagcgattctcgtggccctccagctcgaggaacaacngccacgttgacgtattagngagtccaggcagaagacgaggctagactagttacngtacaatcaggacagacgacagttggtacttagtaggagttagtcgggcggtagggaaccgaagggttcgaccgttcgtacggtcacgccccgaaggcctccgcccccttggtccacgttcgttcgtttccccc

SEQ ID NO: 421182 - DNA, 571 bp, Homo sapiens
  misc_feature: GZ8MTXP01DLGQH.51.37.D04.1.454.CMB.2.raw
  modified_base (354)..(354): a, c, t, g, unknown or other
  modified_base (359)..(359): a, c, t, g, unknown or other
  modified_base (450)..(450): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctggacggtccctgagctctcctgtgcagcctctggactcacttcagtcgctactcatgagctggactcccgcgaggcctacggaggggagggtctgcgagtggtctcactattatagtgaactaagnggaanaaccatatcacgcagactcgtagagacgggcacttcaccatccacgaacggacaacgaccgaaacggtacctacgtactagtactcgtaanaactaaactacgtaacgtacgtacgaaacggaacgaacggaaacggtaccgaccggtacgttacgttacgttcgttgtggacggtaagggtggacgggaggtaacgggttaacggtaacgg

SEQ ID NO: 421183 - DNA, 812 bp, Homo sapiens
  misc_feature: GZ8MTXP01AFEJ7.51.37.D04.1.454.CMB.2.raw
  modified_base (263)..(263): a, c, t, g, unknown or other
  modified_base (275)..(275): a, c, t, g, unknown or other
tcagcgatcgtatacacgaccggtgctcgatttagtagcatactgttgagctctgggagaagagccccagtcccagaattcccaggagtttccattaggtgatcagcactgaacacagaggactcaccatggagtttgggctgagcttgggttttccttgttgctattatagaaggtgtccagtgtcaggtgcagctggtggaatcggtgggggagtcttggtcaagccgtgggacggtccctaagctctcctgtgcagcctntgattcaccttnagtcgctacttcatgagctggactcccgcaggcctccggaggggagggctgcgtaggtcggtctcgaacctattagttaggagacttaaaagggtcggggaacctaaacccactactttaccgtaccgggactaacgggtaaccctttcggtaggggaaacgggtaaaccgggggtcccgttaaacttttcccgtaacccctaacgtttccccgttaaacccgggggaaaccgggggaaaccccaaaaccggggtaaccccaaaacgggttaaaacccgttcccgtaaacccgtttaggttaaacccttacccgttaaggaaacccttaaaagttaccggaaacccgtaaaggtttaaaccgaaaacgggggaaccgaaaccccgggtaaaacgggaaccccggaaccccggggttacccggtttacgtttaacccgtttcccgggttggggttaccgggaaccgggttagggggtttaacgggggtagggggaaacggttaacgggggttaaccccggttaagggggtaacccggg

SEQ ID NO: 421184 - DNA, 582 bp, Homo sapiens
  misc_feature: GZ8MTXP01BCQ31.51.37.D04.1.454.CMB.2.raw
  modified_base (271)..(271): a, c, t, g, unknown or other
  modified_base (284)..(284): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagtcgttgggttttccttgttgcttattatagaaggtgtccagtgtcaggtgcagctggtggaagtcgtgggggagtcttggtcaagccgtggggacgggtccctggacgactctcctgtgcagcctntggatccaccttnagtgcttactcatgagcgtgactcccgcgaggcctacggaggggacggctgcgaggtggtctccatatagttagcgaataaagtggggaaacaacctactatttccgacgcaacgtactcgagaaggaccgggctattccacatccgaccgaaggaccaacgacaaggactgactgtactcgagaacaaagtcgaaactacgtaacgaaggaaccggaaccgaaacgaccgaccgggtaccgtgttacccgttgttagtcgcggtaagtcggggtaggacggaacggttcgtaacggg

SEQ ID NO: 421185 - DNA, 668 bp, Homo sapiens
  misc_feature: GZ8MTXP01AXCS9.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgcttattatagaaggtgtccagtgtcaggtgcagctggtggaatcgtgggggagtcttggtcaagcctgggacggtccctgagctctcctgtgcacgcctcgtggtactccaccttcagtcggcttacttcatgagctggactcccgcaggcctaccggaggggagggctggcgaggtcggtctcactattacgttagtgtaacttaagtggggaaacaaacccctagtactttcaaccgcaacggtaccttcggtaggtacgggaaaccggggtcctaactttcccgtacctaacgtcccgtaacccggaaggggaaccccaaacggaccccaaacggggaacccttcaacgttacgtataccgttagaacctaaaatcgtaaaacacgttaacgaaacggaacggacccgttaaagcccgttaaaccggggtcccttagttaccgttcgttcggcgggacggtaagggtcgggtggggaaacggtcggttaacccgggtaaggg

SEQ ID NO: 421186 - DNA, 584 bp, Homo sapiens
  misc_feature: GZ8MTXP01EIQDF.51.37.D04.1.454.CMB.2.raw
  modified_base (348)..(348): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtggggggagcttggtcaagccgtgggagggtccctgagctctcctgtgcagcctcgtggtactcaccttcaggtggctacttcatgagctggactccgcaggcctccgagggggagggctgcaggtggtctcacatattgnaactaagtggggaacaaaccatatttcacgcagactcgtagacggaacgggcctagtttcctaccactccgtaccgacgggaaccaaacggcccaaaggggtaacctcaacttgtaactccgtagaacctaaaatcgaaactagttacgaaaggaacgaccgaaagaccggaccggtccgtagttaccttgttggtggcgtaaggtgggtagggagtaacgggttaacgtaacggg

SEQ ID NO: 421187 - DNA, 624 bp, Homo sapiens
  misc_feature: GZ8MTXP01DQHQ4.51.37.D04.1.454.CMB.2.raw
  modified_base (243)..(243): a, c, t, g, unknown or other
  modified_base (306)..(306): a, c, t, g, unknown or other
  modified_base (311)..(311): a, c, t, g, unknown or other
  modified_base (337)..(337): a, c, t, g, unknown or other
tcagcgatcgtatacacgaccggtgctcgatttagtagcatactgttgggtttgggggtgggtccaggaggcagaactctgggtgtctcaccatggcctggatccctctacttctcccctcctcactctctgcacaggctctgaggcctcctatgagctgacacagccagcctcggtgtcagtcgtccccaggacagacggccaagactccctgctctggagatgcattgacctaaaacgttntttcgtactttttagaacaacagacgacacgaccgacgaccctaataaattaataataataanaaganagtagagacgacctagaggactccgngacgtcgtacttctcgtcgtccctacgacgcgtacgaacggaaaccaacgcgaccgtaacgttacgaacgtagttaggtggacgtacgaggacgaaggaacgacggagtactagtaacttattactagtactaactacgaacggacgaaggaacgacgtaggttagttagttagtaggtacgttaggtacgggacgggaacgggaacgtaggttcgtaccgttacgtacggtcgacggccgacggtccgtcccgtccccgtcgtccttaccgttccgttccgtcccc

SEQ ID NO: 421188 - DNA, 745 bp, Homo sapiens
  misc_feature: GZ8MTXP01BYZ2N.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagcgtggtggaatcgtgggggagtcttggtcaagccgtgggacgggtccctggacgactctcctgtgcagcctcgtggatccaccttcagtggctactcatgagctggactccgcaggcctccggaggggaggctgcaggtgggtctcactatattagtgaactaaagtggggaaacaaaccctacgtactttccgtaacggacctaacgtaccgttacgtagggaaacgggtaaacgggggtcccttaaattttccccgtaccgtaaccgttccccgtaaacccggaaacgggggaaacccaaaacccgggtaccccgaaaaacggggtaacccgttaacctaaccgttacggttaaacctacccgttaggaaacctaaaaagttccggaaaaaccgtacggttaacccgtaaagggaacccggaacccggaaaaggtacccgttaacccggggtccggttacgtttaaaccgtttccgttgggttaacgggaccgggtaagggtttcgggggagggggaacgggtaacggggaacccgtttaaccggggg

SEQ ID NO: 421189 - DNA, 608 bp, Homo sapiens
  misc_feature: GZ8MTXP01AKTZZ.51.37.D04.1.454.CMB.2.raw
  modified_base (263)..(263): a, c, t, g, unknown or other
  modified_base (285)..(285): a, c, t, g, unknown or other
  modified_base (569)..(569): a, c, t, g, unknown or other
  modified_base (586)..(586): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagccgtgggacgggtccctgacgctctcctgtgcagcctntggatcaccttcagtgctactnatgagctggactcccgcaggcctaccggagggggaacggggtctgcgaggtcgggtctccactattagtagtgaacttaagtggggaacaaaccctacgtacttacgtaccgcaaagtccttacgtaggaaacgggtaacggggtccctatttccctacctaaccttccgaaccccgaggggaaccctaaccggacccaaaggtaacctctacgtagtaactcgtagactaaatcgaaacctagtaccaaggaacaccgaaagccgacggtcgtattcgttcgnggtcgcgtaaggtcggnggggacgtaaggaacgtaaggg

SEQ ID NO: 421190 - DNA, 681 bp, Homo sapiens
  misc_feature: GZ8MTXP01DLVXC.51.37.D04.1.454.CMB.2.raw
  modified_base (247)..(247): a, c, t, g, unknown or other
  modified_base (351)..(351): a, c, t, g, unknown or other
  modified_base (399)..(399): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcctcactctctgcacaggctctgaggcctctatgagctgacacagccagcctcggtgtcagtcgtccccaggacagacggccaagactcccctgctcgtggagatgctattcgaacctaaaacgtnttttgtacttttttacggtaaccaacagaacgccaggaccaggacccctaataaattaacttaataataataaagacagtagagacgccctgacgggactcccngacgcgtattcctcgtcggtccctccagctacgacgggaaacaaacgngaccgtaacgttcgacgaacgtttaggacgggacgtacccgaggacgaaggaacgaccggaggtactacggtaacttattaacgcgtaacaagtaccaggactaaggaaccgataaggttagtaacttaggtggtagttacggttcgggacgggtaagggtaacccgtaagggttacggtaccccggttacgtacgggtaccaaccggaccccgaacggggtccctacccggtccccccgttacgggtcccttacccgttccggttcccgtttcccccccgg

SEQ ID NO: 421191 - DNA, 501 bp, Homo sapiens
  misc_feature: GZ8MTXP01BCBRW.51.37.D04.1.454.CMB.2.raw
  modified_base (239)..(239): a, c, t, g, unknown or other
  modified_base (332)..(332): a, c, t, g, unknown or other
  modified_base (353)..(353): a, c, t, g, unknown or other
  modified_base (361)..(361): a, c, t, g, unknown or other
  modified_base (400)..(400): a, c, t, g, unknown or other
  modified_base (411)..(411): a, c, t, g, unknown or other
  modified_base (418)..(418): a, c, t, g, unknown or other
tcagcgatcgtatacacgaccggtgctcgatttagtagcatactgttgggtttggggtgggtccaggaggcagaactctgggtgtctcaccatggcctggatccctctacttctcccctcctcactctctgcacaggctctgaggcctcctatgagctgacacagccagcctcggtgtcagtgtccccaggacagacggccaagatcccctgctctggagatgcattgaccaaaacgtntttgctttttggtaccaacagaagccaggccaggccctataataattatatataaagacagtgagagcctcagggatccctgagcgattctcnggcctccagctcaggaacaangccagttnacgatagtgagtcaggcagaagacgaggctgactatacngtcaatcaggnagaccangtgtactatggagtatggcgagggaacaaggttgaccgttgaggtcacgccaaggctcgccccgtgtcactcgttccgtcccg

SEQ ID NO: 421192 - DNA, 593 bp, Homo sapiens
  misc_feature: GZ8MTXP01EPPX9.51.37.D04.1.454.CMB.2.raw
  modified_base (267)..(267): a, c, t, g, unknown or other
  modified_base (278)..(278): a, c, t, g, unknown or other
  modified_base (483)..(483): a, c, t, g, unknown or other
  modified_base (547)..(547): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcacatggagtttgggctgagtcttgggttttccttgttgcttattatagaaggtgtccagtgtcaggtgcagcgtggtggaatcgtgggggagtcttggtcaagccgtgggacgggtccctgagtctcctcctgtgcagcctntggatcacttnagtgctactcatgagctggactccgcgaggcctaccggagggggaacgggctgcgtaggtcgggtcctaccgactattagttagtagtaacttaaaggtggggaaacaaaccgactacttcctacgctacgacttcgaggaacgggacggcctattccacctatccacgacggaacaacgaccaaaggactactatagtactccngaactaaatacgaactagtaaccaaggaacgacgttaaacgaccgacggtctagttacccgttnaggttgcggtaagtggggtaggacggtaacggttaacggtaacggg

SEQ ID NO: 421193 - DNA, 671 bp, Homo sapiens
  misc_feature: GZ8MTXP01CA3QM.51.37.D04.1.454.CMB.2.raw
  modified_base (264)..(264): a, c, t, g, unknown or other
  modified_base (276)..(276): a, c, t, g, unknown or other
  modified_base (347)..(347): a, c, t, g, unknown or other
  modified_base (363)..(363): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagccgtgggacgggtccctgacgactctcctgtgcagcctntggatcaccttnagtgctactcatgagctggactccgccaggcctccgagggggagggctgcaggtggtctcactatattagngaactaagtggggaanaacccatattacacgacacgactcgtaggaaggaacggggtcctaattccgtacccaattccgtaccgaaggggaacccaaaccggaccccaaaaggggtaaccctacgtaaccgttaggttaactccgttaacggaacctaaaatcggtaaaacctacggttaaccgaaaggaaccgggaacccgaaacggaaccgttaacccggggttaccccgttggtttaaacccgtttcgttagggttggacccgggtaagggtttaggggtacgggggaaagggtaacgggttaacggtttaaacccggggg

SEQ ID NO: 421194 - DNA, 811 bp, Homo sapiens
  misc_feature: GZ8MTXP01ASELL.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgcttattatagaaggtgtccagtgtcaggtgcagcgtggtggaagtcggtggggggaggtcgtttgggtacaaggccgtgggacgggtccctggacgtactctcctgtcgcacgtcctcgtggtactcctaccttcgaggtcggtccttacttcaagttggagtcgtacggactccccggccgagggtccgtaccggaaggggggacgggggtctggccgtaggggttcgggtcctaccgactaagttagttaggtacgtaaaccgttaaaggtcgggggaaactaaaccctaactacgtttaccgaaccgacgtaacgtaccgttacgaagggaacgggaacggggtccccttaatttaccccgtacctaacgtcccgtacccgggaacggggaaacccaaaccgggtacccaaaacggtaaccttaccgtaaccgttacggttaaacttccgtaagaaaccgtaaaacgtaggaaaaccctaggttaaacccgaaaagggaacccggaaacccgaaaacgggtaccccgttaaaccggggttcccgtttaacgggtttaaccctttcggttacggggttaacgggacgggtaaggggtttgggggtaacgggggagggttaaccgggttaaccgttaacccgggggg

SEQ ID NO: 421195 - DNA, 729 bp, Homo sapiens
  misc_feature: GZ8MTXP01BAUUR.51.37.D04.1.454.CMB.2.raw
  modified_base (278)..(278): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcggtggggggagcgttgggtcaagccgtgggacggtccctgagactctcctgtgcagcctgtggatcaccttnagtgctactcatgagctggactcccgcgaggcctccggaggggaggggctgcgtaggtggtctccgactagttagttaggtcgtaacttaaagtcgggggaaactaaacccctagtaaactttcccgtaacgacgtaaggtaaccttccgtagggaacgggaacgggggtaccccttaagtttcccctacccgtaaacgttcccgtaaccccggaaacggggaaccccgaaaacccgaccccgaaaacggggtaaaccccttcggtaaacccctttaggttaactaccccgttagaaaccttaaaaccgttgggaaaacccttaggtaaccgtaaaacgggccggaaccggaaacgacccggacgggtaccgttcggttacttccggttagggtcggtccgggtaagggttggggacgggggttacggtaacggttaaccgtaaccggggg

SEQ ID NO: 421196 - DNA, 535 bp, Homo sapiens
  misc_feature: GZ8MTXP01DLYAX.51.37.D04.1.454.CMB.2.raw
  modified_base (261)..(261): a, c, t, g, unknown or other
  modified_base (339)..(339): a, c, t, g, unknown or other
  modified_base (354)..(354): a, c, t, g, unknown or other
  modified_base (360)..(360): a, c, t, g, unknown or other
  modified_base (404)..(404): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagccgtgggaggtccctgagactctcctgtgcagcctntggatcaccttcagtgctacttcatgagctggactccgcaggctccgagggaaggctgcagtggtctcgacatatagngaactaagtgggaanaaccanattctacgcagactctgtagaacgggcctattcctaccattccnccgaagggaacctaaacgccaaaggaactcactgtatcagacaaatcgaacagtacaagaacacgaaagaccgacggcgtagttaccgttgttagtgcggtgtgggtagggagtaacggaacgtaacgggg

SEQ ID NO: 421197 - DNA, 754 bp, Homo sapiens
  misc_feature: GZ8MTXP01CQBOO.51.37.D04.1.454.CMB.2.raw
  modified_base (179)..(179): a, c, t, g, unknown or other
  modified_base (259)..(259): a, c, t, g, unknown or other
  modified_base (266)..(266): a, c, t, g, unknown or other
  modified_base (271)..(271): a, c, t, g, unknown or other
  modified_base (291)..(291): a, c, t, g, unknown or other
  modified_base (296)..(296): a, c, t, g, unknown or other
  modified_base (304)..(304): a, c, t, g, unknown or other
  modified_base (330)..(330): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgttgggttttccttgttgctattatagaaggtntccagtgtcaggtgcagcgtggtaggaatcggtgggggagctttggacaaggcctgggacgggtcccgagactctctgtncagcctntggtnttcacttcagtggctacttnatgancgtggacnccgcgaggctaccggagggacgggcnggcgtaggtcggggtctacgtaacctagttacgttaggtagtacgtaaaagggttacgggaacgtaaaccctaactacgtttccgaaccgggacaaacggtacccttaccgtggggttaaccggaaacgggggtcccttaaccgtttaccctaccgttaaacgttccctaaacccggacgggggaaacctaaaccccggacccgaaacggttaaaccctcgtaaacccgttggttaacctacgttaacggaacctaaaggtacgtaaaaccgtaaggttaacccgtaaaggaaccggtaacccggaaaggacccggtaaccgggttccggtttaacgtaaccggtttcggttggttacggggtaaccggtggttaacgggggtgggtaacggggttaccggtaaacgggttcggggtaaccggg

SEQ ID NO: 421198 - DNA, 717 bp, Homo sapiens
  misc_feature: GZ8MTXP01EZI48.51.37.D04.1.454.CMB.2.raw
  modified_base (192)..(192): a, c, t, g, unknown or other
  modified_base (239)..(239): a, c, t, g, unknown or other
  modified_base (271)..(271): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtncagctggtggaatcgtgggggagcttggtcaagcctggagggtcccngagctctcctgtgcagcctctggatcaccttnagtgctactcatgagctggactccgcaggcctccggaggggacgggggctgcgaggttcgggtctcccaacgtattaagtttaggtgtaaacgttaaagtcgggggaaacaaacccacttacttaccgtacgacgacgtaccttcgtagggaaacgggaaacgggggtccccgtaatttttccccgacccgtaacttccccgtaaccgggaaacgggggtaaacccaaaaccccgggtacccaaaaacgggtaaccctttacccgacgttacggttaactaccgttacggaacctaaaaacgttaggaaaacctacggtaaccgtaaagggaaccggtaaccccggaaaggaacccgttaccggggtaccgttacgttaccctttgttcgggtaacgcgggtaaggttggggaggggaaggtaacgggttaacggttaaccggggg

SEQ ID NO: 421199 - DNA, 556 bp, Homo sapiens
  misc_feature: GZ8MTXP01CC5JZ.51.37.D04.1.454.CMB.2.raw
  modified_base (263)..(263): a, c, t, g, unknown or other
  modified_base (275)..(275): a, c, t, g, unknown or other
  modified_base (290)..(290): a, c, t, g, unknown or other
  modified_base (411)..(411): a, c, t, g, unknown or other
  modified_base (446)..(446): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagtcttggtcaagccgtgggacgggtccctgagctctcctgtgcagcctntggatcaccttnagtgctcttcatganctggactccgcaggctaccgagggggaggctgcgaggtggtctccactattagttagtgaactaaagtggggaaactaaacccatacttcacgcagacctgaggagaacgggcctattccnccatccacgaggacacgaccaaggactcactgtcngagaataaactacgaatacgtaacgaaacggcgaaccgaagccggacgttcgtacttaccgttgttaggtgtaggtggttgggagggttacgtaacgggttcgtaacggg

SEQ ID NO: 421200 - DNA, 596 bp, Homo sapiens
  misc_feature: GZ8MTXP01E4HAH.51.37.D04.1.454.CMB.2.raw
  modified_base (262)..(262): a, c, t, g, unknown or other
  modified_base (379)..(379): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagccgtgggagggtccctgagactctcctgtgcagcctntggatcaccttcagtgcttacttcatgagctggactccgccaggcctccggaagggggaacggggctgcgtaggtgggtctccgactattaagttagtgaacttaaagtggggaaanaaacccatacttccacgcagtactcgtagtagggaacgggcctattcctaccgatccgtaccgaaggaaccaaacgacccgtaaaggaactcgtaactgtaatccgtagaacaaagtgaaacctagtacgtaaaggaacgaaccggaagaccgttaacgggccttaggttacttcgaggtgcggtaaggtggagggagtaacggttaacgtaacggg

SEQ ID NO: 421201 - DNA, 583 bp, Homo sapiens
  misc_feature: GZ8MTXP01AQAZW.51.37.D04.1.454.CMB.2.raw
  modified_base (294)..(294): a, c, t, g, unknown or other
  modified_base (371)..(371): a, c, t, g, unknown or other
  modified_base (539)..(539): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctgggtggaatcgtggggggagctttgggtcaaggccgtgggacggggttccctgacgtaccttctccgtgtgtacgccctcgtggtacttcacctttnagtggcttacttcatgagctggactccgcaggctaccgagggggacgggctggcaggtcggtctcactatattaggngactaaaagtcgggaacaaccacgtattcacgcagtactgtagtaggaacgggcctattcctaccatcctaccgagggaccaacgacaagactcacgtgtacttcagactaaagtcgaaactcgttaacaaaggcgaaccgaagaccgaccgggttcttagtcttcgnggttcggcggtggtggtaggggagacggtaacgttcggggaacg

SEQ ID NO: 421202 - DNA, 710 bp, Homo sapiens
  misc_feature: GZ8MTXP01DPNR1.51.37.D04.1.454.CMB.2.raw
  modified_base (341)..(341): a, c, t, g, unknown or other
  modified_base (351)..(351): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagccgtggaggtccctgagactctcctgtcgcagcctctggatcaccttcagtgctacttcatgagctggactcccgcaggcctaccgagggggaacggctgcgtagtgggtctccanattagttagngaacttaaagtgggggaacaaaccccgtatactttaccgtacggacaacgaccttcgttaggtacgggaacgggtccctaatttcctaccgattcctaccggaagggaaaccaacgtacccaaaggggaacccttacgtaacttacggtaaactttcgtaacgaaacctaaaaagttccggaaaaccctagggttaaaccaaaacggggaacgtaaaccccgggaaaggtaacccgttacccgggggtaaccccgtttagggttaaccccgtttcgttaggggttaacccgggaacggttaacgggggtttggggtaaggggggaacctaaaggggggttaacccgtttaaccgggggg

SEQ ID NO: 421203 - DNA, 673 bp, Homo sapiens
  misc_feature: GZ8MTXP01C5B4Z.51.37.D04.1.454.CMB.2.raw
  modified_base (224)..(224): a, c, t, g, unknown or other
  modified_base (246)..(246): a, c, t, g, unknown or other
tcagcgatcgtatacacgaccggtgctcgatttagtagcatactgttgggtttgggggtgggtccaggaggcagaactctgggtgtctcaccatggcctggatccctctacttctcccctcctcactctctgcacaggctctgaggcctctatgagctgacacagccagcctcggtgtcagtcgtccccaggacagaccggccaagactcccctgctcgtgganatgctattcgaacctaaaagtntttgtctttttagaaccaacagaacgcaggccacggccctaataataattataataataaagacagtagagacgccctagagggactcccgtgacgtctacttctcgtacggcctccgagcctacgacgggaaaccaacgaacgccctacggttacgacgtagttaggagggacgtaccgaaggcaaaggaacgtacggaacgggcttacgggtaacttaacgttaacgtcgtaaactaacgtacgaagggacgaacggaacgacgtaaggttggtaacttaggtacggtagttacggttcggggacgggaagggtaacccgtaagggttacggtacccggttacgttaacggcgaaccggttccccgaacgggtcccgtacccgtccccggtcggtacccttaccttcccgttcccgtttcccccg

SEQ ID NO: 421204 - DNA, 640 bp, Homo sapiens
  misc_feature: GZ8MTXP01ASU5W.51.37.D04.1.454.CMB.2.raw
  modified_base (253)..(253): a, c, t, g, unknown or other
  modified_base (510)..(510): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtggtttcgtgtagctatatagagtgtcagtgtcaggtgcagctggtggaatcggtgggggaggtcttggtcaagccgtgggagggtccctgagcctctcctgtgcncgtctgtgtactcctactcgagtcgtacttactacataggacgtcgtacggacctccccgacgacggtaccgacggagggggacggtctggcgtaggtcggtcctaccatagttagtacgtacgtaacgtaaaggtcggaaacaaacctactacttacgacgacaacgtcctagaggaacggtacgtcctacttccactactccgtaccggaacgaacctaaccgaaccaacgtactacgtacttacgtactacganaacgaaacgtaacgtaacgtaacgtaacgaaacggaacgaacggaaacgaaccgttaccggtaccgtacgttacgttcgttcggtggtaggtaagggtagggtagggacggtaacggttaacggtaacgg

SEQ ID NO: 421205 - DNA, 602 bp, Homo sapiens
  misc_feature: GZ8MTXP01BYRDS.51.37.D04.1.454.CMB.2.raw
  modified_base (262)..(262): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagccgtgggagggtccctgagactctcctgtgcagcctntggatcactcagtgctactcatgagctggatccgcaggctccgagggaggctgcaggtggtctcactatatagtgaactaagtggggaacaaacccgatactttcaacggctaagaccttcgtaggaaggaacgggccgtaattcctaccaacgttccgtacccgaaggggaaaccaaaccggtacccaaaacggggtaacctcgaaaccgttgtaactccgtgaacctaaaagtgaaacctagtactaaaggaacgaccgaaagtaccgacgggtcccgttgttaccgttcgttggtaagcgtaaggtcggtaggggagtaacgggttaacgtaacggg

SEQ ID NO: 421206 - DNA, 670 bp, Homo sapiens
  misc_feature: GZ8MTXP01DFCS8.51.37.D04.1.454.CMB.2.raw
  modified_base (258)..(258): a, c, t, g, unknown or other
  modified_base (343)..(343): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggcaagcctggagggtccctgagctctcctgtgcagcctntggatccacttcagtgctacttcatgagctggactcccgcaggctcgaggggagggctgcaggtggtctacacgtattagttagngtaacttaagtggggaacaaacccactactttccgaacggctaacgtaccttcgtagggaaggaacggggtccctaatttcccgaccctacttcccgtaacccggaaacggggaaccaaaccgacccgaaaacggggtaaacccttcgtaaaccgttgttaactcgtacgaacctaaaagttcggaaactaacggttaaccaaaagggaaccgacccgggaaaacggaacccggttacgggttaccgttacgtttacccgtttgttacgggtgggtaacggtgggttaggggtgggggaacgtaacggggttaacggttaaccgggg

SEQ ID NO: 421207 - DNA, 609 bp, Homo sapiens
  misc_feature: GZ8MTXP01EN10C.51.37.D04.1.454.CMB.2.raw
  modified_base (359)..(359): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagtcttggtcaagcctgggaggtccctgagctctcctgtgcagcctgtggatcacttcagtgctactcatgagctgactccgcaggctccgagggagggctgcaggtcggtctcactatacgttagtcgtaactaaagtggggaanaaacccataactttctaacgctaagtacctgtacggaaggaacgggccgtaatttccctacctaactcccgtaccgaaacgggaaccaaaccggaccaaacgggaacctaccgtaacttagttaactccgtagaaacctaaaagtacgaaactaacgtacctaaaggaacggaccgaaagaccgttaccggtaccgttgttacttcgttgtaagcggtaagtggtagggaggaacggttaacgtaacggg

SEQ ID NO: 421208 - DNA, 642 bp, Homo sapiens
  misc_feature: GZ8MTXP01ENUCN.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtggggggagcttggtcaagcctgggacgggtccctgaggctctcctgtgcacgcctgtggtactcctaccttcgaggtcgtcttactcagtgagcgtggactcccgacgaggcctacggaagggggacgggctgacgtaggtcggtacctacgactattagttaggcgtaacgttaaaggtcggggaaactaaaccctacgtactttaccgacgctaaacgtaccttgtaggtacgggaacgggtacctactttacccacctactccgtaccgaagggaaccaaacgacccaaagggtaccctacgtaacttgtaacttaccgaggaactaaagtcgaaacctagtaacgaaacggaacgaaccgaagaccgacggtccgttagttacgttcgttggtgcggtaaggttgggagggagtaacggttcgtaacggg

SEQ ID NO: 421209 - DNA, 576 bp, Homo sapiens
  misc_feature: GZ8MTXP01EA0X6.51.37.D04.1.454.CMB.2.raw
  modified_base (352)..(352): a, c, t, g, unknown or other
  modified_base (381)..(381): a, c, t, g, unknown or other
  modified_base (407)..(407): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtggggggagcttggtcaagccgtgggacgggtccctgagactctcctgtcgcacgcctcgtggtacttccaccttcaggtcgctacttcatgagctggactccgcaggctcgaggggaggctgcaggtggtctcactatattagngaactaagtgggaacaaccatattcacgnagactcgtagagacgggcctattccncatccacgaacggaacaaccgccaaacggtactaccgtactagtactcgtagaactaaagtcgaaacctagtacgtaaagaaccgtaccaaaggaccgaggtcccgtagttacgttcgaggtcggtaggtaaggttgggggaggaggtaacggttaacggtaaccgggg

SEQ ID NO: 421210 - DNA, 684 bp, Homo sapiens
  misc_feature: GZ8MTXP01A5CT4.51.37.D04.1.454.CMB.2.raw
  modified_base (247)..(247): a, c, t, g, unknown or other
  modified_base (296)..(296): a, c, t, g, unknown or other
  modified_base (362)..(362): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagtcttgggttttccttgttgctattatagaaggtgtccagtgtcaggtgcagctggtggaatcggtgggggagtcttggtcaaggccgtggggacgggtcccnggagtcctctcctgtcgcacgcctcgtggactcacttcagtgcttactnatgagctggactcccgcaggctaccggagggggaagggctagcaggtcggtctccatattattagngtaactaagtcggggaacaaacccagtactttacgacgacaagtacttcgtggtaacggaacggggtccccttaagttccctaaccctatacccgtaccggaacggggaaaccaaaccggaacccaaagggtaacccgttactaaccggttagttaactaccgttaggaaacaaaacgttagtaaaccaaacgggtttactaaaacgggaaccgtaaccggaaaaggaccgttaacccgggtcgttaacggttacctttccgttagggtggaccgggtaaggttggggaggggttaacggaagggttaacccgttaaggggg

SEQ ID NO: 421211 - DNA, 719 bp, Homo sapiens
  misc_feature: GZ8MTXP01E0681.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggacgggtccctgagactctcctgtgcagcctctggatcaccttcagtggctactcatgagctggatccgccaggctccgagggagggctgcagtggtctcacatatagtgactaagtgggaacgaaccactattctaacggcaaggaccttcgtaggaacgggtaaacgggggccccaatttcccctacctaattccccgtacccggaacgggggaaacccaaaccgggaccccaaaacgggtaacccttaccaccgttacgggtaacttccgttacggaacctaaaagtacggaaaacctaacggttaaccgtaaaagggaaccgggtaaccccggaaaagggtaccccggaaaccccgggggttcccccggttaagggttaaccccttttccggttaggggttaaccggggcccggggttaacgggtttacgggggttacggggggaaaggggtaaaccgggggttaacccggtttaaacccgggggg

SEQ ID NO: 421212 - DNA, 586 bp, Homo sapiens
  misc_feature: GZ8MTXP01C8E8L.51.37.D04.1.454.CMB.2.raw
  modified_base (263)..(263): a, c, t, g, unknown or other
  modified_base (267)..(267): a, c, t, g, unknown or other
  modified_base (319)..(319): a, c, t, g, unknown or other
  modified_base (337)..(337): a, c, t, g, unknown or other
  modified_base (455)..(455): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggacgggtccctgagtactctcctgtgcagcctntggntcacttcagtgctactcatgagctgactccgcgaggctcgagggaggctgcnggtggctcactatatagngaactagtggggacaacccgatacttacgtacgcagtacctgtaggaacggacgggtcctatttccacctagttcccaccggaacgggaaccaacggaccccaaagggtaaacccttnaaaccgttgtactcgtacgataaaacgtgaaacctagtacctaaaggaaccgaccggaaagaccgacggtccgttagttacgttccgttaggtcgaggtaaggttgggagggaagtcggaaccgttaaggg

SEQ ID NO: 421213 - DNA, 626 bp, Homo sapiens
  misc_feature: GZ8MTXP01A4G8V.51.37.D04.1.454.CMB.2.raw
  modified_base (240)..(240): a, c, t, g, unknown or other
  modified_base (366)..(366): a, c, t, g, unknown or other
tcagcgatcgtatacacgaccggtgctcgatttagtagcatactgttgggtttgggggtgggtccaggaggcagaactctgggtgtctcaccatggcctggatccctctacttctcccctcctcactctctgcacaggctctgaggcctcctatgagctgacacagccagcctcggtgtcagtgtccccaggacagacggccaagatcccctgctctggagatgcattgaccaaaacgtntttgctttttagacaacagagcagcagccctataataatatatataagacagtagagacggcctacgagggtactcccgttgacgcgtaattctcgtcggcctccgagctacagggaacctaacgngccaacgttgacgtattagtacgacgttacccgaaggaccgaagaacggacgtagactagtaactagttactgttacaatcgagcaaggccgaagtagtggtaactttagacggtaacgtaggttcggaacgggagggaaccgtaaaggggttccgaaaccggttccgtaaacggggttcaccgggttccccgaaagggcccttacccggaaccccgttccggggttaccttacttccccggttaacgttttcccccccg

SEQ ID NO: 421214 - DNA, 621 bp, Homo sapiens
  misc_feature: GZ8MTXP01EXOY0.51.37.D04.1.454.CMB.2.raw
  modified_base (348)..(348): a, c, t, g, unknown or other
  modified_base (375)..(375): a, c, t, g, unknown or other
  modified_base (399)..(399): a, c, t, g, unknown or other
  modified_base (413)..(413): a, c, t, g, unknown or other
  modified_base (564)..(564): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctggagcgttgggttttccttgttgctattatagaaggtgtccagtgtcaggtgcagctggtggaatcggtgggggagtcgttggtcaagccgtgggacgggtccccgagacctctcctgtgcagcctctggtcttcaccttcagtgctacttcatgagctggactcccggccgaggccgtaccggagggggaaggggccgtggccgnggtcggggtctacacctattagttagngactaaagtcggggaacaaaccancttacgcgacgacnctcgtaggtacggaacgggccctattccaccgattccacccggaagggacccaacggaccaaacgactcaacgtgtaactcaagacaaagtcgaaacgtagtaaccaaaggccggaaccgaaagaccggaccgggttccgttaacggtttnacgttcgttcgggtggtcggaagggtaggtggggacggtaacgggaacggtaaccgg

SEQ ID NO: 421215 - DNA, 633 bp, Homo sapiens
  misc_feature: GZ8MTXP01AZTSP.51.37.D04.1.454.CMB.2.raw
  modified_base (262)..(262): a, c, t, g, unknown or other
  modified_base (288)..(288): a, c, t, g, unknown or other
  modified_base (330)..(330): a, c, t, g, unknown or other
  modified_base (593)..(593): a, c, t, g, unknown or other
  modified_base (606)..(606): a, c, t, g, unknown or other
  modified_base (613)..(613): a, c, t, g, unknown or other
  modified_base (623)..(623): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttcctgttgctattatagaaggtgtccagtgtcaggtgcagcgtggtggaatcgtgggggagtcttggtcaagcctgggagggtccctgacgctctcctgtgcagcctntggatcacttcagtgctactcatganctgactccgcaggcctcggagggacggggctgcaggtggtcnccgactattagtagtgtaactaaaggtcggggaaactaacccatactttccaccggatacgtaacccttcggtaggtacgggaaacgggggtccctaacgttcccgtaccaacgtttcccgaacccgaagggggaacccctaaaccgacccgaaaggggaaccttaccggaacttacggtactttaccaggaacccttaaagtaccgaaacgtaacgtaacccgtaaaggaaccgacccggttaaagaccgttacggtcggtnttaccgttgttgngacgtgngggtaggagnggaacgtcgg

SEQ ID NO: 421216 - DNA, 633 bp, Homo sapiens
  misc_feature: GZ8MTXP01DN045.51.37.D04.1.454.CMB.2.raw
  modified_base (354)..(354): a, c, t, g, unknown or other
  modified_base (590)..(590): a, c, t, g, unknown or other
  modified_base (604)..(604): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagttgggctgagctgggttttccttgttgctattatagaaggtgtccagtgtcaggtgcagctggtggaatcgtggggggagtcttggtcaagccgtgggacgggtccctgacgtactctcctgtgcacgcctcgtggactcaccttcaggtcggctacttcatgagcgtggatcccgcaggctccgagggggaggctgcgagtggtctcgactatattagngtaacttaagtggggataaacccatacttacacgcagtactcgtaggagaacggggtcctaatttccaccgtattccgaccgaaacggggaaccaaaccggacccaaaggggtaaacccttctaaacgttcggttaactccttaggaacctaaaaattcgggaaaccttagtaaccgtaaaggaacgaaccggaaagaacccgacgggtacccgttgttacctttcgaggttccgngggtaagggttggngggggagtaacgggttaacgttaacgggg

SEQ ID NO: 421217 - DNA, 668 bp, Homo sapiens
  misc_feature: GZ8MTXP01DJ1MW.51.37.D04.1.454.CMB.2.raw
  modified_base (392)..(392): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgcttattatagaaggtgtccagtgtcaggtgcagctggtggaatcgtggggggagcttggtcaagcctgggacgggtccctgacgtactctccgtgtgcacgccttcgtggtacttccacccttcaggtcggtccttaccttcattcggagtcgttaggactccccggccagggcctaccgggaagggggaagggcctggcgtaggtcggtctaccaactattagttagngtaaacttaagtggggaaacaaacccactacttaccacgcacgtactgtaggaaggacgggtccatttccgcatccgaccgagggaaccacgaccaaaggactacgtactgtacttcgagaactaaagtcgtaaacgtaacgttaaccgaaaggaaccggaaccggaaaggtacccgttacggggtaccccgtttagttaacccgttggttacgggttaaggaccggtaaggggtcgggtaagggggaacggtaacgggttaaccggtaaccgggg

SEQ ID NO: 421218 - DNA, 651 bp, Homo sapiens
  misc_feature: GZ8MTXP01AVNLY.51.37.D04.1.454.CMB.2.raw
  modified_base (289)..(289): a, c, t, g, unknown or other
  modified_base (343)..(343): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaaggtgtccagtgtcaggtgcagctggtgaatcgtgggggagcttggcaagcctgggagggtccctggacgtactctcctgtgcagcctgtggatcaccttcagtcggctactcatgancgtgactccgcaggctcgagggaggctgccgaggtggtctccactattagtagntaactaagtcggggaaactaacccatacttcgtaacgcaagtactcgtaggaacggtacgggcccgtattcccgtacctacgtacctaccggaacggaaccgaaacgacccgaaacggggtaaccttaccgtaaccgttacggtaaaccttcgtaacggtaacctaaaaacgttggaaaccgttacgtaaacgtaaacggaacggaaccggttaaacggaccggttcgggaccgtttagttaccgtttcgttggtaacggacggtggtttcgggaggggttaacggtaacggttaaccgtaaccgggg

SEQ ID NO: 421219 - DNA, 628 bp, Homo sapiens
  misc_feature: GZ8MTXP01AIHOG.51.37.D04.1.454.CMB.2.raw
  modified_base (288)..(288): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaaggtgtccagtgtcaggtgcagctggtggaatcgtgggggagcttgggtcaagccgtggacgggtccctgagactctcctgtgcagcctctggatcaccttcagtgctactcatgantgatccgcagctcgagggaggctggcaggtggtctcactatatagtgaacgttaagtcggggaacaaacctactactttaccgacgactacggaccttcgtacggtaggtaaacgggggtcctaagtttcccgtacccaagttcccgtaacccggaaggggaacccaaaccgaccccgaaagggaaccttccaaccgttagttaactcccgtaggaacctaaagttcgaaaacctaggtaccgtaaggaacggacccgaaaggacccgttaacgggcccgttagttacttcgttacggtgcggtaaggtgggtagggacggtaacggttaacgtaacggg

SEQ ID NO: 421220 - DNA, 656 bp, Homo sapiens
  misc_feature: GZ8MTXP01EI502.51.37.D04.1.454.CMB.2.raw
  modified_base (485)..(485): a, c, t, g, unknown or other
  modified_base (552)..(552): a, c, t, g, unknown or other
  modified_base (619)..(619): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagtcgttgggttttccttgttgctattatagaaggtgtccagtgtcaggtgcagcgtgggtggaagtcggtggggggaggtctttggtcaagccgtgggacgggtccctgacgtaccttctcctgtcgcacgccttcgtggtactccaccttgagtcgtctacttcgatgagtcgtggactccccgcgaggccgtaccgggaagggggaacggggtccgtaggcgtaagggtcggttacctaccacgtaatttagtaggtacgaacgttaaggtcggggaactaaacccgattacttaccgtaacgctagtactgtaggtacgggacggtccgtaatttccnctactccgtaccggaggaaccaaaccgaccaaaggtaactcgtaactgtatccgtagataaacgtanacgtaatacgaagaacgtaaccggaaagccgttaacggtccgttaacttacgttcgttggtaacggnggtaagggttcggagggacgtgggaacgttaacgggg

SEQ ID NO: 421221 - DNA, 701 bp, Homo sapiens
  misc_feature: GZ8MTXP01ELVR6.51.37.D04.1.454.CMB.2.raw
  modified_base (263)..(263): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtggggggagcttggtcaagcctgggacgggtccctgagactctcctgtgcagcctntggatcaccttcagtgctacttcatgagctggactccgcaggctccggagggggaggggctggctaggtgggtctcactatattagtgaactaaagtggggaactaaaccactattaccgtacgacagtacctcgtagggaacggaacggggaccctagtttccctaccgtaattcccgaccggaacgggaaccaaacccggaccaaaacggggtaaacccttcgtaacccgttagttaactcctaacggtaaactaaaacgttgaaaaccgtacggttaaaccgtaaaagggaacgaaccccgggaaaagaccccggttaaaccggggttcccggttaacgtttacccgtttccggttaaggggtcgggtaccgggtaaggggtttcgggggacggggggttaagtaaccgggggttaacccgtttaacccgggggg

SEQ ID NO: 421222 - DNA, 682 bp, Homo sapiens
  misc_feature: GZ8MTXP01CZMOW.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctgggtggaatcggtgggggagcttggtacaacgccgtgggacggtccctgacgtactctcctggtcgcacgtcctctggtatccaccttcaggtcggcttactcatgagcgtggactcccgccgaggcctccggagggggaacgggctggcgaggtcgggtctaccactattagttagtgtaactaagtcggggaacaaccagtctacacgtacaaacgacttcgtaggaacgggtaacgggccgtaacttcccgtacacttacccgaaccggacgggaacccaaaccggacccaaaacggggtaaccttaccgtaacttacggtaacttcggacgaactaaaacgtcgtaaaaccgtacgttaaactaaacggggaaccgaaccggttaaacggacccggttacgggtacccgttaggtttaccgttacgttgggtggacgggtaaggttcggggagggagggtaacgggaacgttaaccggggg

SEQ ID NO: 421223 - DNA, 715 bp, Homo sapiens
  misc_feature: GZ8MTXP01A53RA.51.37.D04.1.454.CMB.2.raw
  modified_base (263)..(263): a, c, t, g, unknown or other
  modified_base (277)..(277): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagtcttgggttttccttgttgctattatagaaggtgtccagtgtcaggtgcagcgtgggtggaatcggtgggggagtcgttggtcaagccgtgggagggtccctgagactctcctgtgcngctcgtgctcactnagtgctctcatgagctgactcccgccgaggcctaccgggagggggaacggggtcgtgcggaggttcgggtctccgaactagttagtttagacgtaaacgttaaggtcggggtaaacaaacctaactacgtttacgacgactacgtactcggtaggaacgggacgggtacccttaatttcccgtacctagttccccgaacccggaaaggggaacccctaaaccgaacccgtaaaggggtaaccccttaggtaccttagtactccgttaacggaacttaaaaacgtcgaaaaccgttacggttaaaccgaaacgggaaccggaaacccgaaagggtccccgttaaccgggggtctttacgttaaccgttcggttagggtaacccggtgggtaagggtcggggttacgggggaacgtaacggggaaccgtttaaccggggg

SEQ ID NO: 421224 - DNA, 589 bp, Homo sapiens
  misc_feature: GZ8MTXP01AFPJ4.51.37.D04.1.454.CMB.2.raw
  modified_base (257)..(257): a, c, t, g, unknown or other
  modified_base (264)..(264): a, c, t, g, unknown or other
  modified_base (275)..(275): a, c, t, g, unknown or other
  modified_base (351)..(351): a, c, t, g, unknown or other
  modified_base (374)..(374): a, c, t, g, unknown or other
  modified_base (492)..(492): a, c, t, g, unknown or other
  modified_base (549)..(549): a, c, t, g, unknown or other
  modified_base (555)..(555): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagccgtgggacgggtccctgacgactctcctgtncagcctntggatcacctnagtgctactcatgagctggactcccgcaggcctacgagggggagggctggacgtaggtggtccacactatagttgngaactaagtgggaacaaaccctntacttacgtacgctaagtactcgtaggtacggaacggggtccctacttccgtacctactcccgtaccggaaggaccaacgacccaaaggtacctcgatacgtatcgtagacctaaagngtaaactagttaccaaaggcgtaccggaaatacccgacggtccgttgttaccgttgngtcggngtaaggtggtagggacgtaaggaacgtaaccggg

SEQ ID NO: 421225 - DNA, 623 bp, Homo sapiens
  misc_feature: GZ8MTXP01BTN5I.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagccgtgggacgggtcctgagctctctgtgcagcctctggctcaccttcagtggcttactcatgagtctggactccccggcaggccgtaccggaagggggacggggctggcgaggtcgggtcctacactattacgttaggtcgaaacgtaagtcggggaaacaacctactacttcgacgacaagtactgtaggaagggaacggggtccctaatttccgtcctaagttccgaccgaagggaaccaaccgaccaaaggtaacctcgaaccgttgtaactccgtaagaactaaaacgtcgaaacctaggtaactaaacgggaacgaccggaacgacccgacgggtccttaggttacctttggttgtgggtagtggttgggagggacgtggttaacgtaacggg

SEQ ID NO: 421226 - DNA, 541 bp, Homo sapiens
  misc_feature: GZ8MTXP01ELI08.51.37.D04.1.454.CMB.2.raw
  modified_base (270)..(270): a, c, t, g, unknown or other
  modified_base (285)..(285): a, c, t, g, unknown or other
  modified_base (333)..(333): a, c, t, g, unknown or other
  modified_base (342)..(342): a, c, t, g, unknown or other
  modified_base (347)..(347): a, c, t, g, unknown or other
  modified_base (446)..(446): a, c, t, g, unknown or other
  modified_base (450)..(450): a, c, t, g, unknown or other
  modified_base (455)..(455): a, c, t, g, unknown or other
  modified_base (506)..(506): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggcaagcctgggaggtccctgagactctcctgtgcagcctctgatcaccttnagtgctactgatganctgatccgcaggctcgagggaagggctgcaggtggtctcacatatagngaactaagnggganaaaccacattcgaacgcagactgtagaaggaacgggcctaatttctaccaatccaccgaagggacaaacgccaaaggaacttacaactgtaactgaganaaanataanagtacgaagaacgaacgaacgaacgacggtcgtacgttacgttcgttgtgngtaaggtgggtagggaggtaacggaacggtaacgg

SEQ ID NO: 421227 - DNA, 596 bp, Homo sapiens
  misc_feature: GZ8MTXP01BR9KJ.51.37.D04.1.454.CMB.2.raw
  modified_base (243)..(243): a, c, t, g, unknown or other
  modified_base (369)..(369): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcctcactctctgcacaggctctgaggcctcctatgagctgacacagccagcctcggtgtcagtcgtccccaggacagacggccaagactcccctgctcgtggagatgcattgaccaaaagtntttgctttttaggaccaacagaagccaggccaggcccctataaataattatatataaagacagtgagagccctagagggatcccgtgagcgattctctggccctccagctcgaggggaaacaacgngccctacggttgaacgtattaggtgggacgtccgaggacaagaaggacgaggcctagacttattaactgtacaatccaggggcaagacgactagtggttacttagtagggtattacggttcgggacgggaggggaaccaaaggggttcggaacccgttcgtaggtcgacggcccgaagggtccctcggtcccccgttagggtccaccgttccgttcggttccccccc

SEQ ID NO: 421228 - DNA, 707 bp, Homo sapiens
  misc_feature: GZ8MTXP01CZ56B.51.37.D04.1.454.CMB.2.raw
  modified_base (267)..(267): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagtcgttggtacaagcctgggacgggtccctggacgactctcctgtgcagcctntggatccacttcagtggctactcatgagctggactccgcaggctccgagggaggctgcagtggtctcgactatagttagtgaacttaaagtgggggaacaaacccacgtacttccgtaacgctaacgaccttcgtaggaaggaacggggcccttaaatttccctacccaacgtttcccgaccggaacggggaaaccaaacccggtaacccaaaacggggtaaccttaccgtaaaccgtttcggtaacttacgtacgaaccgtaaaaagttcgaaacctaaacggttacccaaagggaacccgtaaacccgggaaaggaaccccgttaacccgggggtacccgtttacggttacccgtttcggttaccgggttaaggaccggttaaggggtttggggaagggggttacggtaaaccggggttaaccggtttaacccggggg

SEQ ID NO: 421229 - DNA, 631 bp, Homo sapiens
  misc_feature: GZ8MTXP01B9W7Q.51.37.D04.1.454.CMB.2.raw
  modified_base (334)..(334): a, c, t, g, unknown or other
  modified_base (364)..(364): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagtcttggcaagcctgggagggtccctggacgactctcctgtgcagcctctggatcacttcagtggctacttcatgagctggatccgcaggcctccgagggggaagggctgcaggtggtcncgactatattagtgaacttaagtggggaanaaacccactattccgtacgcagacctcgtaggaggtaacggggcctaatttcccgactatccgtaccgaaggggaccaaacggtacccaaaggggtaaccttcgacttacggtaatcccgtagtaacctaaaagtgaaacctaggtaacctaaagggaacgacccgaaacggaccgacggggtacccgttagttaacccgtttgttccgggttggccgggtaaggttgggtagggggaacggtaacgggttaaccgtttaacggggg

SEQ ID NO: 421230 - DNA, 696 bp, Homo sapiens
  misc_feature: GZ8MTXP01DL4PB.51.37.D04.1.454.CMB.2.raw
  modified_base (195)..(195): a, c, t, g, unknown or other
  modified_base (199)..(199): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagttgggctgagcttgggttttccttgttgctattatagaaggtgtccagtgtcaggtgcagntggnggaatcgtgggggagcgttggtcaagccgtgggacgggtccctggagtactctcctgtgcagcctgtggtatccaccttcgagtcgctacttcagtgagctggactcccgaccgacggtcctaccggagggggaacggggctggccgtaggtcgggtcctaccgactaattagttagtgtaacgtaagtcggggaactaaacccactattaccgtaacgctaacgtactcgtaggaaacgggacgggtcctaattccctaccgtattcccgaccgacggggaaacctaaacgacccgaaacggtaaacctcaacgttcgtaacttccggtaaacaaacgtaaacgtacgtaaacctacgtaaaccgtaaacggaaccggaaacccggaacggaacccgttacccgggtacccgtttaacgttacccgttcggttcggtcgggtacgggttaaggggtaggggtacggggaacgggtaaccgggttaaccggtaacgg

SEQ ID NO: 421231 - DNA, 587 bp, Homo sapiens
  misc_feature: GZ8MTXP01BX4PL.51.37.D04.1.454.CMB.2.raw
  modified_base (291)..(291): a, c, t, g, unknown or other
  modified_base (549)..(549): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcggtgggggagtcttggtcaaggccgtgggacggtccctgacgtctctcctgtgcagcctctggatcacttcagtgctactcatgngctggactccgcaggctcgaggggaaggctgcaggtggtctcactatagtagtgaactaagtcgggaacaacccatacttcgtacgcaacgtctgtaggaaggacgggccctagttcctaccctatacccgtaccgaacgggaccaaacggaccaaagggtaactcgaactgtactcgtagactaaagtcgaaactacgtactaaaggaacgacccgaaagacccgttacgggtcccttgttaccgttgttcggtcgnggtaaggttgggagggaggtaaggttaacccgtaaggg

SEQ ID NO: 421232 - DNA, 754 bp, Homo sapiens
  misc_feature: GZ8MTXP01ESLO9.51.37.D04.1.454.CMB.2.raw
  modified_base (249)..(249): a, c, t, g, unknown or other
tcagcgatcgtatacacgaccggtgctcgatttagtagcatactgttgggtttgggggtgggtccaggaggcagaactctgggtgtctcaccatggcctggatccctctacttcctcccctcctcactctctgcacaggctctgaggcctcctatgagctgacacagccagcctcggtgtcagtcgtcccaggacagacggaccaagctccctgcctgtaggagtatgctattacgaacctaaaacgtnttttcgttacgtttttacggaacctaagaagacgccgaggaccgacgtaccctaataacttaattaagtaactaagtaaaagacgtaagtagaacggaccggtccctacggacgggtacctacccgtaggtacgtacgttacttccgtcgtcgtccccctacgacgtacgacggaaacggaaacccaaacgtcgtacccgtaacgttacgaacgtagttttaggggcggacaccggagacgtaaaggaggaacggagttaccgagtaacttacgttacttacgaacttaacacggaacggcgaacggtaacgtaggtaggttaacgttacggttaggtacgggttaacggttacgggtacggggacgggtaacggtaaccgggtaacgggttaccggtaccggttaccggtacgggtcaacccgggttaccgttacccggtcccggtccccggttaacccggttccggtacccgttacccgtttccccgttccccgtaacccccg

SEQ ID NO: 421233 - DNA, 669 bp, Homo sapiens
  misc_feature: GZ8MTXP01AGXVJ.51.37.D04.1.454.CMB.2.raw
  modified_base (243)..(243): a, c, t, g, unknown or other
  modified_base (371)..(371): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcggtgggggagcttggtcaagccgtgggacgggtcccngagactctcctgtgcagcctctggatccaccttcagtgctacttcatgagctggactcccgccaggctccggaagggggacgggctgcgtggtggtctcccatattagtagcgaactaagtcgggtanaaacccgatacttctacgctaacgtacctacgtaggaacgggtaaacgggcccgttacttacctacccacgttacccgtacccggaaagggaaaccccaaaccgggacccaaaacggtactaaccgacttacggttacacgttacgaacctaaaagtaccgtaaacgacggttaaaccaaacgggaaccgaacccggttaaacgaccggaaaccgggtcccgttagttaccccgtttaggttggtccggagggttaaggtggggtagggggagtaacggggttaaccgtaaccggggg

SEQ ID NO: 421234 - DNA, 535 bp, Homo sapiens
  misc_feature: GZ8MTXP01ENBNM.51.37.D04.1.454.CMB.2.raw
  modified_base (354)..(354): a, c, t, g, unknown or other
  modified_base (362)..(362): a, c, t, g, unknown or other
  modified_base (395)..(395): a, c, t, g, unknown or other
  modified_base (400)..(400): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctggacggtccctgagctctcctgtgcagcctctggatcaccttcagtggctacttcatgagctggactccgcaggctccgaggggagggctgcagtggtctcacatattagtgaactaagtgggganaaacccanattctacgcagactcgtagagaagggccattcncatcncagggacaacgccaaaggactacgactgtatcgtgaacaaatgaaactagtacgtaaagaacgaccggaaagaccgacggtccgtgttaccgttgttgtaagcgaaggtgggtgggagtaacggaacgtaacggg

SEQ ID NO: 421235 - DNA, 782 bp, Homo sapiens
  misc_feature: GZ8MTXP01A9SHQ.51.37.D04.1.454.CMB.2.raw
  modified_base (282)..(282): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgttgggttttccttgttgctattatagaaggtgtccagtgtcaggtgcagctggtggaatcggtgggggagcgtttggtcaagccgtgggacggtccctgacgcttctctgtcgctagcctgtggtatccaccttnagtgactactcatgagctggactcccgacgaggctaccggaagggggacgggctaggcgtaggtcggtcctaccactagttagttaggtcgaaacttaagtcgggggaaactaaaccctactacgtttaccgtaaccggctaaacgtacccgttgaaggggaaacgtaaaccgggggtccccttatttaccccgtaccctaagttaccccgtacccgggaaacggggtaaacccaaacccggtaaccccgaaaaccggggtaaaccctttcccggaacccttaggtttaactcccgttacgggaaactaaaacggttacgaaaactacggggttaacccgtaaagggtaaccggaaccccgggaaaagtacccccgggttacggggtaccccgtttaacgggttaccttttcccgggttacgggttaaccgggtacgggttaaggggtttacgggggtaaccggggttaaacgggtaaccgggttaaccgggtaaccggg

SEQ ID NO: 421236 - DNA, 688 bp, Homo sapiens
  misc_feature: GZ8MTXP01DEVPW.51.37.D04.1.454.CMB.2.raw
  modified_base (246)..(246): a, c, t, g, unknown or other
tcagcgatcgtatacacgaccggtgctcgatttagtagcatactgttgggtttgggggtgggtccaggaggcagaactctgggtgtctcaccatggcctggatccctctacttctcccctcctcactctctgcacaggctctgaggcctctatgagctgacacagccagcctcggtgtcagtcgtccccaggacaggacggccaaagactcccctgctctggagatgcattcgacctaaaaacgtnttttgtacttttttaggaaccaacagaacgccacggccacggacccctaataaattaattaataataataaagactagtagaggacggaccctagaacgggtactcccgtgacgtcgtattctcgtcggccctccgagccgtacgaacgggaaaccaacgtcgaccgtacgttaggaacgtaagttacggtagggacgtaccgaggacgaaggaaacggtacgaaggtacttacggtaacttaacttaacgtacgtaacaaacgttacgaaggggacgaacggtaacgtaacgtaagggttcgtaagtttagtacgggtaaggttacggttacggggaccgggtaagggaacgtaaagggttcggtacccgttacgttacggcttacggccgacggtcccgttaccgccccgtcggtccttacctccgttccgtaacccccg

SEQ ID NO: 421237 - DNA, 628 bp, Homo sapiens
  misc_feature: GZ8MTXP01DN9YX.51.37.D04.1.454.CMB.2.raw
  modified_base (265)..(265): a, c, t, g, unknown or other
  modified_base (277)..(277): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtggggggagtcttggtcaaggcctgggacgggtccctgacgctctcctgtgcagcctntggatcaccttnagtcgctactcatgagtctgactccgcaggctaccgagggggaaggctgcgaggtgggtctacgactatagttgtagtaactaagtggggaacaaaccatactctacgcagactcgtggaacggaacgggcctaattccgtacctatcccgtaccgaacgggaacccaaaccggtacccaaacgggtaaaccttcgaacttacggtaacttcccgtagaacctaaaaagtcgaaacgtaacgtacgtaaaggaaccgaaccggaaacgacccgttacgggtccgttagttaacccgttcgttacggtgacggtggttagggacggggaggaacgggttaacgtaaccgggg

SEQ ID NO: 421238 - DNA, 643 bp, Homo sapiens
  misc_feature: GZ8MTXP01BO5ND.51.37.D04.1.454.CMB.2.raw
  modified_base (244)..(244): a, c, t, g, unknown or other
  modified_base (258)..(258): a, c, t, g, unknown or other
  modified_base (289)..(289): a, c, t, g, unknown or other
  modified_base (294)..(294): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcctcactctctgcagaggctctgaggcctcctatgagctgacacagccagcctcggtgtcagtcgtccccaggacagacggccaagactcccctgctctggagatgcattgaccaaaacgttnttgtctttagacanagacgcacgcacgacctataatatatataanaaganagagagacgcctacgaggtactccgagacgcgtacttcgtcgtcgtccctaccgacgcgtacgaacggaaacaacgcgtaccgtacgtagacgtagttaggaggacgtaccgaggacgaaggaacgacggaggtacgtagtaacttagttacgtagtaacaactacgaacgggacgaacggaacgtaacgtaggttacggttaacgttaggtacggtagttacgggtacggggacgggaacgggtaacggtaacgggttacggtacccgttacgtaacggtaccgaccggacccgacggtcccgtccccggtccccgttacggtccttacccgttccgttcccgtcccc

SEQ ID NO: 421239 - DNA, 674 bp, Homo sapiens
  misc_feature: GZ8MTXP01A15IM.51.37.D04.1.454.CMB.2.raw
  modified_base (256)..(256): a, c, t, g, unknown or other
  modified_base (379)..(379): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagtcttggtcaagccgtgggacgggtccccagactctcctgtncagcctctgattcacttcagtgctattcatgagctgactccgacaggtcctccggagggggacgggctggcgtaggtcggtctacactattagttaggcgtactaaaagtggggaacaaaccnctatttccacggctaagaccttcgtaggtaggaaacgggtccgtaatttccgtaccgtaacttcccgtacccgaaggggaaccccaaaccgaccgaaaacggtaaccttcgaaaccgttcgttaaactcccgtaaggaaccctaaaagtacgtaaaccgtaacggttactaaaacgggacggtaaaccccggaaaggttaaccggaccgggttcccgttagttaaccttccggttggttccggtaaggagggttgggtaagggggagaacggggtaacgttaaccggggtaacgg

SEQ ID NO: 421240 - DNA, 627 bp, Homo sapiens
  misc_feature: GZ8MTXP01C28AX.51.37.D04.1.454.CMB.2.raw
  modified_base (508)..(508): a, c, t, g, unknown or other
  modified_base (570)..(570): a, c, t, g, unknown or other
  modified_base (580)..(580): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagtcttgggttttccttgttgctattatagaaggtgtccagtgtcaggtgcagcgtggtggaagtcggtgggggagtcgttggtcgaagccgtgggacgggtccctgacgtactctctgtcgcacgcctgtggtactcctaccttcaggtcggtcttactcatggagtcgtggactcccgacgacggccgtaccggaagggggacgggctaggcgtaggtcggtcctaccgactattagtagtgaacgttaagtgggaacaaaccgtactagtacgtacgacaacggtccttacgaggaacgggtacgggtcctaacttcctaccgtattccggacgaacggaacaacgaccagaactcacgttnacgtcagaaacttaaagcgtaaacagtaacgaaaggccgaaccgaaaggtacgcgtaccgtnttaccgttgnggaacgtgggaaggtttcggagggacgtaacgggttaacgtaacggg

SEQ ID NO: 421241 - DNA, 654 bp, Homo sapiens
  misc_feature: GZ8MTXP01DI9GN.51.37.D04.1.454.CMB.2.raw
  modified_base (362)..(362): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagtcttgggttttccttgttgctattatagaaggtgtccagtgtcaggtgcagcgtggtggaatcgtgggggagcttggtacaagccgtgggacggtccctgacgctctcctgtgcacgcctgtggtactccaccttcgagtcgctacttcatgagctgactcccgcaggcctcggagggggacggctgcgtaggtcggtctaccactagttagttagngaacttaagtcggggaaactaaacccgactagttaccaacgcaacgtacttcgtaggtacgggaaacgggccgtaatttccccaccgtattcccgaccgaacgggaacccaaaccggaccccaaagggtaaccctccgtaaacttcgtaactcacgaactaaaacttcggaaacctaggttaccgaaaggaacgaacccggaaagtacccgacgggtacccgttaggttacccttcgttaggtcggacggtaagggtcgggtagggggaagtaacggaacggttaaccgggg

SEQ ID NO: 421242 - DNA, 762 bp, Homo sapiens
  misc_feature: GZ8MTXP01AOWGB.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcggtgggggagtcgttggtcaagccgtgggacggtccctgagacctctcctgtcgcacgcctcgtggtactccaccttcgaggtcggccttacgttcagtgagtcgtggactcccgcgaggccgtaccggaagggggagggtctggacgtaggtcggtctaccgactagttagttacgtgtaaacctaaggtcggggaaacaaaccccgtactacgtttaccgaacggactaacggtactacggtagggaaacgggtaaccggggcccttatttaccccacccgtacgttaccccgaccgggaaacgggaaacccaacccgaacccgaaaacggttaaaccctccgtaaagtttacgtaccttcgtaacggaaactaaaacggttacgaaaccggtaagttaaaccgaaacgggaaccggaaaccccggttaaaggtacccggttacccggggtacctttaacgtttacccggtttcgttggggttaacgggccgggttaaggggtttaccgggggaaggggaacggggttaaccgggaacccggtttaaccggggg

SEQ ID NO: 421243 - DNA, 620 bp, Homo sapiens
  misc_feature: GZ8MTXP01DW4AI.51.37.D04.1.454.CMB.2.raw
  modified_base (500)..(500): a, c, t, g, unknown or other
  modified_base (571)..(571): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctgggtggaatcgtggggggagtcttgggtcaagccgtgggacgggtccccagactctcctgtgcagtcctctggacttcaccttcagtggctacttcatgagctggactccgcaggctcgagggggagggctgcaggtcggtctacgaactattagttagtgacgtaaaagtcgggggaacaaacctactactttaccgacgaccgaagtaccttcgtaggtacgggaaacggggtccctaatttccctacctattcccgacccggaagggaccaaaccggccaaacgtaaccgtctaacgttntaatctagacaaagttacgaatacgtactaaacggagaaccgaaagttcgaccggttcgtagttacttcgnggttcgaaggtagtgggtaggggagttacggtaacgttaaccgggtaag

SEQ ID NO: 421244 - DNA, 731 bp, Homo sapiens
  misc_feature: GZ8MTXP01BNYG7.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagtcttggtcaaggccgtgggacgggtccctgagacctctccgtgtgcacgcctcgtggtatccaccttcaggtcgctacttcatgagcgtggactcccgccaggcctccggagggggtaagggctggccgaggttcgggtctcccgactattagttaggtgaacttaaggtcgggggaaacaaacccatactttaccacggtcacggacttcgtggtacggaaacggggtccctaatttccctacccgtacttcccgaacccggaagggggtaacccaaacccggacccgtaaaacggggaaacccgtttccaacgtttacggtaacttccgtacggtaaacctaaaattacgggaaaaccttaagttaacccgtaaagggaaaccggtacccgaaaaccggaccggttcccgggggttaaccccttggtttaacccgtttccggttaggttcggggaccggttaagggtcgggggttaggggaacgggtaacggggttaaccgtttaaaccggggg

SEQ ID NO: 421245 - DNA, 594 bp, Homo sapiens
  misc_feature: GZ8MTXP01D0QBX.51.37.D04.1.454.CMB.2.raw
  modified_base (256)..(256): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttggctgagcttgggttttccttgttgctattatagaaggtgtccagtgtcaggtgcagctggtgaatcgtggggggagcttggcaagccgtggaggtccctgagctctctgtgcagcctnggactcaccttcagtcgctacttcatgagctggactcccgacaggcctaccgagggggaaggctgcaggtggtctcactagtacttagtcgaacttaagtggggacaaaccactattaccgacgacaacgactctaggaacggaagggccctaattcctacctagtcctaccgaagggaccaaacgccaaagggtaaactcgaaccttgaactcgtacgaagtaaatacgaaacctagttaccgaaaggaagtacccgaaagccccgaaggtacccgttagttacgttcgttggtgcggtaagtgggtaggggacgtaacgggttcgttaacccgggg

SEQ ID NO: 421246 - DNA, 755 bp, Homo sapiens
  misc_feature: GZ8MTXP01AKVQR.51.37.D04.1.454.CMB.2.raw
  modified_base (289)..(289): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagtcttgggttttccttgttgctattatagaaggtgtccagtgtcaggtgcagctggtaggaatcggtgggggagtcttggtcaagccgtgggacggtccctgacgtactctcctggtgctacgtccctgtggtactctacccttnaggtggcttacttcatggagtcgtggactcccgccgagggcctaccggagggggaacgggtctggcgtacgggtcgggtctacccgacgttattagttaggtcgtaaaacgtaaagggtgggggaaacctaaaccctaacgttacgtttttaccgaaccggtactaaacgggtaacctttcggaaaggggaaacgggtaaccgggggtcctaaccgtttacccgaccctaagttccccgtaccggaaacggaaacccgaacccgaacccgaaacggggtaccctacgtaaacgttcggtaacttcgaacgtaaacctaaaagtccgaaacgtacgtaaaccgtaaacgggaaccggaacccggaaaggtacccggacccgggttacccgttagttaccccgttggttggtaaccgggagtaagggtaggggtacggggagggtaacggttaacggttaacccgggg

SEQ ID NO: 421247 - DNA, 605 bp, Homo sapiens
  misc_feature: GZ8MTXP01DLA1X.51.37.D04.1.454.CMB.2.raw
  modified_base (280)..(280): a, c, t, g, unknown or other
  modified_base (291)..(291): a, c, t, g, unknown or other
  modified_base (568)..(568): a, c, t, g, unknown or other
tcagcgatcgtatacacgaccggtgctcgatttagtagcatactgttgagctctgggagaagagccccagtcccagaattcccaggagtttccattcggtgatcagcactgaacacagagactcaccatggagtttgggctgagtcttgggttttccttgttgctattatagaaggtgtccagtgtcaggtgcaggctggtggaatcgtggggggagtcgttggtcaaggcctgggacgggtccctgacgtactctcctggtgcagctctggatcacctnagtggctactnatgagctgactccgcacggctacggaggggagggctgcgtaggtcggtctacactattactaggtgaacttaaggtggggaactaaaccacgtacttacgtacgcacgactcgtaggacggaacgggtcctaattccgtaccattaccgacccggaaagggaacccaacggtaccccaaagggtaaaccttcgaaaccttgtacttacgagtaactaaagtcgaaacctagtaacgtaaaggaacgacgaaagccgttacggtccgtattacgttcnggtcggagtgggtgaggggagtaaccgggcgtaacgg

SEQ ID NO: 421248 - DNA, 698 bp, Homo sapiens
  misc_feature: GZ8MTXP01DG3MS.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgcttattatagaaggtgtccagtgtcaggtgcagcgtggtggaatcggtgggggagtcttggtcaagccgtgggacggtccctgacgtctctccgtgtcgcacgcctcgtggtacttccaaccttcgaggttggtaccttacgtttccaagttcggaacgtcgtacggactccccggaccgaacgggcctacccgggaaaggggggtaacgggcttaggcgtaagggtcgggtacctccgaactaagttagttaagtcgaaccgttaaaggtggggaaactaaaccctaacgtacttaccgtacgcgtaagtacccttgtacgggtacggaacgggtcctaacgttcctaccctatcccgtaccggaagggaaccaaacgtaccccaaaggtaaaccctctacttagtacttcgagaactaaaagtgaaacctagtaacgtaaagaaccggacggttaaaccgacgttacggtaccgttgttaccgtttgaggttcggacgtgggtagggagggagtaacgggaacgttaaccggg

SEQ ID NO: 421249 - DNA, 768 bp, Homo sapiens
  misc_feature: GZ8MTXP01AOTHL.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttcctgttgctattatagaaggtgtccagtgtcaggtgcagctggtggaatcgtgggggagtcttggtcaagcctgggacggtccctgacgactctccgtgtcgcagtcctcgtggactcgaccttcagtgctacttcatgagtctaggactcccgccagggcctaccggaagggggaacggggtctggacgtaggttcggggtacctaccgaacctagtttaagttaggtacggaaccttaaaagggtcggggaaacctaaaccctcgtaaacttttaccgaccggcgtaaacgtacccttaggttaacgggaacggggtaaaccgggggtccccgttaattttaccccggtaccccgtaaatttccccggaaccccggaaagggggtaaaccctaaacccgggaccccggttaaaaacgtaacccttaccgtaacgttacgttactacggtaacgaaacgttaaaacgtacggtaaacctaggttaaaccgaaagggaacccggaaaccggttaaacggacccggttaccgggtaccgttacgttaccgttcggttgggtaacggagggttaacggggtgggtacggggacggtaaccgggttaacggtcggg

SEQ ID NO: 421250 - DNA, 947 bp, Homo sapiens
  misc_feature: GZ8MTXP01ADBK7.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaggtgtccagtgtcaggtgcagcgtgggtaggaatcggtggggggaggtcgttgggtcaagccgtggggacggggtccctggacgtacttctccgtgtcgcacgtcctcgtggtacttccaccttgtaacggtcgggtacttacttacagttacgagtccgtacgggtacctccccggaccggtaacgggtccccggtaacccgggaaggggggtaaccggggggtcgtcgggtaccggttacggggttacgggggtttcctaaccccgtaaacgttaagtttaacgttttagggtacgtaaaaaccgttaaagggttaacggggggaaacctaaaccctaaaccgttaacgttttaccgtaaccgggtaccaaacgggttacccttaggggttaacggggaaacggggtaacccggggtccctttaacgtttacccctaccccgtactttaccccgggaaccccggtaaacggggggaaaacccctaaaccccggggaacccctaaaaaacgggggttaaccccgttacccttaaaccgttcggttttaaacctacgaacgttaaccgaaagttaaccgaaacgtaaacggtaaaccgtaaacgggaacggtaaacccggaaacggtaaccgggacccgggggtttaaccctttacggggtttaacccttttccggggttagggtttcccggggaacgggggtttaacggtaagggggggggtacggggttaaaaacgggtcccgggggttaaaccgggttttaacccgggggg

SEQ ID NO: 421251 - DNA, 748 bp, Homo sapiens
  misc_feature: GZ8MTXP01EE9DW.51.37.D04.1.454.CMB.2.raw
  modified_base (224)..(224): a, c, t, g, unknown or other
  modified_base (244)..(244): a, c, t, g, unknown or other
  modified_base (261)..(261): a, c, t, g, unknown or other
  modified_base (291)..(291): a, c, t, g, unknown or other
  modified_base (294)..(294): a, c, t, g, unknown or other
  modified_base (296)..(296): a, c, t, g, unknown or other
tcagcgatcgtatacacgaccggtgctcgatttagtagcatactgttgggtttgggggtgggtccaggaggcagaactctgggtgtctcaccatggcctggatccctctacttctcccctcctcactctctgcacaggctctgaggcctcctatgagctgacacagccagcctcggtgtccagtcgtccccaggacagacggccaagactcccctgctctgganatgcattgacctaaaagttntttgtcttttagacaanagacgcagcacgacctataatatatataanaananagtgagacgcctacgaggtactccgtagacgtcgtacttcgtcgtcggccctaccgacgctacgaacggaaaccaacgcgtaccgtaacggttacgaacgtaggttacgggtaggtacgtaccgaggacgaaggaacggtaacggacggtacgttaacgtaacttaacgttacgtacgtaactaacgtacgaacgggacgaacggtaaccggtaacggttaaacggtttacggttaacgtttaaggtaacggggttaacggttacggggttaccgggggtaaccggggaacggggtaaacccgggttaaacggggttacccggtaacccgggttaccggtaaccgggtacccggaacccggttaccccggttaaccgggtccccgtaccccggttcccccggttacccggtacccgttacccgtttccccgtttaaccccgtttaacccccg

SEQ ID NO: 421252 - DNA, 661 bp, Homo sapiens
  misc_feature: GZ8MTXP01ATXEW.51.37.D04.1.454.CMB.2.raw
  modified_base (255)..(255): a, c, t, g, unknown or other
  modified_base (264)..(264): a, c, t, g, unknown or other
  modified_base (365)..(365): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagcgtggtggaatcggtgggggagcttggtcaagccgtggacggtccctgagctctcctgtncacgtcctntggtactccaccttcgagtcggccttacttcatgagtctggactcccgcgaggccgtacggagggggacggctgcgaggtcggtcctacactattagtagngtaaacttaagtggggaaactaacccgtaactactttaccgacgtacaacgtactcgtaggaaacgggtacgggtacccttacttacctacctaacttcccgaacgaaccggggaacccaaaccggtaaccaaacggtaaccttactacgtacgttaactcgtacgaaactaaactacggaaactacgttaacgaaacggaacggaacccgaaagacccgttaccggtaccgtacgttaccgttcgttagtggtcggtaaggtagggtaggggacgtaacggttaacggtaacggg

SEQ ID NO: 421253 - DNA, 831 bp, Homo sapiens
  misc_feature: GZ8MTXP01B22FY.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcggtggggggagtcgttggtcaagccgtgggacggtccctggagtacctctcctgtcgcacgcctgtggactccaccttcagtcgctacttcatgagcgtggactcccgccgaggtccgtaccggagggggacggggctcggcgtagggttcgggtacctaccgaactatttaagttacggtacgtaaaccgttaaaggttcgggggaaaccgaaaccccttaacgttaaccgttttacccgtaaaccgggtaccgtaaacggttacccgtttcggttacgggttaacggggaaaccgggggttaccccctttaagttttccccctaccgttaacgttcccccggtaaaccgggaacgggggaaacccctaaaccggaccccgtaaaaggggtaacccctttaccggtaacccgttggttaaccttaccgtaacgaaacgtaaaacggttcgaaaaccgtaggttaaaccgaaacgggaacccggtaacccgggaaaaggtccccgggttaaaccgggtcccggtttaacgtttaccccggtttggttcggggtaacgggtaccggggttaaggggttacggggtagggggttaacgggtaacgggttaaccggttaacccggggg

SEQ ID NO: 421254 - DNA, 663 bp, Homo sapiens
  misc_feature: GZ8MTXP01BR9XG.51.37.D04.1.454.CMB.2.raw
  modified_base (546)..(546): a, c, t, g, unknown or other
  modified_base (626)..(626): a, c, t, g, unknown or other
  modified_base (648)..(648): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaagtcggtggggggagtcgttggtcaaggccgtgggacgggtccctgacgtaccttctcgtgtcgctacgcccttgtggtactccgaccttcgaggtcggtccttacttcattggagtcgtggactcccgcgaggcctaccggagggggacgggtctgcgtaggtcggtctacactattagttagtcgtaactaaggtcggggaaacaaaccctacttactttaccgacggactacgtaccgttcgagggaaacggacggggtcctaatttccctaccacgttcccaccggaaacgggaaccaaaccgggaaccaaagggtaacccttcaaccgttagttaacnccgtagaacctaaaagccgtaaacagttacgaaaggcgaacccggagaccgcggtcccggttattaccgttgttacgggnggcggtggtcggtaggggacgngttcccggtaagggg

SEQ ID NO: 421255 - DNA, 616 bp, Homo sapiens
  misc_feature: GZ8MTXP01AOAXW.51.37.D04.1.454.CMB.2.raw
  modified_base (376)..(376): a, c, t, g, unknown or other
  modified_base (445)..(445): a, c, t, g, unknown or other
  modified_base (507)..(507): a, c, t, g, unknown or other
  modified_base (515)..(515): a, c, t, g, unknown or other
  modified_base (574)..(574): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagcgtggtggaatcggtgggggagtcttggtcaagccgtgggacgggtccctgacgctctcctgtgcagcctcgtggacttccaccttcgaggtgacttactcatggagcgtaggactcccgcgaggcctaccggaagggggacgggctggacgaggttcgggtcctacgactattagttagngtaacgtaaagtgggaactaaacccatacttcacgctagactcgaggaacggacgggccttatccactntaccgaccgaacgggaccaacgtacccgaaagtaacctcattacgtactctagaactaaacngtaaaccngtaaccaaagggaacgaacggaaacgtaccgacgggtaccgttgttaaccgttgttggngtaccggtaagttgggaggggagtaacggttcggttaacggg

SEQ ID NO: 421256 - DNA, 608 bp, Homo sapiens
  misc_feature: GZ8MTXP01ANBAC.51.37.D04.1.454.CMB.2.raw
  modified_base (257)..(257): a, c, t, g, unknown or other
  modified_base (263)..(263): a, c, t, g, unknown or other
  modified_base (354)..(354): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcggtgggggagtcttggtcaagcctgggacggtccctgagactctcctgtgcncgcctntggtatcacttcagtgctacttcatgacgctggactcccgcaggcctaccgaggggaagggctgcgaggtgggtctcgaactagtattagngtaactaagtgggaaacaacctatacttcgacgctacgactcgtagagggacggccgtattcctccgaacttccgaccgacgggaaccaacggaaccaacggggaactcgtaacgtcggttaactccgtagaactaaaggtacaaacgtagttaccgaaaggaacgaaccgaacgaccgaaaccggtccgtacgttacgttcgttagggcgtgggtaagttggggtagggaagtaacggggcgttaaccggggg

SEQ ID NO: 421257 - DNA, 678 bp, Homo sapiens
  misc_feature: GZ8MTXP01EL95P.51.37.D04.1.454.CMB.2.raw
  modified_base (564)..(564): a, c, t, g, unknown or other
tcagcgatcgtatacacgaccggtgctcgatttagtagcatactgttgagctctgggagaagagccacagtcccagaattcccaggagtttccattcggtgatcagcactgaacacagaggacctcaccatggagtttgggatgagtcgttgggttttccttgttgctattatagaaggtgtccagtgtcaggtgcagcgtgggtggaatcggtgggggagtcgttggtacaaggtccgtgggacgggtccctggacgtactcctcctgtgcagcctgtggacttacctaccttcgagtcggtccttacttcgatgacggtcgtcggactccccggcgacgggtccgtaccgggagggggaacgggtctgcgtaggtcgggtccctacatattagttacgtacgtacgtaaggtgggaaaccgaaccctactactttacgacgacgtacgaccttcggagggtaaacgggtacgggtacccttaactttccgacctaccgttaccgacccgggaaggaaccccaacggtaccaaacgtaacctctacttagtactccggtaaanaacgtaaagtacgtaacgtaagtaacggaaacgacggaaaccgacgaccggtaccggtacgttcgttacgttgtaaggtggaaggtaggtggggttaggaacggttaacggtcg

SEQ ID NO: 421258 - DNA, 577 bp, Homo sapiens
  misc_feature: GZ8MTXP01EMCXR.51.37.D04.1.454.CMB.2.raw
  modified_base (260)..(260): a, c, t, g, unknown or other
  modified_base (561)..(561): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttggctgagcttgggttttcctgttgctattatagaaggtgtccagtgtcaggtgcagctggtgaatcgtgggggagtcttggtcaagccgtgggacggtccctgagtactctcctgtgcagctntggatcacttcagtgctacttcatgagctgactccgcaggctacgaggggaggctgcagtggtctcgactatagtagtgaacttaaagtggggaaactaaacccagtactttaccgacgctaacgtaccgtcgtaggaaggtaacgggtcctaatttccgaccctagttcccgacgaagggaaccaaacgcccaaaggaacttcgacttagtactcgtagaactaaagtcgaaaccgtagtaaccgaaaggaacctaccggaaagcccgaacggtcgttagttccttgagtgacgtgtggnggaatcggaacgtcgg

SEQ ID NO: 421259 - DNA, 686 bp, Homo sapiens
  misc_feature: GZ8MTXP01CCMJ1.51.37.D04.1.454.CMB.2.raw
  modified_base (192)..(192): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtncagctggtggaatcgtgggggagtcttggtcaaggcctgggagggttccctgacgacttctcctgtcgcacgcctcgtggattccaccttcagtcggctacttcatgagtctggactcccgccaggcctccggagggggaacggggtctggcagggtcggtacctcgactagttagtttagtcgaacttaaaggtcgggacaaaccctactacttaccgaaccgctacgtacctcgtaaggacgggaaacggggtcctaactttccgaccgtacgttcccgacccgaacggggaacctaaaccggaccccgtaaacgggtaaacctaccggtaacttacggtactccgtaacggaactaaacgtacgaaacgttacgtaacgaaacggaacggaacccggaaacgaccggacccgggtaccgttcgttaaccgttcgttacggtgggtacgtaagggtggtacggggaaggtaacggttaacggttaaccgggg

SEQ ID NO: 421260 - DNA, 619 bp, Homo sapiens
  misc_feature: GZ8MTXP01E3RKM.51.37.D04.1.454.CMB.2.raw
  modified_base (358)..(358): a, c, t, g, unknown or other
  modified_base (564)..(564): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcggtggggggaggtcttggtcaagccgtgggacgggtccctgagactctcctgtgcagcctctggatcacctcagtggctacttcatgagctggactcccgccaggctccggagggggagggctggctagggtggtctccactataagttagngaactaagtgggaacaaccatatcacgcacgtactcgtaggtacggaacgggccttaactttcacctatacccgtaccgaacgggaacccaaacgaccgaaacggactacctaattgtacttcagtaacaaatacgaaacctaggtaactaaagggaaccggaaaccgaaacggacccgttacgggcccgtttgttaccgtttcgngggtcggcggtaagggtgggtagggggaagtaaccggggttaacgttaacggggg

SEQ ID NO: 421261 - DNA, 773 bp, Homo sapiens
  misc_feature: GZ8MTXP01BSQQQ.51.37.D04.1.454.CMB.2.raw
  modified_base (719)..(719): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgcttattatagaaggtgtccagtgtcaggtgcagcgtgggtaggaatcggtgggggggagtcgtttgggtacaaggcccgtggggacgggtccctggacgtaccttctccgtggtcgcacgtccctcgtaggtacttcctaccttcgaggttcggtaccttaacctttcgagttcggaacgtccgttacgggacctcccccggaccgaacggggtccccgttacccgggaaggggggtaacgggggtccttgggaccgtagggttcggggtaccttaccgaacgtaagtttagtttagacgtaaacgttaaaggtgggggaaacctaaaccctacgttaactttccgaacgacgtaacgtaccttgagggaacgggacgggtcccttaagtttccccacctaagttcccgaaccggaaacgggaaacccaaaccgggtacccaaaacgggtaacccttacgtactaggttaactcgtacgaaacttaaagtcgaaactacggtaacaacggaacggtaccgaaagacccggttacggtccgttaagttaccgttcgnggtaacggcggtaagggttcggggagggacgtaacgggttaaccgttaacgggg

SEQ ID NO: 421262 - DNA, 588 bp, Homo sapiens
  misc_feature: GZ8MTXP01EKNMW.51.37.D04.1.454.CMB.2.raw
  modified_base (263)..(263): a, c, t, g, unknown or other
  modified_base (268)..(268): a, c, t, g, unknown or other
  modified_base (278)..(278): a, c, t, g, unknown or other
  modified_base (331)..(331): a, c, t, g, unknown or other
  modified_base (538)..(538): a, c, t, g, unknown or other
tcagcgatcgtatacacgaccggtgctcgatttagtagcatactgttgagctctgggagaagagccccagtcccagaattcccaggagtttccattcggtgatcagcactgaacacagagactcaccatggagtttgggctgagtcgttgggttttccttgttgctattatagaaggtgtccagtgtcaggtgcagcgtgggtaggaatcggtgggggagtcttggtcaagtccgtggacggtccctgacgctctcctgtgcngcctntgatcacttnagtgctacgtcatgagctggactccgcgaggcgtaccgaagggggacgggtcngcgtaggtgtcctagactatagttgcgtaactaagtgggaacgaaccaatgtacctaagctaagccttgacggaagggaaccgctaactttccactaatccgacgacggaacaaccgttaaccaaaggacttgaaacttggtaactctacgataaagttgaaactaagtccgaaaaggcgtaacccgaaagccgaagtccccggttnttaacccgtttgaggtgaacgtgtggggtagaggtccgttaacggtcggg

SEQ ID NO: 421263 - DNA, 747 bp, Homo sapiens
  misc_feature: GZ8MTXP01DF6J6.51.37.D04.1.454.CMB.2.raw
  modified_base (271)..(271): a, c, t, g, unknown or other
  modified_base (282)..(282): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggtagtttgggctgagtcgttgggttttccttgttgctattatagaaggtgtccagtgtcaggtgcagcgtgggtggaatcggtggggggagtcgttgggtccaagtccgtaggggacggtccctgacgtactctcctgtncagcctgtgtntccactcaggtcgtactacttcagtgagtccgtgactccccgacgaggtcctaccggggagggggtaacgggggctacggccgtagggttcgggtaccttacctaggtactttagttaggtacggtaacttaaagggtgggaaaccctaaacctaacgtacgttaccgtaacggacgtaaacgtaccgtaggtagggaaacgggtacgggtacccttactttacccgtaccctaacttccccgaaaccggaaacggggtaacccaaacccgtaaccccgaaaaaacggggttcccctttaaacgggaaccgtttacttaaccgttccgtaaagtaaaccctaaaaagtaccgtaaaccgtacggttaaacgaacggaacgtaaacccggacgtaccggttaccgtacgttcgttaccgttgcggtggacggttggcgggtaggacggtaaggttcccggtaaggg

SEQ ID NO: 421264 - DNA, 663 bp, Homo sapiens
  misc_feature: GZ8MTXP01BW77A.51.37.D04.1.454.CMB.2.raw
  modified_base (251)..(251): a, c, t, g, unknown or other
  modified_base (318)..(318): a, c, t, g, unknown or other
  modified_base (429)..(429): a, c, t, g, unknown or other
tcagcgatcgtatacacgaccggtgctcgatttagtagcatactgttgggtttgggggtgggtccaggaggcagaactctgggtgtctcaccatggcctggatccctctacttcctccccctcctcactctctgcacaggctctgaggcctcctatgagctgacacagccagcctcggtgtcagtcgtccccaggacagacggccaagactcccctgctcgtaggagatgactattacgaccaaaacgttntttgttactttttagaaccaaacagaacgccaggccagacccctaataaataattatataataaganagtagagacggccctagagggtactcccgtagacgcgtattctctcggtccctccaggcctacgacgggtaaaccaaacgcgacccgtaacgttaggaacgtagttaaggngggtaacgtccgaaggacgaaggaaagacggaaggtctacggtataacgttaacgtgtaactaatacgaacgacgaaacgtaaccgaacgtaagttaggttaacgttaagtagggtacgtttaggccgggtacgggaaacggaaccgtaagggttcggtaaacccgttcgtacggtcgaccgccgacgtccgtcccggtaaccccgtggcccttacctcgttcccgtaaccccc

SEQ ID NO: 421265 - DNA, 715 bp, Homo sapiens
  misc_feature: GZ8MTXP01A8XYC.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagcgtggtggaatcggtgggggagtcttggtcaagccgtggacggtcctgagactctctgtgcagcctcgtaggtactccaccttcgaggtcgtctacttcatggacgtcgtaggactccccgacgaggccgtaccggaagggggacggggtctggaccgtgggtcggtctacctactagttagttagtcgaaaccgttaaggtcggggacctaaaacccgtactacgttacctaacgctaaagtacccgtttgagggaaacgggaaccgggtccttaaagttccccgtactacgttccccgaaccggaacgggtaacccaaaccgggaccctaaaaggggtaccctcggaacttagtactccgtagaaacctaaagttacaaacgtacgtaaccgaagggaacccgaacggaaacggtaacccgccgggtaccgttaacgggttccctttcgggacggtaacgggtacggttaacgggtttaggggagggggttaacgaacggggttaaacggttccgggg

SEQ ID NO: 421266 - DNA, 644 bp, Homo sapiens
  misc_feature: GZ8MTXP01A80QB.51.37.D04.1.454.CMB.2.raw
  modified_base (247)..(247): a, c, t, g, unknown or other
  modified_base (338)..(338): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcctcactctctgcacaggctctgaggcctcctatgagctgacacagccagcctcggtgtcagtcgtccccaggacagacggccaagactcccctgctctggatatgcattcgaacctaaaacgttntttcgtctttttacggaaccaacagaacgccaggccagccctaataactaattataataataaagacagtgagacgcctgaggactcccgngacgcgtattcacgtcggccctaccgagtactacgaacggggaaaccaaacgcgaccctacggttacgacgtaagttaggtacggacgtaccgaggtacgaaagaacgacggacggacttaggtaacttaattacgtcgtaactaacgtacgacggtacgaacgtaacgaacgtaggtacggttacttagtacggtagtacgtacgggacggaaggggtaactaaacgggttcgtaacccgttcgtacgggtacacgttccgaacgcgtacccgcccgtcgtaccttcgtccgttccgttcccccg

SEQ ID NO: 421267 - DNA, 823 bp, Homo sapiens
  misc_feature: GZ8MTXP01A2ADW.51.37.D04.1.454.CMB.2.raw
  modified_base (276)..(276): a, c, t, g, unknown or other
  modified_base (759)..(759): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagcgtggtggaatcggtgggggagtcgttggtcaagccgtagggacgggtccctggacgaccttctcctggtgccacgtcctntggtacttcctaccgtttcaggttcgtacttactctagtggacgtcgttaggacctccccgaccgaagggtccctacgggaagggggaacgggtctagacgtagggttcggtacctaccgacgtattagttaggtcgtaaacgttaagggtccgggaaacaaaccctaagttactttaccgaacggactaacgtcccttagtagggaaacggggtaaccgggtcccttaaagtttccccgaccctacgtttaccccgaacgggaaacccggggaaacccttaaacccgaaccgaaaacgtacccgttacctaacgtttacgttaaacgttccctaacggaaactttaaaagggtaccggaaaaaccttccggtttaaaacggaaaaccggaaccgggaacccgttaaaaacgggccccggttaacccgggggtttacttacggtttaacccgtttcgggttacggggaagggtttaaccgggnggggttttaacccgggggacggggggaaagtaaccccggggttaaaaccgggtttaaccggggg

SEQ ID NO: 421268 - DNA, 784 bp, Homo sapiens
  misc_feature: GZ8MTXP01CM40D.51.37.D04.1.454.CMB.2.raw
  modified_base (749)..(749): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagtcgttgggttttccttgttgcttattatagaaggtgtccagtgtcaggtgcagtcgtggtaggaagtcggtggggggagtcgttggtacaagccgtgggacggtccctgagtacctctccgtgtcgcacgtcctcgtggtactccaccttcaggtcgtaccttacttacagttggagtcgttacggaccttcccggaccgaggtccgtaccggaaggggggtaacggggctggccgtaggttcgggtactaccgacgtatttagttagtacgtaaaccgttaagtgggggaaactaaacccgtacttacgttacctaacggactaacgtaccgttcggaaggtaacggggacgggtacccttaatttcccgtaacccgtagttaccccggtaccgggaaaaccggggaacccaaacccggtaaccccgtaaaggggttaacccttaaccccgttaagggtttacgttaaccttaccggtaacgtaaactaaaacgttacgaaaccgtacggttaaaccgaaggaacccggtaacggaaacggtaaccgttcgggttaccggtacccgtttagttcgttcggtaagggtacgtggggtttacggnggggttaacggtaacgggttaacggttaaccgggg

SEQ ID NO: 421269 - DNA, 742 bp, Homo sapiens
  misc_feature: GZ8MTXP01DYLXD.51.37.D04.1.454.CMB.2.raw
  modified_base (346)..(346): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttggctgagcttgggttttcctgttgctattatagaaggtgtccagtgtcaggtgcagctggtgaatcgtgggggagcttggtcaagccgtgggacggtccctgacgactctcctgtgcagcctgtgactcaccttcagtgctacttcatgagctggactccgcagctaccgagggacggctgctaggtcggtctaccactattagttagngtaactaaagtcggggaaactaaacccacgtatttaccgacgctaacgtacttaccgtaggaacgggtaaacgggccccttaaagttccccgtaccctaacgttaccccgtaccggaaacggggaacccctaaaaccggtacccggaaaaacggttaaacccgttacccgtaaacttacgggtttaactaccccgttaaggaaaccttaaaaagggttaccaaaaccgttaacggttaaacccgaaagggaaacggtaacccccggaaaagggacccgttaaacccggggttcccggttaaagtttccccgtttaacggttcgggttaaggaccgggttaacggggtttggggacgggggttaagaaaccggggttaaccccggttaaaacggggg

SEQ ID NO: 421270 - DNA, 657 bp, Homo sapiens
  misc_feature: GZ8MTXP01ANQF1.51.37.D04.1.454.CMB.2.raw
  modified_base (245)..(245): a, c, t, g, unknown or other
  modified_base (260)..(260): a, c, t, g, unknown or other
  modified_base (600)..(600): a, c, t, g, unknown or other
  modified_base (620)..(620): a, c, t, g, unknown or other
tcagcgatcgtatacacgaccggtgctcgatttagtagcatactgttgagctctgggagaagagccccagtcccagaattcccaggagtttccattcggtgatcagcactgaacacagagactcaccatggagtttgggctgagcgttgggttttcctgttgctattatagaagtgtccagtgtcaggtgcagtcgtggtggaagtcgtggggggagtcgttggtcaagccgtgggacggtcccngacgctctcctagtncagtcctgtcgtatccacttcaggtcgcttactcagtggacgtcgttacggacgtccccgacgtacgggccgttcccgggaaagggggtacgggcttacggaccgttaggtcgggttacctaccgtactaagtttagtaacggttgaaaaccgtaagggtcggggaaacaccctaatactttaccgacgacgacgttactcgtaggaacggtaaccgggcctaatttccccgacagttcccgaaccggaaggaaccaacccgacgaaacggtaacctctaccgtagtacctcgacgtaagaaagtcaaggtactacgtaaaggccgaacccgaaaggacnccgtcgtaacttcgtttcgnggaacgtggtggtggagggacgtaacggttcgccggg

SEQ ID NO: 421271 - DNA, 556 bp, Homo sapiens
  misc_feature: GZ8MTXP02GXXPF.51.37.D04.1.454.CMB.2.raw
  modified_base (250)..(250): a, c, t, g, unknown or other
  modified_base (256)..(256): a, c, t, g, unknown or other
  modified_base (263)..(263): a, c, t, g, unknown or other
  modified_base (272)..(272): a, c, t, g, unknown or other
  modified_base (275)..(275): a, c, t, g, unknown or other
  modified_base (277)..(278): a, c, t, g, unknown or other
  modified_base (280)..(280): a, c, t, g, unknown or other
  modified_base (284)..(284): a, c, t, g, unknown or other
  modified_base (287)..(287): a, c, t, g, unknown or other
  modified_base (299)..(299): a, c, t, g, unknown or other
  modified_base (303)..(303): a, c, t, g, unknown or other
  modified_base (555)..(556): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtggtttcgtgtaggctatatagagtgtccagtgtcaggtgcagctggtggaatctgggggaggcttggtcaagcctggagggtccctgagctctcctgtgcanctctgntctctcngtgctctcntgngnngncgcngcncgagggaggcgngcgngtggtctcacatatagtgatagtggacgaacactacttactacgacacgactacgtaggaggaacgggaccgtacgttacctacctactacgtaccgacggaaccgaaaccgaaccgaaaccgtaacctacctacgttacgttactacgtacgtaactaaacgtaacgtaaacgtaacgtaacgtaaacggtaaacggaaccggaaaccggaaaccggtaccgggtacccggttacgttaccgtttacgttnn

SEQ ID NO: 421272 - DNA, 509 bp, Homo sapiens
  misc_feature: GZ8MTXP02F4I4H.51.37.D04.1.454.CMB.2.raw
  modified_base (355)..(355): a, c, t, g, unknown or other
  modified_base (394)..(394): a, c, t, g, unknown or other
  modified_base (400)..(400): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtgggtttcctgttgctattatagaggtgtccagtgtcaggtgcagctggtggaatcgtgggggagcttggtcaagcctggagggtccctgagactctcctgtgcagcctctggattcaccttcagtggctacttcatgagctggatccgccaggctccgaggggaggggctgcagtgggtctcgacatattagtgactaagtgggganaaccacattcacgcagactctgtagaagggcccgattcnccatcnccagggacaacgccaagaactcactgtatctgacaatagaacagtactaagacgacgaacgacgacggacgtcgtacgtctgtggcgagtggtggaggacggacgtacg

SEQ ID NO: 421273 - DNA, 607 bp, Homo sapiens
  misc_feature: GZ8MTXP02JBUE8.51.37.D04.1.454.CMB.2.raw
  modified_base (240)..(240): a, c, t, g, unknown or other
  modified_base (253)..(253): a, c, t, g, unknown or other
  modified_base (281)..(281): a, c, t, g, unknown or other
  modified_base (286)..(286): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcctcactctctgcacaggctctgaggcctcctatgagctgacacagccagcctcggtgtcagtgtccccaggacagacggccaagatcccctgctctggagatgcattgccaaaacgtnttgtctttgacanagagcagcacgcctataatatatataanaaganagtgagacgcctagaggactccgtgagcgtacttctcgtcggtccctccagctacgacggaaccaacgacgaccgtaacggttacgaacgtaagttaggtacgggacgtaccgaggacgaaggaaaggacggagactagaacttaattacgtagtacaaatcgaagacaagaacgacgtaaggttacgttaacttaggtaggtagttacgttacggggacgggtaacggaaccgtaagggtcggaaccgttacgtacggtaccgacgacccgaacggccgtaccggtccccgtcggtacctaccgttccgtccgttccccg

SEQ ID NO: 421274 - DNA, 513 bp, Homo sapiens
  misc_feature: GZ8MTXP02IC2XG.51.37.D04.1.454.CMB.2.raw
  modified_base (401)..(401): a, c, t, g, unknown or other
  modified_base (440)..(440): a, c, t, g, unknown or other
  modified_base (443)..(443): a, c, t, g, unknown or other
  modified_base (445)..(445): a, c, t, g, unknown or other
  modified_base (447)..(447): a, c, t, g, unknown or other
  modified_base (452)..(452): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtggtttcctgtgctattatagaggtgtccagtgtcaggtgcagctggtggaatcgtgggggagcttggtcaagcctggagggtccctgagactctcctgtgcagcctctggattcaccttcagtggctacttcatgagctggatcccgcaggctccgaggggaggggctgcaggtggtctcacatatagtgactaatgggggaataaaccactatttccaacgcagacctgtgtgaagggcccattctccatcnccagggacaaacgcctaaagaacttcactgtatctaganaanananagtanaagacgacgacgacgacgacgtcgtcttcgtgtgcgaggtggtaggaggacggacgtacgg

SEQ ID NO: 421275 - DNA, 574 bp, Homo sapiens
  misc_feature: GZ8MTXP02HHTZM.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagcctctggattcaccttcagtgctacttcatgagctggatccgcaggctccgaggggagggctgcagtggtctcgacatattagtgacttaagtggggaacaaccatattctacgcaaggacctcgtaggaagaaacgggggccctaatttccctccccaattcccgtacccgaacgggggaaccaaaccgggacccaaaaggaaccttcaaccgttgtaactcctagacaaaatcgaaactagtactaaagacgaccgaaagaccgaacggccgtacgtacttcgtgtgcgtagtcggtagggacgaggacgtacggg

SEQ ID NO: 421276 - DNA, 528 bp, Homo sapiens
  misc_feature: GZ8MTXP02J048Z.51.37.D04.1.454.CMB.2.raw
  modified_base (289)..(289): a, c, t, g, unknown or other
  modified_base (447)..(447): a, c, t, g, unknown or other
  modified_base (493)..(493): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatctgggggaggcttggtcaagcctggagggtccctgagactctcctgtgcagcctctggattcaccttcagtggctacttcatganctggatccgccaggccccagggaggggcgtgcgagtgggtcgtcaccatattagtgctaagtgggaggaaccactatctacgcagactctgagaaggggccgattctcactctccgacgggacaaccgaccaagaactacactgtatctgacaaatanacagactacgaagacgacgacgacgaccgtacgtacgtcctgtggngtacggtaggtagggaggacggacggtacggtacg

SEQ ID NO: 421277 - DNA, 529 bp, Homo sapiens
  misc_feature: GZ8MTXP02I4J6V.51.37.D04.1.454.CMB.2.raw
  modified_base (343)..(343): a, c, t, g, unknown or other
  modified_base (358)..(358): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctggagactctcctgtgcagcctctggattcaccttcagtgctactcatgagctggatccgccaggctccgaggggagggctgcaggtgggtctccacatatagtnacttaagtggggganaaaccatattcacgcagactcgtagagaagggccgattcctccatcctaccgagggacaaacgccaaagaactcactgtatctagacaaatgaacagtacaaagacgaccgaaagacaacggccgttagtaccttcgtgtggcgaggttggagggacgaggtactacgggg

SEQ ID NO: 421278 - DNA, 515 bp, Homo sapiens
  misc_feature: GZ8MTXP02G81ZD.51.37.D04.1.454.CMB.2.raw
  modified_base (253)..(253): a, c, t, g, unknown or other
  modified_base (266)..(266): a, c, t, g, unknown or other
  modified_base (281)..(281): a, c, t, g, unknown or other
  modified_base (378)..(378): a, c, t, g, unknown or other
  modified_base (396)..(396): a, c, t, g, unknown or other
  modified_base (426)..(426): a, c, t, g, unknown or other
  modified_base (434)..(434): a, c, t, g, unknown or other
  modified_base (437)..(437): a, c, t, g, unknown or other
  modified_base (439)..(439): a, c, t, g, unknown or other
  modified_base (442)..(442): a, c, t, g, unknown or other
  modified_base (444)..(444): a, c, t, g, unknown or other
  modified_base (446)..(446): a, c, t, g, unknown or other
  modified_base (448)..(448): a, c, t, g, unknown or other
  modified_base (450)..(450): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtggtttctgtgctatatagagtgtccagtgtcaggtgcagctggtggaatcgtgggggagcttggtcaagcctgggagggtccctgagactctcctgtgcagcctntggattcaccttnagtgctactcatganctggatccgcaggctcgaggggagggctgcaggtggtctcactattattaggtgacttaaagtgggggaacaaccactatttccacggcagacctgngagaacggggcctattcnccattcaccagggaacacgcctaaagactnactgtacncananaanananananagacgacgacgacgacgacgtacgtacgtcgtgtgtcgtaggtggtaggaggacggacggtacgg

SEQ ID NO: 421279 - DNA, 580 bp, Homo sapiens
  misc_feature: GZ8MTXP02IFAEQ.51.37.D04.1.454.CMB.2.raw
  modified_base (241)..(241): a, c, t, g, unknown or other
  modified_base (258)..(258): a, c, t, g, unknown or other
  modified_base (288)..(288): a, c, t, g, unknown or other
  modified_base (293)..(293): a, c, t, g, unknown or other
  modified_base (316)..(316): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcctcactctctgcacaggctctgaggcctcctatgagctgacacagccagcctcggtgtcagtgtccccaggacagacggccaagatcccctgctctggagatgcattgaccaaaagttntttgtcttttagacaanagagcagcacgacctataataatatataanaaganagtgagacgcctgaggactccgngagcgtattctcgtcgccctaccgacgctacgaacggaaccaacgcgaccgtacgttagacgtagttaggtggacgtacgaggagaagaagacgagctagtaactattactgtaactaaatacagacgaagacgacgtaggttaggttaacttagtagggtacgttaggtcgggacgggaacggacgaaggtcgaccgtacgtacggtaccgacgaccgacggccgtacccgccccgtcgtacctaccgttccgtaccgtcccc

SEQ ID NO: 421280 - DNA, 599 bp, Homo sapiens
  misc_feature: GZ8MTXP02H7BBQ.51.37.D04.1.454.CMB.2.raw
  modified_base (261)..(261): a, c, t, g, unknown or other
  modified_base (344)..(344): a, c, t, g, unknown or other
  modified_base (560)..(560): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagccctntggattcaccttcagtggctacttcatgagctggatcccgcaggctccgaggggagggctgcaggtggtctcgacatattagngacttaaagtgggggaaacaaacccacgtaatttccgtaaccgacaagtaccttcgtaggtagggaaacggggtcccgtaatttccctacccaatcccgtacccgaggggaaccaaaccggccaaacgaacctcaacctgtaactctagacaaaagtgaaacagtactaaaaggacgacccggaaagaccgaaccgggtccgttagtaccctttgngtcgcggtaaggtggtaggggacggtaggaacgtacggg

SEQ ID NO: 421281 - DNA, 554 bp, Homo sapiens
  misc_feature: GZ8MTXP02JUZXV.51.37.D04.1.454.CMB.2.raw
  modified_base (242)..(242): a, c, t, g, unknown or other
  modified_base (362)..(362): a, c, t, g, unknown or other
  modified_base (379)..(379): a, c, t, g, unknown or other
  modified_base (411)..(411): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcctcactctctgcacaggctctgaggcctcctatgagctgacacagccagcctcggtgtcagtgtccccaggacagacggccaagactcccctgctctggagatgcattgaccaaaacgtntttgctttttggtaccaacagaagccaggccaggcccctataataattatatataaagacagtgagaggccctgagggactccctgagcgattctctggccctccagctcgaggacaacngccagttgacgattagnggagtccaggcagaagacgagctgactatacngtacaaatcaagcagacgacaggtgtacttagtgggagttagttcgggagggaagggaccgaaagggtcgaaccggtccgtaaggtccacggaccccgaaggccgtcgcccccgtcggtcccaccgttcctccggttcccccg

SEQ ID NO: 421282 - DNA, 526 bp, Homo sapiens
  misc_feature: GZ8MTXP02FYJ3H.51.37.D04.1.454.CMB.2.raw
  modified_base (240)..(240): a, c, t, g, unknown or other
  modified_base (314)..(314): a, c, t, g, unknown or other
  modified_base (357)..(357): a, c, t, g, unknown or other
  modified_base (375)..(375): a, c, t, g, unknown or other
tcagcgatcgtatacacgaccggtgctcgatttagtagcatactgttgggtttggggtgggtccaggaggcagaactctgggtgtctcaccatggcctggatccctctacttctccccctcctcactctctgcacaggctctgaggcctcctatgagctgacacagccagcctcggtgtcagtgtccccaggacagacggccaagactcccctgctctggagatgcattgaccaaaacgntttgctttttggtaccaacagaagccaggccaggcccctataataattatatataaagacagtgagaggccctnagggatccctgagcgattctctggcctccagctcaggacaacngccacgttgacgattagnggagtccaggcagaagacgagctgactattactgtcaaatcagcagacgacagtaggtacttagtggaagtattcgggacggagggtaaccgaaagggtgaccgtccgtaggtcacgcccaaggctcgcccctcggtcactctcgttcccc

SEQ ID NO: 421283 - DNA, 508 bp, Homo sapiens
  misc_feature: GZ8MTXP02F3JKC.51.37.D04.1.454.CMB.2.raw
  modified_base (289)..(289): a, c, t, g, unknown or other
  modified_base (339)..(339): a, c, t, g, unknown or other
  modified_base (353)..(353): a, c, t, g, unknown or other
  modified_base (360)..(360): a, c, t, g, unknown or other
  modified_base (368)..(368): a, c, t, g, unknown or other
  modified_base (374)..(374): a, c, t, g, unknown or other
  modified_base (387)..(387): a, c, t, g, unknown or other
  modified_base (420)..(420): a, c, t, g, unknown or other
  modified_base (495)..(495): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagctctcctgtgcagcctctggattcaccttcagtggctacttcatganctggatccgcaggctcgagggagggctgcagtggtctccgacatattagngcttaagtgggganaacccanattcacgnagactntgagaggcattcncatctcgaggacaacgccaaagactcactgtanctagacaaatgaacagtacaaagcgaccgaaagaccacggccgtagttacctcgtagtgcgtagtggtagggganacgggactacggg

SEQ ID NO: 421284 - DNA, 686 bp, Homo sapiens
  misc_feature: GZ8MTXP02G6U9P.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagccgtgggacgggtccctgagactctcctgtcgcagcctctggattcaccttcagtgctacttcatgagctggactccgccaggcctccggaggggaggggctggcgaggtcgggtctaccgactattagttaggtcgacgttaaaggtcgggggaaacaaaccctactactttaccgacgcaagtaccttcgtaggaacggaacggggccctagtttccctaccgtacttcccgtacccgacggggaacccaaaccggaccctaaaacggtacccttaccaaccgttaggtaactccgttagaaccctaaaagtacgaaacctacggttaacaaacgggaaccggaacccggaaacggacccggtaacccggggttccgtttacgttaccccgtttcgttagggccggtacggtaacggggttcggggtagggggaacgtacggggtaacgttaaccggggg

SEQ ID NO: 421285 - DNA, 702 bp, Homo sapiens
  misc_feature: GZ8MTXP02FOK4H.51.37.D04.1.454.CMB.2.raw
  modified_base (237)..(237): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaaggtgtccagtgtcaggtgcagctggtggaatctgggggagcttggtcaagcctgggagggtcccngacgtctcctcgtgcgcgacgtcctcgaggtctcctacctgaggtcggtaccttactacagtggacgtcgtaggtacctcccgaccgaggtccctaccgggaagggggacgggcgtcgacgtaggggtcggtcctaccgactatttaagttaggtcgtaacgttaagggcgggggaaaccaaccctaattactttaccgaccgacgaaacgtacttcgtaggaacgggaaccggggaccttacttcccacctaacttcccacgggaaacgggaaccgaaaccgaccgaaaacggtaacctacctacgttagtactaccgtaaacgaaacgtaaacgtaacgaaacgtaacgtaacgaaacgaaccggaacggaaacgaaccggaccggtacgttacgttaccgttcggtacggtaacggtacggtacgggtacggggagggtaacgggacggtaacggtaacggg

SEQ ID NO: 421286 - DNA, 508 bp, Homo sapiens
  misc_feature: GZ8MTXP02GYLGF.51.37.D04.1.454.CMB.2.raw
  modified_base (334)..(334): a, c, t, g, unknown or other
  modified_base (347)..(347): a, c, t, g, unknown or other
  modified_base (353)..(353): a, c, t, g, unknown or other
  modified_base (384)..(384): a, c, t, g, unknown or other
  modified_base (411)..(411): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccctgagactctcctgtgcagcctctggattcaccttcagtgctactcatgagctggatccgcaggctcgagggagggctgcagtggtctcacatatagngactaatgggganaaccanattcaacgcagactctgtgaagggccattcnccatctccaggacaacgccaaagactnactgtatctgacaaatgaaacagtacaaagacgacccgaaagaccacgggccgtgtaaccttcgtagtgcgagttggagggagacggacttacgggg

SEQ ID NO: 421287 - DNA, 771 bp, Homo sapiens
  misc_feature: GZ8MTXP02H9UOY.51.37.D04.1.454.CMB.2.raw
  modified_base (332)..(332): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcgaggtgcagtcgtgggtaggtaatcggggtagggggacgtcggttggtacgaacgtccggtaggggtaccggtccgtaggacgtcttcctccgtggtcgacgccgtcccttgtaggtcttcctacccttgaggtcgtacttacctntagtgacgtcgtggtaccgccccggacgacggtcccgtaccggggaagggggacgggtcgtcggacgtacggggtcggttcaccccgaataagtttaagttggtacgtaacgttaaagggtcggggaaactaaacccacttaacgttaccgtaccggacaaacgttcccttgtagggtaacggggtaaccgggtccctattttaccccctacgtaccgttacccgaaccggggaacgaaacccgaaacccgaaccgtaaacgtacttaccgtacgttacgttactacgaacgtaaacgtaaagaaccgtaacgtaacgtaaaccgaaaggacccggaaaacggaaaccgtaccggtaccggttaccgtttacgtcgtttacggacgggtaacggtaggtacggggttaggggacgggaaacggtacgttaaccgggtgg

SEQ ID NO: 421288 - DNA, 540 bp, Homo sapiens
  misc_feature: GZ8MTXP02I39MF.51.37.D04.1.454.CMB.2.raw
  modified_base (292)..(292): a, c, t, g, unknown or other
  modified_base (366)..(366): a, c, t, g, unknown or other
  modified_base (409)..(409): a, c, t, g, unknown or other
  modified_base (415)..(415): a, c, t, g, unknown or other
  modified_base (461)..(461): a, c, t, g, unknown or other
  modified_base (466)..(466): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagccgtgggacgggtccctgagactctcctgtgcagcctctggattcaccttcagtggctacttcatganctggactccgccaggctccgaaggggagggctggcaggtgggtctcgacatattagtgacttaaagtggggaanaaacccatacttcaacgcagactcgtgtacgaagggccattcnccatcnccgaagggacaaacgcctaaagaacctcactgtatctagaacaaanagaanagtacgaagacgacgaacgacgacgacgtacgtactcgtgtcgcgacggtacggtaggacggacggacgtacgg

SEQ ID NO: 421289 - DNA, 596 bp, Homo sapiens
  misc_feature: GZ8MTXP02IKP3M.51.37.D04.1.454.CMB.2.raw
  modified_base (353)..(353): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctgggtggaatcgtgggggagcttggtcaagccgtgggacgggtccctgagactctcctgtgcagcctctggattcaccttcagtgctacttcatgagctggactcccgcaggcctccgaggggagggctggcgaggtcggtctaccactatattagngactaagtggggaacaaaccactattccgacgcacgactcgaggaagaacgggcctattctaccattccacgagggacaaacgaccaaagaacctcacttgtaactcgtagactaaaagtacgaaacagtaactaaaacgacgaaccggaaaagaccgaaaccgggtcccgttagttaacctttcgtaggtaacggacggtaaggttcggtagggggacgtaacggggtaacgttaaccgggg

SEQ ID NO: 421290 - DNA, 491 bp, Homo sapiens
  misc_feature: GZ8MTXP02I13SY.51.37.D04.1.454.CMB.2.raw
  modified_base (255)..(255): a, c, t, g, unknown or other
  modified_base (348)..(348): a, c, t, g, unknown or other
  modified_base (368)..(368): a, c, t, g, unknown or other
  modified_base (384)..(384): a, c, t, g, unknown or other
  modified_base (386)..(386): a, c, t, g, unknown or other
  modified_base (403)..(403): a, c, t, g, unknown or other
  modified_base (410)..(410): a, c, t, g, unknown or other
  modified_base (413)..(413): a, c, t, g, unknown or other
  modified_base (422)..(422): a, c, t, g, unknown or other
  modified_base (424)..(424): a, c, t, g, unknown or other
  modified_base (426)..(426): a, c, t, g, unknown or other
  modified_base (431)..(431): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtggtttcgtgtagctatatagagtgtccagtgtcaggtgcagctggtggaatcgtgggggagcttggtcaagcctgggaggtccctgagactctcctgtgcagccctntggattcaccttcagtggctacttcatgagctggatccgccaggctccgagggagggctgcagtggtctcacatattagtgactaatgggganaacacatttcacgcaagctntgagagggccattccncntcacgagacacgacaanactcatntanctagacaanananagtanagacgacgacgacgacgcgtacgtacttcgtgtgcgaggtggtaggaggacggacgtacg

SEQ ID NO: 421291 - DNA, 526 bp, Homo sapiens
  misc_feature: GZ8MTXP02I5LKW.51.37.D04.1.454.CMB.2.raw
  modified_base (342)..(342): a, c, t, g, unknown or other
  modified_base (349)..(349): a, c, t, g, unknown or other
  modified_base (354)..(354): a, c, t, g, unknown or other
  modified_base (360)..(360): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggacgggtccccgagactctcctgtgcagcctctggattcaccttcagtgctactcatgagctggactccgcaggctccgaggggagggctgcagtggtctcaccatattagngctaagnggganaaccanattccacgcagactcgtgtagaacgggctattcctaccatcctaccgagggaccaacgaccaaagacctcactgtactctagacaaatcgaacagtacaagacgaccgaagaccgacggcgtagtacgtctggtgcgtagtggtagggagacggtacgtaggacgg

SEQ ID NO: 421292 - DNA, 603 bp, Homo sapiens
  misc_feature: GZ8MTXP02GK14J.51.37.D04.1.454.CMB.2.raw
  modified_base (197)..(197): a, c, t, g, unknown or other
  modified_base (205)..(205): a, c, t, g, unknown or other
  modified_base (244)..(244): a, c, t, g, unknown or other
  modified_base (254)..(254): a, c, t, g, unknown or other
  modified_base (311)..(311): a, c, t, g, unknown or other
tcagcgatcgtatacacgaccggtgctcgatttagtagcatactgttgagctctgggagaagagcccagtcccagaattaccaggagtttccattcggtgatcagcactgaacacagaggactcaccatggagtttgggctgagcgtggtttcgtgtagctatatagagtgtcagtgtcaggtgcagctgtggaatntgggaggngttgtcaagccgtggaggtccgtgagactctcctgtgcncgctcgtgtntctactctgtgtctactctatgagcgtgctccgcgacgcgtcgagggaggcgtgcgngtggtcgtcactatattagtgtacgtaagtaggacgaaactaactacttactacgacgacgtactacgtagaaggaacggacgtacgttactacctactacgtaccgaacggaacgaaaccgaaccgaaacgaaacgtactactacgtacgtactacgtaactaaagtaacgaacgaacgtaacgtaaacgaacgaaccgaaacgaaaccgaaccggtaccggttacgttaccgttacgttcgtaacgtacggtacggtacggtagggtaacggtaacggtaacggtaacgg

SEQ ID NO: 421293 - DNA, 734 bp, Homo sapiens
  misc_feature: GZ8MTXP02IIXVL.51.37.D04.1.454.CMB.2.raw
  modified_base (243)..(243): a, c, t, g, unknown or other
  modified_base (258)..(258): a, c, t, g, unknown or other
  modified_base (263)..(263): a, c, t, g, unknown or other
  modified_base (289)..(289): a, c, t, g, unknown or other
  modified_base (294)..(294): a, c, t, g, unknown or other
tcagcgatcgtatacacgaccggtgctcgatttagtagcatactgttgggtttgggggtgggtccaggaggcagaactctgggtgtctcaccatggcctggatccctctacttcctccccctcctcactctctgcacaggctctgaggcctcctatgagctgacacagccagcctcggtgtcagtcgtcccaggacagacggccaagactcccctgctctggagatgcattgaccaaaagttnttgtctttagacaanagacncagcacgacctataataatatataanaaganagtagagacgcctagaggactccgtagagcgtacttcgtcgtcgccctaccgacgcgtacgaacgggaaccaaacgcgaccgtaacgttacgaaacgttagttacggtacggtacgtaccgaagggacgaaaggaaacggaacggtaacggtacgtacgtaaacttaacgttaaccgtagtaactaaacgtacgaaacggacgaaacggaaccgtaacgtaaggttacggttaaacgtttaaggtagggtaaggtttaacgggttaccgggggaacggggtaaaccgggtaaaccggtaaacggggttaccggtaaacccggtttaaccggttacgggtaacccgacccgggaacccggtaaaccggtccccggttacccccggtacccccggttaccgggtacccctacccgtttccccgtttaccccgttaccccccg

SEQ ID NO: 421294 - DNA, 537 bp, Homo sapiens
  misc_feature: GZ8MTXP02GTEF1.51.37.D04.1.454.CMB.2.raw
  modified_base (262)..(262): a, c, t, g, unknown or other
  modified_base (346)..(346): a, c, t, g, unknown or other
  modified_base (360)..(360): a, c, t, g, unknown or other
  modified_base (400)..(400): a, c, t, g, unknown or other
  modified_base (449)..(449): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggaggcttggtcaagcctgggagggtccctgagactctcctgtgcagcctcnggattcaccttcagtggctacttcatgagctggactccgccaggcctccgaggggacgggctgcaggtggtctcacatattagngactaagtgggganaaccacattcacgcagactcgtagtgaacgggccattccncccatcctaccgagggacaaacggccaaagaacctcactgtatccgtanaacaaatcgaacgagtacgaaagacgaccgaaagacgaccggtccgttcgtactcgtgcgacgtaggtggagggagacggacgtacgg

SEQ ID NO: 421295 - DNA, 544 bp, Homo sapiens
  misc_feature: GZ8MTXP02G730N.51.37.D04.1.454.CMB.2.raw
  modified_base (328)..(328): a, c, t, g, unknown or other
  modified_base (354)..(354): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagcctctggattcaccttcagtggctacttcatgagctggatccgcaggctcgagggagggctgcaggtggtcnccgacatatagtgactaagtgggganaaccacattcacgcagactcgtggaagaacggggcccgtaattcccaccgattccctaccgaggggaaccaaaccggaccaaagacctacacgttgtactcgtagacaaaatcgaaactagtactaaagacgacccgaaagaccgacggcctgtacttcgtagtgcgagtggagggagacggactacggg

SEQ ID NO: 421296 - DNA, 576 bp, Homo sapiens
  misc_feature: GZ8MTXP02GRHS5.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagcctctggattcaccttcagtggctacttcatgagctggactccgccaggctccgaggggaggggctggcaggtgggtctccgacatattagtgacttaaagtgggggaacaaacccatatttcctaacgcaacggactcgtaggaacggaacgggggccctatttccctacccaattcccgtaccgaggggaaccaaaccggcccaaaaggaacctacacgttagtatcctagacaaagtgaaactagtacaaagacgaccgaaagaccacggccgttacgtaccttcgagtgcgtaggtgaggggagacggactacggg

SEQ ID NO: 421297 - DNA, 539 bp, Homo sapiens
  misc_feature: GZ8MTXP02GGLTQ.51.37.D04.1.454.CMB.2.raw
  modified_base (445)..(445): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggaggcttggtcaagcctgggagggtccctgagactctcctgtgcagcctctggattcaccttcagtgctacttcatgagctggactccgccaggcctccgaggggagggctgcaggtggtctcacatattagtgacttaagtggggaacaaaccatacttcacgcagactcgtgtagaacgggccattcctccattccacgacgggacaaacgaccaaagacctcactgtatcngaacaatagaacagtactaagacgaccgaaaggacaccgggtcgtacgtaccttgtaggtcgacgaggtcggtagggagacgggtactaacggg

SEQ ID NO: 421298 - DNA, 542 bp, Homo sapiens
  misc_feature: GZ8MTXP02IBHKS.51.37.D04.1.454.CMB.2.raw
  modified_base (253)..(253): a, c, t, g, unknown or other
  modified_base (375)..(375): a, c, t, g, unknown or other
  modified_base (381)..(381): a, c, t, g, unknown or other
  modified_base (509)..(509): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtatccagtgtcaggtgcagctggtggaatcgtgggggagcttggtcaagccgtgggagggtccctgagctctcctgngcagcctctggacttcaccttcagtggctacttcatgagtctggactcccggccaggcctccggaagggggaaggggctggcgtaggtgggtctacactatagtagtgactaagtggggaanaaaccntattcacgctagactcgtagagacggcctatttcaccattccaccgaggaccaaacgtcaaagaactcacttgatcgtagaacaatcgaaactgtacaaaagcgaccgaagacacggcgtataccttnggtcgcgaggtcggaggacgacggtacgtacgg

SEQ ID NO: 421299 - DNA, 586 bp, Homo sapiens
  misc_feature: GZ8MTXP02JC9N2.51.37.D04.1.454.CMB.2.raw
  modified_base (260)..(260): a, c, t, g, unknown or other
  modified_base (342)..(342): a, c, t, g, unknown or other
  modified_base (355)..(355): a, c, t, g, unknown or other
  modified_base (361)..(361): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggtttccttgttgctattatagaaggtgtccagtgtcaggtgcagctggtggaatcgtgggggaggcttggtcaagcctgggagggtccctgagactctcctgtgcagcctntggattcacttcagtggctactcatgagctggactccgcaggctccgaggggagggctgcaggtggtctccacatattagtnactaagtgggganaaccanattcaacgcagtactcgtagaaggaacgggccgaattccacccatccctaccgaaggggaccaaaccggacccaaagaaccttcaccttggtaactcgtacgactaaaatagaaacctagtacctaaaggacggacccggaaagacccgtaacgggtcccgttacgttaccttcgttaggtcgacggtaggttcggtagggggacgtaaggggtacgttacgggg

SEQ ID NO: 421300 - DNA, 517 bp, Homo sapiens
  misc_feature: GZ8MTXP02HLHIW.51.37.D04.1.454.CMB.2.raw
  modified_base (351)..(351): a, c, t, g, unknown or other
  modified_base (357)..(357): a, c, t, g, unknown or other
  modified_base (372)..(372): a, c, t, g, unknown or other
  modified_base (388)..(388): a, c, t, g, unknown or other
  modified_base (394)..(394): a, c, t, g, unknown or other
  modified_base (437)..(437): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggaggtccctgagactctcctgtgcagccctctggattcaccttcagtgctactcatgagctggatccgccaggctcaggggagggctgcagtggtctcacatattagtgctaagtggggaanaaaccnattcacgcagacctntgagaagggccattcnccatcnccagagacaacgcctaaagaactcactagtaatctagacaaanagaacagtacgtaacgacgacgaacgacgacgaccgtacgtacgtcgtgtcgacggacggtaggtacggacggacggacg

SEQ ID NO: 421301 - DNA, 504 bp, Homo sapiens
  misc_feature: GZ8MTXP02HH8Z9.51.37.D04.1.454.CMB.2.raw
  modified_base (267)..(267): a, c, t, g, unknown or other
  modified_base (314)..(314): a, c, t, g, unknown or other
  modified_base (316)..(316): a, c, t, g, unknown or other
  modified_base (318)..(318): a, c, t, g, unknown or other
  modified_base (324)..(324): a, c, t, g, unknown or other
  modified_base (327)..(327): a, c, t, g, unknown or other
  modified_base (332)..(332): a, c, t, g, unknown or other
  modified_base (335)..(335): a, c, t, g, unknown or other
  modified_base (339)..(339): a, c, t, g, unknown or other
  modified_base (357)..(357): a, c, t, g, unknown or other
  modified_base (360)..(360): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtggtttctgtagctatatagagtgtcagtgtcaggtgcagctggtggaatcgtgggggagcttgggtcaagcctgggagggtccctgagactctcctgtgcagcctctggattcaccttnagtgctacttcatgagctggactccgcaggctaccgaggggagggcngngngtgtcncanatatntgntagngagacactatctacacanatnagagacggcgtctctcactcacgacgacgacgacaacactacactatactctacacaatagaacagtacgaacgacgacgaacgaacgacgtacgtacgtactcgtcgtgacgtacggtaggtaggacggacggtacggtacgg

SEQ ID NO: 421302 - DNA, 512 bp, Homo sapiens
  misc_feature: GZ8MTXP02IGE9A.51.37.D04.1.454.CMB.2.raw
  modified_base (240)..(240): a, c, t, g, unknown or other
  modified_base (359)..(359): a, c, t, g, unknown or other
  modified_base (431)..(431): a, c, t, g, unknown or other
  modified_base (452)..(452): a, c, t, g, unknown or other
tcagcgatcgtatacacgaccggtgctcgatttagtagcatactgttgggtttggggtgggtccaggaggcagaactctgggtgtctcaccatggcctggatccctctacttctccccctcctcactctctgcacaggctctgaggcctcctatgagctgacacagccagcctcggtgtcagtgtccccaggacagacggccaagatcccctgctctggagatgcattgaccaaaacgtntttgctttttggtaaccaacagaagccaggccaggcccctataataattatataataaagacagtgagaggccctcagggatccctgagcgattctctggcctccagctcaggacaacngccagttgacgattagtggagtccaggcagaaagacgaaggctagactatactgtcaaatcagcaagacganagtggtattatggatatcggngaggacaaggtgacgtcgaaggtcaagccaaaggctcgcccctcggcacgtctcgtcccc

SEQ ID NO: 421303 - DNA, 655 bp, Homo sapiens
  misc_feature: GZ8MTXP02JSDA0.51.37.D04.1.454.CMB.2.raw
  modified_base (286)..(286): a, c, t, g, unknown or other
  modified_base (329)..(329): a, c, t, g, unknown or other
  modified_base (346)..(346): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtggtttcctgttgctattatagaggtgtccagtgtcaggtgcagctggtggaatcgtgggggagcttggtcaagcctggagggtccctgagactctcctgtgcagcctctggattcaccttcagtggctacttcatganctggatccgcaggcctaccgaggggagggctgcaggtcggtcnccacgtattagttaggngtacgtaaggtcggggaaacaacctactacttaccgacgactacgtaccgtcgtaaggaacgggaacgggtcccttaacttccctaccctaacgttaccccgtacccggaaacggggaaacccaaaccggtaacccgaaacgtaacccttacgaacgttacgttaacttacgtaacgtaactaaacgtaacgtaacgtaacgtaacgtaaacggaacggaaccggaacggaaccggaccggtaccgtacgttacgttacgtacgtaacgtacggtacggtacggtagggtacggtacggtacggtacgg

SEQ ID NO: 421304 - DNA, 638 bp, Homo sapiens
  misc_feature: GZ8MTXP02IMADG.51.37.D04.1.454.CMB.2.raw
  modified_base (246)..(246): a, c, t, g, unknown or other
  modified_base (253)..(253): a, c, t, g, unknown or other
  modified_base (260)..(260): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtggtttcgtgtagcgtatatagagtgtcagtgtcaggtgcagctggtggaatctgggggagcttggcaagcctggagggtccctgagctctcctgtgcngctctgntctctcngtgctactctatgagcgtgacgtccgccgcgcgaccggagggagggcgtgcgtaggtcggtcgtaccactatagtagtagtacgtaagtggaacgaacactacttacgtacgactacgtactcgaggaacggaacgggtaccgtacgttactacctacgtaccgtaccgacggaaccgaaaccgaaccgaaaccgtaaccgtaccgtacgttacgttacgtacgtaacgtaacgtaaacgtaacgtaaacgtaacgtaacgtaaacgaacggaaccggaaacggaaaccggtaaccggtaccgttaccgttaccgtttacgttcggttaacggtacggtacggtacgggtaggggtacgggtaacggtaacggtacgg

SEQ ID NO: 421305 - DNA, 617 bp, Homo sapiens
  misc_feature: GZ8MTXP02IPXNY.51.37.D04.1.454.CMB.2.raw
  modified_base (252)..(252): a, c, t, g, unknown or other
  modified_base (265)..(265): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtggtttcgtgtagctatatagagtgtccagtgtcaggtgcagctggtggaatctgggggagcttggtcaagcctggagggtccctgagactctctgtgcagcctntggattcaccttnagtgctactcatgagcgtgactcccgcgacggcctaccggaggggagggctggcgtaggtcggtctaccacgtattagttagtgtacttaaggtcggggaacaaaccctacgtacttccgtacgactaacgtactcgtagaggaacggtacgtacgttctacctactactaccgacggaaccgaaaccgaaccgaaacgaactacctacgtacgtactacgtacgactaataacgaacgtaacgtacgtaaacgaacgaaccggaaacgaacgaaccggtaccgttacgttacgttacgttacgtaacggtacggtacggtacggtagggtacggtacggtaacggtaacgg

SEQ ID NO: 421306 - DNA, 616 bp, Homo sapiens
  misc_feature: GZ8MTXP02JBE3Q.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggtttcctgttgctatatagaaggtgtccagtgtcaggtgcagctggtggaatcgtgggggagcttggtcaagcctgggagggtccctgagactctcctgtgcagcctctggattcaccttcagtggctacttcatgagctggatccgcaggctccgagggagggctgcaggtggtctcgactatattagtgacttaagtgggggaactaaaccactatttcgaacgctagaactcgtaggtaggaaacggggtccctaatttccgtccctaattcccgtaccccgaaaggggaacccaaacccgggcccaaaacggtaacccttccgtaaaccttggttaaactccgttagaacctaaaagttcggaaacctaagtactaaaacggacggacccgaaagaccgaacggtccgttagtaccttcctaggtcgtacggagttcggggagggacgacgggtactacgggg

SEQ ID NO: 421307 - DNA, 556 bp, Homo sapiens
  misc_feature: GZ8MTXP02JN4KU.51.37.D04.1.454.CMB.2.raw
  modified_base (289)..(289): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctggagggtccctgagactctcctgtgcagcctctggattcaccttcagtgctacttcatganctggatcccgccaggcctccgaggggaaggggctggcgaggtgggtctaccgactatagttagtgacttaagtggggaacaaccacattctacgcagactcgtggtagaacgggcctattcctccatcctaccgaggaccaaacgccaaagactcatgtactcgtagacaaatcgaaactagtactaaagacgacgaacgaccgacgggtccgtagttaccttcgtggtcgcggtaggtggtaggggaaggtacggaacgtacgggg

SEQ ID NO: 421308 - DNA, 603 bp, Homo sapiens
  misc_feature: GZ8MTXP02FJNUV.51.37.D04.1.454.CMB.2.raw
  modified_base (157)..(157): a, c, t, g, unknown or other
  modified_base (164)..(164): a, c, t, g, unknown or other
  modified_base (200)..(200): a, c, t, g, unknown or other
  modified_base (248)..(248): a, c, t, g, unknown or other
  modified_base (264)..(264): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtggtttcgtntaggctntatagagtgtccagtgtcaggtgcagctgtggaatntggggaggctggtcaagcctggagggtcccgtgagactctcctgtgcngctctgtatctcctcngtgtctactcatgagcgtggacgtccgccgacggcgtccggaggggaggggcgtgcgaggtggtcgtccactatagttagtagtacgtaagtggaacgaacaactacttactacgacacgtactcgtgtaggacggacgtacgttccgtacctactacgtaccgaacgaacgaaaccgaaccgaaacgaactactactacgtactacgtacgtaactaaagtaacgaacgaacgtaacgtaaacgaacgaacgaaacgaaccgaccggtacgttacgttacgttacgttacgtaacggtacggtacggtagggtagggaacggaacggtaacggtacgg

SEQ ID NO: 421309 - DNA, 513 bp, Homo sapiens
  misc_feature: GZ8MTXP02I77W5.51.37.D04.1.454.CMB.2.raw
  modified_base (359)..(359): a, c, t, g, unknown or other
  modified_base (382)..(382): a, c, t, g, unknown or other
  modified_base (398)..(398): a, c, t, g, unknown or other
  modified_base (404)..(404): a, c, t, g, unknown or other
  modified_base (437)..(437): a, c, t, g, unknown or other
  modified_base (439)..(439): a, c, t, g, unknown or other
  modified_base (442)..(442): a, c, t, g, unknown or other
  modified_base (444)..(444): a, c, t, g, unknown or other
  modified_base (447)..(447): a, c, t, g, unknown or other
  modified_base (451)..(451): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagcctctggattcaccttcagtggctacttcatgagctggactccgccaggctccgaggggaaggggctgcagtgggtctcacatattagtgactaatggggaanaaaccacattcaacgcagacctntagagagggccattcnccatcncaggacaaacgccaaagaactcactgtatctananaananaanaganaagacgacgaacgacgacgacgtacgtactctgtgcgaggtaggtaggaggacggacgtacg

SEQ ID NO: 421310 - DNA, 566 bp, Homo sapiens
  misc_feature: GZ8MTXP02JMF5N.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggacgggtccctgagactctcctgtgcagcctctggattccaccttcagtggctacttcatgagctggactccgccaggctccgaggggagggctgcaggtgggtctccgactattattagtgacttaagtgggggaacaaacccacgtaatttccaacgcaaggtacctcgtggtagaacggggcccgtaatttctacccattcccaccgagggaccaaaccgccaaagaacctcactgtatctagacaaatgaactagtcaaagacgaccgaaagtaccacggggtcctagttaccttgtggtgcgtacggtaggtagggacggaggacgtaacgg

SEQ ID NO: 421311 - DNA, 568 bp, Homo sapiens
  misc_feature: GZ8MTXP02GJXOQ.51.37.D04.1.454.CMB.2.raw
  modified_base (328)..(328): a, c, t, g, unknown or other
  modified_base (336)..(336): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaaggtgtccagtgtcaggtgcagctggtggaatcgtgggggagcttggtcaagcctgggagggtccctgagactctcctgtgcagcctctggattcaccttcagtgctactcatgagctggatccgcaggctcgagggaggctgcagtggtctcactntagttagngacttaagtggggacaaccatattcgacgcaagtactcgtagaaggaacgggccgtaatttccacctactccgtaccgaaggggaccaaacgccaaagtacctcacttgtactcgtagaactaaagtacgaactagtactaaggacgaccgaaagaccgtacggtaccgtacgtaaccgttcgtacggtcgacggtaggttcgggagggaacgtacgggaaccttaacgggg

SEQ ID NO: 421312 - DNA, 519 bp, Homo sapiens
  misc_feature: GZ8MTXP02IRM34.51.37.D04.1.454.CMB.2.raw
  modified_base (357)..(357): a, c, t, g, unknown or other
  modified_base (364)..(364): a, c, t, g, unknown or other
  modified_base (372)..(372): a, c, t, g, unknown or other
  modified_base (398)..(398): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccctgagactctcctgtgcagcctctggattcaccttcagtggctacttcatgagctggactccgccaggctccgagggagggctgcaggtggtctccacatattagtgacttaagtgggganaaaccanattcacgnagactctgtagaacgggcctattccnccatccaccgagggaccaaacgccaaagaacctcactgtatctgacaaatgaaacagtacaaaagacgaccgaagacacggcctcgtacttcgagtgcggagtggaggagaggactacggg

SEQ ID NO: 421313 - DNA, 535 bp, Homo sapiens
  misc_feature: GZ8MTXP02ISJYM.51.37.D04.1.454.CMB.2.raw
  modified_base (352)..(352): a, c, t, g, unknown or other
  modified_base (358)..(358): a, c, t, g, unknown or other
  modified_base (388)..(388): a, c, t, g, unknown or other
  modified_base (394)..(394): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccctgagactctcctgtgcagcctctggattcaccttcagtggctacttcatgagctggatccgcaggctccgagggagggctgcaggtggtctcacatattagtgctaagtgggganaaccanattcacgcagactctgagaagggccattcnccatcncaggacaacgccaagaactcactgtatctagacaaatacgaaactagtactaaaggacggacccgaaagaccaaccgggccttcggtaaccttcgtggtcgacggtaggttcggtaggggagtacggggtaacttacgggg

SEQ ID NO: 421314 - DNA, 565 bp, Homo sapiens
  misc_feature: GZ8MTXP02JYEMI.51.37.D04.1.454.CMB.2.raw
  modified_base (274)..(274): a, c, t, g, unknown or other
  modified_base (350)..(350): a, c, t, g, unknown or other
  modified_base (365)..(365): a, c, t, g, unknown or other
  modified_base (416)..(416): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggagggtccctgagactctcctgtgcagcctctggattcaccttnagtggctacttcatgagctggactccgccaggcctccgaggggacggggctggcaggtgggtctccacatattagngactaagtggggaanaaccactattcacgcagactcgtagaggaacgggccgtattcctccatccnccgagggaccaaaccgccaaagacctcactgtatctgactaaatacgaaacagtacaaaggacgacccgaaagaccgaccgggtccgttacgtaccgttcgtggtcggacggtagttcggggtaggggaacggacgggaccgtacgggg

SEQ ID NO: 421315 - DNA, 536 bp, Homo sapiens
  misc_feature: GZ8MTXP02JQFIV.51.37.D04.1.454.CMB.2.raw
  modified_base (262)..(262): a, c, t, g, unknown or other
  modified_base (345)..(345): a, c, t, g, unknown or other
  modified_base (354)..(354): a, c, t, g, unknown or other
  modified_base (401)..(401): a, c, t, g, unknown or other
  modified_base (432)..(432): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggaggcttggtcaagccgtgggagggtccctgagactctcctgtgcagcctnggattcacttcagtgctacttcagtgagctggactcccgcaggctccgaggggaggggctgcaggtgggtctcactatatagngacttaagngggaacaacacgtattcacgcagactcgtagaagacgggcctattcnccatccacgaggaccaacgaccaaagacctnactagtactctagacaaatcgaaactgtacaagacgaccgaaagaccgacggtccgtagtaccttgagtcgcggtaagttggagggaagcgggtaacgtacggg

SEQ ID NO: 421316 - DNA, 504 bp, Homo sapiens
  misc_feature: GZ8MTXP02JONMF.51.37.D04.1.454.CMB.2.raw
  modified_base (392)..(392): a, c, t, g, unknown or other
  modified_base (397)..(397): a, c, t, g, unknown or other
  modified_base (476)..(476): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagcctctggattcaccttcagtggctactcatgagctggatccgccaggctccgaggggagggctgcaggtgggtctccgacatattagtgactaagtggggaacaaccactattcacgcagactcagagaggcatcncatcncgaggacaacgccaaagactcactgtatctagacaaatgaacagtacaaagcgaccgaagacgacggcgtcgtacttcngtgcgagtggtagggagacggactacgg

SEQ ID NO: 421317 - DNA, 695 bp, Homo sapiens
  misc_feature: GZ8MTXP02HCK60.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccctgagactctcctgtgcagcctctggattcaccttcagtggctactcatgagctggatccgccaggctccgaggggaggggctgcaggtgggtctccacattattagtgactaaagtgggggaacaaaccacatttccaacgcaaggaccttcgtaggaaggaaacgggggccctaattttccgtaccctaattcccgttacccgaagggggaaacccaaaaccgggaccccaaaaacggaaccctttaccaaacccgtttagggttaaaccttcccgttaggaaaccctaaaaagttcggaaaacctaagggtttaaccctaaaagggaaccggacccccggaaaaggaacccgaaacccgggggtccccgtttaggttaaacccctttccgtaggttcggaccggtaacgggttcggggttaagggggacgtaaagggggaaccctttaaccggggg

SEQ ID NO: 421318 - DNA, 678 bp, Homo sapiens
  misc_feature: GZ8MTXP02GMTV7.51.37.D04.1.454.CMB.2.raw
  modified_base (242)..(242): a, c, t, g, unknown or other
  modified_base (298)..(298): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcctcactctctgcacaggctctgaggcctcctatgagctgacacagccagcctcggtgtcagtgtccccaggacagacggccaagactcccctgctctggagatgcattgaccaaaacgtnttgtcttttagacaacagagcacgcacgaccctaataataatataataataaaganagtagagacgccctacgaggactcccgtagacgcgtattctcgtcggccctccacgctacgacggaacaacgcgacctacgttacgaacgtaagttaggtaggacgtaccgaggacgaaggaaacggacggaggtacgtacgtaacttaacttacgtacgtactaaatacgaagacgaacgaacgtaacgtaaggttacggttaacgttaaggttagggtaagttacggttaccggggacggggaacggggaaccggtaaacggggtaccggtaacccggttaccgtaacgggtacccgaaccggtaaccccgaacggtcccgtacccggtacccccgttacggtacccgtacccgtttcccgtttacccgttacccccg

SEQ ID NO: 421319 - DNA, 501 bp, Homo sapiens
  misc_feature: GZ8MTXP02GAWI9.51.37.D04.1.454.CMB.2.raw
  modified_base (324)..(324): a, c, t, g, unknown or other
  modified_base (347)..(347): a, c, t, g, unknown or other
  modified_base (353)..(353): a, c, t, g, unknown or other
  modified_base (382)..(382): a, c, t, g, unknown or other
  modified_base (387)..(387): a, c, t, g, unknown or other
  modified_base (435)..(435): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatctgggggagcttggtcaagcctggagggtccctgagactctcctgtgcagcctctggattcaccttcagtggctactcatgagctggatccgcaggctccagggagggctgcagtggtcnccacatatagtgctaatgggganaaccanattcacgcagactctgagaaggccattcncatcncaggacacgcaaagactcactgtatctgacaaatgaacagtacaaagngacccgaaagaccgacggcctagtaccttctagtgcgagtcggtagggacgagggtactaacgggg

SEQ ID NO: 421320 - DNA, 563 bp, Homo sapiens
  misc_feature: GZ8MTXP02JOZ25.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccctgagactctcctgtgcagcctctggattcaccttcagtggctacttcatgagctggatccgcaggctccgaggggagggctgcagtggtctccgacatattagtgactaagtgggggaacaaaccactattcctaacgcagacctcgtaggaacgaacggggcccgtaatttccacccattccctaccgaacggggaaccaaaccggacccaaagaacctcgaacttggtactcgtagacaaatcgaaactagttacaaagacgaccgaaagaccgacggccgtagtaccttcgagtgcgaggtggtagggagacggacgtacggg

SEQ ID NO: 421321 - DNA, 570 bp, Homo sapiens
  misc_feature: GZ8MTXP02HT3EE.51.37.D04.1.454.CMB.2.raw
  modified_base (261)..(261): a, c, t, g, unknown or other
  modified_base (361)..(361): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagccctntggattcaccttcagtggctacttcatgagctggatcccgcaggctcgaggggaaggggctgcagtgggtctcgacatattagtgctaaagtggggaaanaaaccactattcacgacagactcgaggaagaacgggccattcctaccactccgaccgagggaaccaaaccgaccaaagtaacctcaactagtatctagaacaaataacgaaacaacgtaacgtaaacgaacgaaccgaaacgaacgaaccggaccgtacgtacgttacgtcgtgtcgtaggtaggtagggacggaacggaacgtaacgg

SEQ ID NO: 421322 - DNA, 615 bp, Homo sapiens
  misc_feature: GZ8MTXP02GJZ3Z.51.37.D04.1.454.CMB.2.raw
  modified_base (241)..(241): a, c, t, g, unknown or other
  modified_base (288)..(288): a, c, t, g, unknown or other
  modified_base (294)..(294): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcctcactctctgcacaggctctgaggcctcctatgagctgacacagccagcctcggtgtcagtgtccccaggacagacggccaagactccctgctctggagatgcattgaccaaaacgtntttgtctttagacaacagagcagcacgacctataataatataataanaaaganagagagaacgcctacgaggactcccgtgacgcgtacttctcgtcgcccctaccacgctacgaacggaacaacgcgccaacgttacgacgtaagttaggtaggacgtccgaaggacgaaggaaagacggagactagtaacttaattacgtagtactaaatacgaagacgaagaacgaacgtagttacggttaacttaggtaggtaagttacggtacgggacgggaacgggaaccgtaagggtacggtaaccgtacgtacggtacgacgacccgaaggtccgtaccgtcccccgtacgtaccgtaccgtccgtacgtcccccg

SEQ ID NO: 421323 - DNA, 652 bp, Homo sapiens
  misc_feature: GZ8MTXP02JP22K.51.37.D04.1.454.CMB.2.raw
  modified_base (190)..(190): a, c, t, g, unknown or other
  modified_base (296)..(296): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtggtttcgtgtaggctatatagagtgtcagtgtcaggtgcagngtggtggagtcggtggggaggtcgttggtacgaacgccgtggtacggtccgtgagtactctcgtgtgcgcgctcgtgtacttctacctctatcgtctactctatgngtcgtgtacgtccgccgacggccgtaccggacggggacggggtcgtcggcgtacggtcggtcgtacctactattagttagtagtacgtaagtacggtaacgtaacctactacttacgtacgacgacgtacgtacgtagtaggtacggtacgtacttacctacctactaccgtaccgacggaaccgaaaccgaaccgaaacgaactactacgtacgttactacgtacgtaacgtaaacgtaacgtaacgtaacgtaacgtaaacgaacggaacgaaacggaaccgaccggtaccgtacgttacgttacgtcggtcggtacggtacggtacggtaggtacggtacggtaacggtacgg

SEQ ID NO: 421324 - DNA, 636 bp, Homo sapiens
  misc_feature: GZ8MTXP02GXIIC.51.37.D04.1.454.CMB.2.raw
  modified_base (190)..(190): a, c, t, g, unknown or other
  modified_base (207)..(207): a, c, t, g, unknown or other
  modified_base (283)..(283): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtggtttcgtgtaggctatatagagtgtcagtgtcaggtgcagntggtggaatgtgggggnggtcgtgtcgacgcgtggtcggtccgtgagtctctctgtgcgcgctcgtgtctctactcgtgtgtctactctatgngcgtgtcgtccgcgacgcgtacggagggagggcgtgcgtggtcggtctctactatagtagtagtacgtagtaggaacgaactaactacttacgtacgtacgtacgtacgtcgtaggtacggtaacgggtaccgtacgttaccgtacctacgtaccgtaccggaacggaaccgaaaccgaaccgtaaaccgtaacgtactacgttacgtacgtacgtacgtaacgtaacgtaacgtaacgtaacgtaacgtaacgtaacgaaccgaacggaaccggtaccggtaccgttacgttacgttacgttacggtcggtacggtacggtacgggtagggtacggtaacggtacggtacgg

SEQ ID NO: 421325 - DNA, 542 bp, Homo sapiens
  misc_feature: GZ8MTXP02F0W17.51.37.D04.1.454.CMB.2.raw
  modified_base (364)..(364): a, c, t, g, unknown or other
  modified_base (411)..(411): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaaggtgtccagtgtcaggtgcagctggtggaatcgtgggggagcttggtcaagcctgggaggtccctgagactctcctgtgcagcctctggattcaccttcagtggctacttcatgagctggactccggccaggcctccgaggggaggggctggcaggtgggtctccgacatattagtgcttaaagtggggaanaaccatattcctaacggcagtactcgtggtgaacggggcctattccnccatctccgagggacaacgcaaagaactcactgtatctagacaaagtcaaacagtacaaaggacgaccgaaagaccacgggcctagttactctaggtcgacgtaggtggtaggggagacgggacgtacggg

SEQ ID NO: 421326 - DNA, 513 bp, Homo sapiens
  misc_feature: GZ8MTXP02IWHV7.51.37.D04.1.454.CMB.2.raw
  modified_base (253)..(253): a, c, t, g, unknown or other
  modified_base (282)..(282): a, c, t, g, unknown or other
  modified_base (339)..(339): a, c, t, g, unknown or other
  modified_base (345)..(345): a, c, t, g, unknown or other
  modified_base (351)..(351): a, c, t, g, unknown or other
  modified_base (366)..(366): a, c, t, g, unknown or other
  modified_base (382)..(382): a, c, t, g, unknown or other
  modified_base (387)..(387): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtggtttcgtgtagctatatagagtgtccagtgtcaggtgcagctggtggaatcgtgggggagcttggcaagcctggagggtccctgagactctcctgtgcagcctntggattcacttcagtggctacttcatganctggatccgcaggctcgagggagggctgcaggtggtctcacatattagtgcttaagngggganaaccanaattcacgcagactntagagacggctattcncatcncgacgacgaacgacaacaactactactacgtactactagactaataagaatacgtacgtaagacgacgaacgacgacggacgtacgtacgttcgtgtgcgtaggtaggaggaggacggtacgtacg

SEQ ID NO: 421327 - DNA, 531 bp, Homo sapiens
  misc_feature: GZ8MTXP02HMZHY.51.37.D04.1.454.CMB.2.raw
  modified_base (222)..(222): a, c, t, g, unknown or other
  modified_base (241)..(241): a, c, t, g, unknown or other
  modified_base (291)..(291): a, c, t, g, unknown or other
  modified_base (300)..(300): a, c, t, g, unknown or other
  modified_base (317)..(317): a, c, t, g, unknown or other
  modified_base (364)..(364): a, c, t, g, unknown or other
  modified_base (386)..(386): a, c, t, g, unknown or other
  modified_base (423)..(423): a, c, t, g, unknown or other
tcagcgatcgtatacacgaccggtgctcgatttagtagcatactgttgggtttggggtgggtccaggaggcagaactctgggtgtctcaccatggcctggatccctctacttctccccctcctcactctctgcacaggctctgaggcctcctatgagctgacacagccagcctcggtgtcagtgtccccaggacagacggccaagactcccctgctctgganatgcattgaccaaaacgtntttgctttttggaccaacagaagccaggccaggcccctaataataattanataataaanacagtgagacggccctnagggactcccgtgagcgattctctggccctccagctcgaggacaacncgccacgttgacgtatttaggnggacgtccaggcaagaagacgaggctagactattacngtacaaatcagcagacgacagtggtactagtggagttagtcggacggaggaccaggtcgacgtcgagtcacgcccaaggcctcgcccccgtgccactcgtactccccc

SEQ ID NO: 421328 - DNA, 519 bp, Homo sapiens
  misc_feature: GZ8MTXP02G6OB7.51.37.D04.1.454.CMB.2.raw
  modified_base (351)..(351): a, c, t, g, unknown or other
  modified_base (391)..(391): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccctgagactctcctgtgcagcctctggattcaccttcagtggctacttcatgagctggatccgcaggctccgagggagggctggcagtgggtctcacatatagtgctaatgggganaaccacattctacgcagactctagagaagggccgtattcnccatctcaggacaacgccaaagactcactgtaatctagacaaatcgaaactagtactaaagacgacgaaagacaaccggctcgtaccttgtagtggtcgaggtcggtaggggacgtagggactacggg

SEQ ID NO: 421329 - DNA, 507 bp, Homo sapiens
  misc_feature: GZ8MTXP02F0RUI.51.37.D04.1.454.CMB.2.raw
  modified_base (288)..(288): a, c, t, g, unknown or other
  modified_base (348)..(348): a, c, t, g, unknown or other
  modified_base (384)..(384): a, c, t, g, unknown or other
  modified_base (389)..(389): a, c, t, g, unknown or other
  modified_base (417)..(417): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaaggtgtccagtgtcaggtgcagctggtggaatcgtgggggagcttggtcaagcctgggagggtccctgagactctcctgtgcagcctctggattcaccttcagtgctacttcatganctggatccgcagctccgagggagggctgcagtggtctcgacatatagtgctaatgggganaaccacattcacgcagactctgagaacggcgattcncatcnccaggacaacgccaaagactcactgtanctgacaaatgaacagtacaaagacgaccgaaagaccgaacggccgtagtaccttctagtcgcgaggtggtagggacgaggacgtaacggg

SEQ ID NO: 421330 - DNA, 692 bp, Homo sapiens
  misc_feature: GZ8MTXP02H7XN0.51.37.D04.1.454.CMB.2.raw
  modified_base (242)..(242): a, c, t, g, unknown or other
tcagcgatcgtatacacgaccggtgctcgatttagtagcatactgttgggtttggggtgggtccaggaggcagaactctgggtgtctcaccatggcctggatccctctacttctccccctcctcactctctgcacaggctctgaggcctcctatgagctgacacagccagcctcggtgtcagtgtccccaggacagacggccaagactcccctgctctggagatgcattgaccaaaacgttntttgtctttttacgtaaccaacagaacgccgacggccgacgaccctaataataattataataataaagacagtagagacgcctacgaggactccgtgagcgtattctcgtcggccctccgacgtctacgaacgggaacaacgcgacccgtaacgttacgaacgtaagttaggtacgggtaacgtaccgagggacgaaaggaaacggaacggacggtacgttacgtaacttaacgttacgttacgtaactaaacgtacgaacgacgtaagaaccggaacgtaggttacggttaacgttaggttagggtaagttacggttacggggacggggtaacgggaaccgtaagggtaccggtacccgtaccgtacggtaccgaaccggtacccgaacggtcccgtcccggtacccccgttacggtaccctacccgtttccgttacccgttacccccg

SEQ ID NO: 421331 - DNA, 555 bp, Homo sapiens
  misc_feature: GZ8MTXP02IK68I.51.37.D04.1.454.CMB.2.raw
  modified_base (241)..(241): a, c, t, g, unknown or other
  modified_base (364)..(364): a, c, t, g, unknown or other
  modified_base (384)..(384): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcctcactctctgcacaggctctgaggcctcctatgagctgacacagccagcctcggtgtcagtgtccccaggacagacggccaagatcccctgctctggagatgcattgaccaaaacgtntttgcttttttggtaccaacagaagccaggccaggcccctataataattatatataaagacagtgagaggccctgagggatccccgtgagcgattctctggccctccagctacagggacaacngccacgttagaccgattagnggatccgaggcagaagacgaggctgactatactgtacaaatcagcagacgacagtgtacttagtggagtagttcgggacggagggacctaaagggtgacccggttacgaacggtcaacggccccaaagggcctaccgcccccgttcggtaccaccttcgtaccgttccccc

SEQ ID NO: 421332 - DNA, 563 bp, Homo sapiens
  misc_feature: GZ8MTXP02GZD8K.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccctgagactctcctgtgcagcctctggattcaccttcagtggctacttcatgagctggatccgcaggctcgaggggagggctgcaggtgggtctccgacattattagtgacttaagtgggggaacaaaccactattccacggcagacctcgtaggaaggaacgggggccctaatttcccgtacccattcccgtacccgaaggggaaccaaaccggacccaaagaaccttcaacttgtaactctagactaaagtgaaacagtacaaagacgaccgaagacgacggctacgtacttcgagtgcgtaggtggtagggacgaggacgtacgg

SEQ ID NO: 421333 - DNA, 539 bp, Homo sapiens
  misc_feature: GZ8MTXP02HVZLY.51.37.D04.1.454.CMB.2.raw
  modified_base (262)..(262): a, c, t, g, unknown or other
  modified_base (361)..(361): a, c, t, g, unknown or other
  modified_base (408)..(408): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggagggtccctgagactctcctgtgcagcctcnggattcaccttcagtgctacttcatgagctggactccgccaggctccgaggggagggctgcaggtggtctcgactattattagtgactaagtggggganaacccatactttcacggcagactcgtggagaacggggcctatttccnccattccgaccgagggaccaaacgccaaagactcacgtgtaactctagacaaagtgaaacagtactaaagacgaccgaaagacgacggctcgttactctggtgacgaggttgagggacgaggtacgtacgg

SEQ ID NO: 421334 - DNA, 567 bp, Homo sapiens
  misc_feature: GZ8MTXP02HH7XK.51.37.D04.1.454.CMB.2.raw
  modified_base (291)..(291): a, c, t, g, unknown or other
  modified_base (310)..(310): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtggtttcgtgtagctatatagagtgtcagtgtcaggtgcagctggtggaatcgtgggggagcttggtcaagcctggaggtccctgagactctcctgtgcagctctggatcacttcagtggctactcatgagctgatccgcagcnccagggaagggcgtgcggngtggtctaccactatagtagtgtagtagtggacgaacactactactacgacgacgactacgtagagacggacgtactctacctactaccgtaccgacgaaccgaaccgaaccgaacgaactactacgtacgtacgtacgtacgtacaagtaacgtaacgtacgtacgtaacgaacgacgaacgaaccgacggtaccgtacgttacgttacgtacgtcggtacggtacggtacggtagggacggacggtacggtacgg

SEQ ID NO: 421335 - DNA, 534 bp, Homo sapiens
  misc_feature: GZ8MTXP02I1E8T.51.37.D04.1.454.CMB.2.raw
  modified_base (261)..(261): a, c, t, g, unknown or other
  modified_base (408)..(408): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggaggcttggtcaagcctggagggtccctgagactctcctgtgcagcctcnggattcaccttcagtggctacttcatgagctggatcccgccaggctccgaggggagggctgcagtgggtctcacatattagtgacttaatggggaagaacccatattcctaacggctagactcgtaggagaaaggggccctattccncctatcctccgagggacaaacggccaaagaactcgactgtactcgtgacaatagaacagtactaagacgaccgaaagcgacggccttagtacttgtagtgcgaggttggagggagacggacgtagg

SEQ ID NO: 421336 - DNA, 655 bp, Homo sapiens
  misc_feature: GZ8MTXP02JZ9Y7.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccctgagactctcctgtgcagcctctggattcaccttcagtggctacttcatgagctggactccgccaggcctccggaggggaggggctggcaggtgggtctcgactatattagtgacttaagtgggggaacaaaccactatttcctacgcaagaccttcgtaggaaggtaaacggggcccgtaatttccgtacccaattccccgtacccggaagggggaaacccaaaacccggaccccgaaaaggtaaacccttaccaacccgttagggttaactcccgttaggaaccctaaaaagttacggaaaacctagggtaacctaaaaggacggaacccggaaagacccgaaccggggtccgttacgtaacctttcgtggtcgacggtaggttcgggtaggggagtacgggtaaccgttacgggg

SEQ ID NO: 421337 - DNA, 559 bp, Homo sapiens
  misc_feature: GZ8MTXP02IDF3Z.51.37.D04.1.454.CMB.2.raw
  modified_base (263)..(263): a, c, t, g, unknown or other
  modified_base (352)..(352): a, c, t, g, unknown or other
  modified_base (431)..(431): a, c, t, g, unknown or other
  modified_base (481)..(481): a, c, t, g, unknown or other
  modified_base (483)..(483): a, c, t, g, unknown or other
  modified_base (486)..(486): a, c, t, g, unknown or other
  modified_base (488)..(488): a, c, t, g, unknown or other
  modified_base (491)..(491): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttgggtcaagcctgggagggtccctgagactctcctgtgcagcctcnggattcaccttcagtggctacttcatgagctggactccgccaggctccgaggggaaggggctgcagtgggtctcgaactagtattaggngacttaaaagtgggggaaactaaacccagtactttcaaccggcaaggaccctgtgtaggaaacgggcccgaattttccncccaattccgacccagggaacaaaccgcaaaagactcactgtaatctaananaananaanagtagaagacgacgacgacgacgacgtacgtacttcgtgtgcgaggtggtaggaggacggacgtacgg

SEQ ID NO: 421338 - DNA, 499 bp, Homo sapiens
  misc_feature: GZ8MTXP02IYXP4.51.37.D04.1.454.CMB.2.raw
  modified_base (250)..(250): a, c, t, g, unknown or other
  modified_base (337)..(337): a, c, t, g, unknown or other
  modified_base (345)..(345): a, c, t, g, unknown or other
  modified_base (350)..(350): a, c, t, g, unknown or other
  modified_base (388)..(388): a, c, t, g, unknown or other
  modified_base (434)..(434): a, c, t, g, unknown or other
  modified_base (472)..(472): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggaggcttggtcaagcctggagggtccctgagactttccngtgcagcctctggattcaccttcagtggctacttcatgagctggactccgcaggctcgagggagggctgcagtggctcacatatagngactaagnggganaccactattcacgcagactctgtagacgggcctattcncatctcgagggacaacgcaaagactcatgtatctgacaaatgaacngtactaagacgacgaagacacggacgtcgtactcgtgngcgagtgtgggagacggacgtacggtg

SEQ ID NO: 421339 - DNA, 522 bp, Homo sapiens
  misc_feature: GZ8MTXP02FWMF4.51.37.D04.1.454.CMB.2.raw
  modified_base (259)..(259): a, c, t, g, unknown or other
  modified_base (287)..(287): a, c, t, g, unknown or other
  modified_base (325)..(325): a, c, t, g, unknown or other
  modified_base (336)..(336): a, c, t, g, unknown or other
  modified_base (350)..(350): a, c, t, g, unknown or other
  modified_base (365)..(365): a, c, t, g, unknown or other
  modified_base (394)..(394): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagctctcctgtgcagcctntggattcaccttcagtgctactcatganctggactccgcaggctcgagggagggctgcagtggtcncacatattagnactaagtggggaanaaccatattcaacgnacgactcgtaggagaagggccctattccnccatcctccgagggacaacgaccaaagactcaactgtactctagacaaatcgaactagtacaaaggacgaccgaaagaccgcggtacgtacgttactcgtgtgcgagttggacgggagaggacgtagg

SEQ ID NO: 421340 - DNA, 544 bp, Homo sapiens
  misc_feature: GZ8MTXP02GRMFB.51.37.D04.1.454.CMB.2.raw
  modified_base (338)..(338): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccctgagactctcctgtgcagcctctggattcaccttcagtgctacttcatgagctggactccgcaggctcgaggggagggctgcagtggtctcacatattagngactaagtggggacaaccactattcacgcagactcgtaggagaacgggccgtattcctaccatccgtaccgaggggaaccaaaccgaccaaagaaccttcacgttgtactctagacaaagtgaaactagtactaaagacgaccgaaagaccgacggtcgtacgtaccttcgtgtgcggtaggtggtaggggagacggacgtacggg

SEQ ID NO: 421341 - DNA, 508 bp, Homo sapiens
  misc_feature: GZ8MTXP02FXZ1D.51.37.D04.1.454.CMB.2.raw
  modified_base (238)..(238): a, c, t, g, unknown or other
  modified_base (311)..(311): a, c, t, g, unknown or other
  modified_base (356)..(356): a, c, t, g, unknown or other
  modified_base (374)..(374): a, c, t, g, unknown or other
  modified_base (404)..(404): a, c, t, g, unknown or other
  modified_base (433)..(433): a, c, t, g, unknown or other
  modified_base (444)..(444): a, c, t, g, unknown or other
tcagcgatcgtatacacgaccggtgctcgatttagtagcatactgttgggtttggggtgggtccaggaggcagaactctgggtgtctcaccatggcctggatccctctacttctccccctcctcactctctgcacaggctctgaggcctcctatgagctgacacagccagcctcggtgtcagtgtccccaggacagacggccaagatcccctgctctggagatgcattgccaaaacgntttgctttttggtaccaacagaagccaggccaggcccctataataatatatataaagacagtgagaggccctnagggatccctgagcgattctctggccctccagctcagggacaacngccacgttgacgattagngatccaggcagaagcgaagctgactatacngtacaaatcagcagacacagtgtacttanggagtatcggnggaggacaaaggtgaccgtctaggtcacgcccaaggctcgcccctcggcacgtctcgttccccg

SEQ ID NO: 421342 - DNA, 523 bp, Homo sapiens
  misc_feature: GZ8MTXP02JLT34.51.37.D04.1.454.CMB.2.raw
  modified_base (242)..(242): a, c, t, g, unknown or other
  modified_base (360)..(360): a, c, t, g, unknown or other
  modified_base (416)..(416): a, c, t, g, unknown or other
  modified_base (500)..(500): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcctcactctctgcacaggctctgaggcctcctatgagctgacacagccagcctcggtgtcagtgtccccaggacagacggccaagactcccctgctctggagatgcattgaccaaaacgtntttgctttttggtaccaacagaagccaggccaggcccctataataattatatataaagacagtgagaggcctcagggactccctgagcgattctctggcctcagctacgaggacaacngccacgttgacgattacgtgagtaccgaggacaagaagacgagctagactattacngtacaatcagacagaccagagtgtacttagtggagtattcgggagaacggaccgaaggtcgaccgtccaggtcacgccaaggcncgccccgtcgcactctcgtcccc

SEQ ID NO: 421343 - DNA, 551 bp, Homo sapiens
  misc_feature: GZ8MTXP02H25LW.51.37.D04.1.454.CMB.2.raw
  modified_base (221)..(221): a, c, t, g, unknown or other
  modified_base (364)..(364): a, c, t, g, unknown or other
  modified_base (384)..(384): a, c, t, g, unknown or other
  modified_base (417)..(417): a, c, t, g, unknown or other
  modified_base (427)..(427): a, c, t, g, unknown or other
tcagcgatcgtatacacgaccggtgctcgatttagtagcatactgttgggtttggggtgggtccaggaggcagaactctgggtgtctcaccatggcctggatccctctacttctccccctcctcactctctgcacaggctctgaggcctcctatgagctgacacagccagcctcggtgtcagtgtccccaggacagacggccaagatcccctgctctgganatgcattgaccaaaacgtatttgctttttggtaacccaacagaagccaggccaggcccctaataataattatataataaagacagtgagaggccctgagggactccctgagcgattctctggcctccagctcgagggacaacncgccacgttgacgattaggngagtccagcagaagacgaggctagactattacngtacatcagnaagacgacagtggtaacttagtggaagttagttcgggaggaacgggacaaaagggttcgaccgtaccgtacggtcgacgacccgaacgccgtcgacccccgtcggtcaccgtcttcgtaccccc

SEQ ID NO: 421344 - DNA, 549 bp, Homo sapiens
  misc_feature: GZ8MTXP02H2NW5.51.37.D04.1.454.CMB.2.raw
  modified_base (353)..(353): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggcaagcctgggagggtccctgagactctcctgtgcagcctctggattcaccttcagtggctacttcatgagctggatccgcaggctccgagggagggctgcagtggtctcacatatagtgactaagtgggggaanaaccactatttccacgcagactcgtaggagaacggggcccatttcctccattccgaccgaggggaaccaaaccggaccaaaagaacttcgacttaggtactccgtagactaaaagtcgaaaccagtactaaagacgaccgaaagaccacggacctgtacttcgagtcgcgtagtcggtagggacgaggtactacgg

SEQ ID NO: 421345 - DNA, 712 bp, Homo sapiens
  misc_feature: GZ8MTXP02G0QJB.51.37.D04.1.454.CMB.2.raw
  modified_base (331)..(331): a, c, t, g, unknown or other
  modified_base (342)..(342): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggagggtccctgagactctcctgtgcagcctctggattcaccttcagtggctactcatgagctggactccgcaggctccgaggggagggctgcagtcggtcncacatattagngacttaagtgggggaactaaaccactacttacgtacggctaaacgaccttcgtagggaacgggaaacgggggtccctaacgtttccctaccctaacgttccccgttaacccggaaacgggggaaccccaaaacccggggtaccccaaaaaggtaaccccttaccgtaaaccgttacggttaaactcccgttaaggaaccctaaaaagtacgggaaaacctaagggtttaaccgtaaaaagggaaccggtaaccccggaaaacggtaaccccggacggggtaccccggtttaggttaccctttcgtagggttcggacggttaagggttcgggggtaggggaacggtaacgggggtaacgtttaaccggggg

SEQ ID NO: 421346 - DNA, 607 bp, Homo sapiens
  misc_feature: GZ8MTXP02HWUTE.51.37.D04.1.454.CMB.2.raw
  modified_base (261)..(261): a, c, t, g, unknown or other
  modified_base (342)..(342): a, c, t, g, unknown or other
  modified_base (357)..(357): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagcctcnggattcaccttcagtgctacttcatgagctggactccgccaggctccgaggggaggggctgcaggtggtctcacatatagngactaagtggggganaacccatattcacgctagactacgtgtagaacgggccgtaatttcctcccgtaattcccgacccgaaggggaaccaaaccggcccaaaaggtaaaccctcaaccgttgtaaacctctacgaactaaaagttggaaaacctaagtcctaaaaggacgacccgaaaagaccaccgggggtaccttacggtaacccttcttgggcgtacgggaaggtttcgggagggggacgaacgggttacgttaacggggg

SEQ ID NO: 421347 - DNA, 525 bp, Homo sapiens
  misc_feature: GZ8MTXP02HCJ9U.51.37.D04.1.454.CMB.2.raw
  modified_base (289)..(289): a, c, t, g, unknown or other
  modified_base (402)..(402): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccctgagactctcctgtgcagcctctggattcaccttcagtggctacttcatganctggatcccgccaggctccgaggggaggggctgcaggtgggtctccgacattattagtgacttaagtggggacaaccactattctacgcagactctagagaagggccgattcnccatctcgaggacaacgccaaagactcatgtatctagacaaatcgaactagtactaaagacgaccgaaagaccgacggacccgtgtacttcgtgtgcgtaggtggtaggacgaggactacggg

SEQ ID NO: 421348 - DNA, 606 bp, Homo sapiens
  misc_feature: GZ8MTXP02IAWX8.51.37.D04.1.454.CMB.2.raw
  modified_base (245)..(245): a, c, t, g, unknown or other
  modified_base (248)..(248): a, c, t, g, unknown or other
  modified_base (279)..(279): a, c, t, g, unknown or other
  modified_base (318)..(318): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtggtttcgtgtagctatatagagtgtcagtgtcaggtgcagctggtggaatcgtgggggagcttggcaagccgtggacgggtccctgagctctcctgngcncgctctgtactctctctgtgctactctatgngtcgtcgtcgtccgccgacgcgtacggagggacgggcgngcgtggtggtctaccatatagtagtagtacgtaagtcggaacgaaactaactacttactacgacacgtacgtacgtaggacggaacggtaccgtacgttcctacctactccgtaccgacgaaccgaaccgaaccgaaacgaactactacgtacgtactactacgaacaagtaacgaacgtaacgtaacgtaaacgaacggaacgaacgaaccgtaccggtaccgttacgttacgttcgtcggtcggtacggtacggtacgggtagggtacggtacggtaacggtacgg

SEQ ID NO: 421349 - DNA, 531 bp, Homo sapiens
  misc_feature: GZ8MTXP02JSSZV.51.37.D04.1.454.CMB.2.raw
  modified_base (292)..(292): a, c, t, g, unknown or other
  modified_base (352)..(352): a, c, t, g, unknown or other
  modified_base (366)..(366): a, c, t, g, unknown or other
  modified_base (403)..(403): a, c, t, g, unknown or other
  modified_base (439)..(439): a, c, t, g, unknown or other
  modified_base (497)..(497): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaaggtgtccagtgtcaggtgcagctggtggaatcgtgggggagcttggtcaagcctgggacgggtccctggacgactctcctgtgcagcctctggattcaccttcagtggctacttcatganctggactccgcaggctccgaggggacgggctggacaggtggtctccgactatagttacgngactaagtgggganaaccatattcacgcagactctgtagacgggctattcnccatctacgacggacaacgcaaagactcgactgtanctagacaaatcgaacagtacaacgacgaccgaaagacgacggcgttagtacttctggngacggaggtacggtaggaagacggtacgtacggg

SEQ ID NO: 421350 - DNA, 636 bp, Homo sapiens
  misc_feature: GZ8MTXP02JU2AW.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggaggtccctgagactctcctgtgcagcctctggattcaccttcagtggctacttcatgagctggatccgccaggctccgaggggagggctgcaggtggtctcactatattagtgacttaagtgggggaacaaaccactatttccacgcagacctcgtaggaggaacggggtcctaagtttcctaccctacttcccgtacccgaagggggaacccaaacccggacccaaaaggtaaccctacaccgttaggttaactccgtagacctaaaagtcggaaaccaaggttacaaaaggaccggacccggaaaagaaccggaccggggtaccccggttagtttacccgttcgtaggtaacggcggtaagggttcggggtagggggacggtaacggggtaacgttaacggggg

SEQ ID NO: 421351 - DNA, 570 bp, Homo sapiens
  misc_feature: GZ8MTXP02IZRLX.51.37.D04.1.454.CMB.2.raw
  modified_base (359)..(359): a, c, t, g, unknown or other
  modified_base (399)..(399): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagcctctggattcaccttcagtggctacttcatgagctggatccgccaggctccgaggggaggggctgcagtgggtctcacatattagtgacttaagtggggganaaaccactattctacgcagactctgagaagggcctattcnccatctaccagggacaaacgaccaaagactcacttgtactctgacaaagtcgaaactaaggtactaaaaggacgaccggaaaagaccgaaacgggtccgttaggttaccctttcgtaggtcgtacggtaaggttcgggtagggggacgtaaggggaaccgtttaacggggg

SEQ ID NO: 421352 - DNA, 610 bp, Homo sapiens
  misc_feature: GZ8MTXP02IK7B7.51.37.D04.1.454.CMB.2.raw
  modified_base (289)..(289): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggtttccttgttgctattatagaaggtgtccagtgtcaggtgcagctggtggaatcgtgggggagcttggtcaagcctggacgggtccctgagactctcctgtgcagcctctggattcaccttcagtggctacttcatganctggatccgccaggctccgaggggagggctgcaggtggtctccgacatattagtgacttaagtgggggaacaacccatactttcctacggctaacgacctcgtaggaaggaaacgggggccctaatttccctacccaatttcccgacccgaagggggaacccaaaccggaccccaaaaggaaccttccaccttgaacttcgaggaccaaagttacgaaacctagttacgtaaaacggacggacccgaaagaccgtaaccgggcccgttagttaacttcgtaggtcgacggagttgggagggacggtacggaccgtaacggg

SEQ ID NO: 421353 - DNA, 601 bp, Homo sapiens
  misc_feature: GZ8MTXP02JKWSX.51.37.D04.1.454.CMB.2.raw
  modified_base (258)..(258): a, c, t, g, unknown or other
  modified_base (265)..(265): a, c, t, g, unknown or other
  modified_base (281)..(281): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtggtttcgtgtaggctatatagagtgtcagtgtcaggtgcagctggtggaatcgtgggggagcttgggcaagcctggagggtccctgagactctcctgtgcagctctggtntctctcngtcgtctactctatgngcgtgacgtccgccgacggcgtcggaggggacgggcgtcgcgtaggtcggtctcctatatagttagtagtacgtaagtggaacgaacactacgtactacgacacgtacgtacgtaggacggaacggacgtacttcctcctactacgtaccgacgaaccgaaccgaaccgaaacgtaactactacgtacgtacgtacgtacgtactaacgtacgaacgtacgtaacgtaacgaacgaacgaacgaaccgaccggtacgtacgttacgttacgtacggtcggtacggtacggtacgggtagggacggtacggtacggtacgg

SEQ ID NO: 421354 - DNA, 662 bp, Homo sapiens
  misc_feature: GZ8MTXP02JZY4Q.51.37.D04.1.454.CMB.2.raw
  modified_base (181)..(181): a, c, t, g, unknown or other
  modified_base (190)..(190): a, c, t, g, unknown or other
  modified_base (256)..(256): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtggtttcgtgtagctatatagagtgtccagtgtnaggtgcagngtggtaggagtcgtggggaggtcgttggtcgacgcgtggacggtccgtgagactctcctcgtcgcncgcctcgtgtattctacctcgtagtgtctactactagtagagcgtagtacgtccgccgacggccgtaccggacggggaacggggacgtcgacgtacggtcggtacgtacctacgtatagttagtacgtacgtaagtggaacgaaaccaactacttacgtacgacacgtactacgtaggtaacggaacggacgtacgtacctacctacgtacgtaccgacggaaccgaaaccgaaccgaaaccgaaccgtaccgtacgtacgttacgtacgtacgtaacaaacgtaacgtaacgtaacgtaacgtaacgaacgaaccggaaacggaaccggaccggtaccgtaccgttaccgttacgtcgtcggtacggtacggtacgggtacgggtacggtaacggtacggtacgg

SEQ ID NO: 421355 - DNA, 590 bp, Homo sapiens
  misc_feature: GZ8MTXP02HSQK0.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctgggtggaatcgtgggggaggcttggtcaagccgtgggagggtccctgagactctcctgtgcagcctctggattcaccttcagtggctacttcatgagctggactccgccaggcctccggaggggaggggctgcgaggtggtctccacatattagtgacttaagtgggggaacaaccactatttcgacgcacgacttcgtaggtaggaaacggggccctattcctcccaatcccgtccgagggaccaacggacctaaagaaccttcgactgtactctagaacaaagtgaaacctagtacgtaaaaggcgaacccggaaagacccgtaacgggtcccgttacgtaccttcggtgtcggcgtaagggttcgggaggggacggaaggacgttacggg

SEQ ID NO: 421356 - DNA, 495 bp, Homo sapiens
  misc_feature: GZ8MTXP02IXGUO.51.37.D04.1.454.CMB.2.raw
  modified_base (260)..(260): a, c, t, g, unknown or other
  modified_base (339)..(339): a, c, t, g, unknown or other
  modified_base (348)..(348): a, c, t, g, unknown or other
  modified_base (362)..(362): a, c, t, g, unknown or other
  modified_base (369)..(369): a, c, t, g, unknown or other
  modified_base (382)..(382): a, c, t, g, unknown or other
  modified_base (403)..(403): a, c, t, g, unknown or other
  modified_base (411)..(411): a, c, t, g, unknown or other
  modified_base (416)..(416): a, c, t, g, unknown or other
  modified_base (418)..(418): a, c, t, g, unknown or other
  modified_base (420)..(420): a, c, t, g, unknown or other
  modified_base (423)..(423): a, c, t, g, unknown or other
  modified_base (425)..(425): a, c, t, g, unknown or other
  modified_base (427)..(427): a, c, t, g, unknown or other
  modified_base (431)..(431): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccctgagactctcctgtgcagcctcnggattcaccttcagtggctacttcatgagctggatccgccaggctcgaggggagggctgcaggtggtctcacatatagngacttaagnggacaacatatcancagactnagagaggctatcncatcacgagacaacgacaaanactcactntactnananaanananatanaagacgacgaacgacgacgacgtacgtactctgtgcgtaggtaggtaggaggacggtacgtacg

SEQ ID NO: 421357 - DNA, 587 bp, Homo sapiens
  misc_feature: GZ8MTXP02JS8AY.51.37.D04.1.454.CMB.2.raw
  modified_base (344)..(344): a, c, t, g, unknown or other
  modified_base (350)..(350): a, c, t, g, unknown or other
  modified_base (357)..(357): a, c, t, g, unknown or other
  modified_base (548)..(548): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagttgggctgagctgggttttcctgttgctattatagaaggtgtccagtgtcaggtgcagctggtggaatcgtgggggaggcttgggtcaagcctgggagggtccctgagactctcctgtgcagcctctggattcaccttcagtggctactcatgagctggatccgcaggcctccgaggggagggctgcaggtgggtctccgacatattagncttaanggggganaaccatattccacgcaagactcgtgtacggaaagggcccgtaatttccctcctaagtcccttacccggaacggggaccaaaaccgggcccaaaaggaaccttcaaaccgtggtaaactcctaggacctaaatacggaaacctagtacaaaggacgaccgaaaggaccaacggggcccgttagtactttcgngtcggacggtagtcgggacggacggtacggtacgtacgg

SEQ ID NO: 421358 - DNA, 623 bp, Homo sapiens
  misc_feature: GZ8MTXP02GNSSQ.51.37.D04.1.454.CMB.2.raw
  modified_base (265)..(265): a, c, t, g, unknown or other
  modified_base (275)..(275): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtggtttcgtgtagctatatagagtgtcagtgtcaggtgcagctggtggaatcgtgggggagcttggtcaagcctggaggtccctgagactctcctgtgcagcctctggattcaccttnagtgctactnatgagcgtggactcccgcgaggcctacggaggggacgggctggcgtaggtcggtcaccgactattagttagtgtaactaaaggtcggggaaacaaaccacttacttaccgacgactacgtactacgtaggacggaacgggaccgtacttacctcctactaccgtaccgacggaacgaaaccgaaccgaaacgaactactactacgtactacgtagtaactaaacgtaacgaacgtaacgtaacgtaaacgaacgaaccgaaacgaaaccgaaccggtaccgtacgttaccgttacgtacgtaacggtacggtacggtaggtagggtacggtaacggtaacggtaacgg

SEQ ID NO: 421359 - DNA, 551 bp, Homo sapiens
  misc_feature: GZ8MTXP02G6LQH.51.37.D04.1.454.CMB.2.raw
  modified_base (360)..(360): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggagggtccctgagactctcctgtgcagcctctggattcaccttcagtggctactcatgagctggactccgcaggctccgaggggagggctggcaggtggtctccacatattagtgacttaagtggggaanaaccactattcctacgcagtactcaggacgaaggggcctattctccatcctacgaggacaacggccaaagactcacttgtaactctgacaaagtcgaactagtacgtaaagacgaccgaagacccgacggggtccgttacgttaccttcgtgtcgacggtaaggttggagggacgacgggacgttaacggg

SEQ ID NO: 421360 - DNA, 643 bp, Homo sapiens
  misc_feature: GZ8MTXP02IUPEQ.51.37.D04.1.454.CMB.2.raw
  modified_base (259)..(259): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggaggtccctgagctctcctgtgcagcctnggacttcaccttcagtgctacttcatgagctggactccgccaggcctccggaggggacgggctggcgtaggtcggggtcctaccgactagttagttagtgacttaaagtcgggggaacaaaccgactatttccaacggcaagtacctcgtaggaacggaaacggggccctaatttcccaccacttcccgaccgaaggggaacccaaaccgaccaaaagaaccttcaacgttagtactccgtagaactaaaagtacgaaactaacgtaacgtaaaggaacgacccggaaaacggacccgaaccgggtcccgttagttaaccgttcgtagggtcggaccgtaagggttcggggtaggggaaacggtacgggtaacggttaacgggg

SEQ ID NO: 421361 - DNA, 509 bp, Homo sapiens
  misc_feature: GZ8MTXP02IXQ80.51.37.D04.1.454.CMB.2.raw
  modified_base (363)..(363): a, c, t, g, unknown or other
  modified_base (394)..(394): a, c, t, g, unknown or other
  modified_base (401)..(401): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggagggtccctgagactctcctgtgcagcctctggattcaccttcagtggctacttcatgagctggatcccgcaggctccgaggggagggctgcagtgggtctcacatatagtgactaagtggggaacaaccanattcacgcagactctagagaacgggcattcnccatccncaggacaacgccaagaactcactgatctgacaaatgaacagtcaaagagaccgaaagcgaacggcctgtaaccttgtagtgcgtaggtcggtgggagacggactacgg

SEQ ID NO: 421362 - DNA, 526 bp, Homo sapiens
  misc_feature: GZ8MTXP02HMTWG.51.37.D04.1.454.CMB.2.raw
  modified_base (349)..(349): a, c, t, g, unknown or other
  modified_base (356)..(356): a, c, t, g, unknown or other
  modified_base (362)..(362): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccctgagactctcctgtgcagcctctggattcaccttcagtggctacttcatgagctggatccgccaggctccgaggggagggctgcagtgggtctccgacatattagtgctaanggggaanaaaccnctattcacgcagactctgagaacggggcctattcctccatcctcgagggacaacgccaaagactcactgtactctagacaaatcgaactagtactaaagacgaccgaaagacgacggccgtgtaccttcgtagtgcgtagtggtagggagacggtactaacggg

SEQ ID NO: 421363 - DNA, 497 bp, Homo sapiens
  misc_feature: GZ8MTXP02GE9VD.51.37.D04.1.454.CMB.2.raw
  modified_base (331)..(331): a, c, t, g, unknown or other
  modified_base (342)..(342): a, c, t, g, unknown or other
  modified_base (355)..(355): a, c, t, g, unknown or other
  modified_base (361)..(361): a, c, t, g, unknown or other
  modified_base (369)..(369): a, c, t, g, unknown or other
  modified_base (376)..(376): a, c, t, g, unknown or other
  modified_base (390)..(390): a, c, t, g, unknown or other
  modified_base (395)..(395): a, c, t, g, unknown or other
  modified_base (408)..(408): a, c, t, g, unknown or other
  modified_base (412)..(412): a, c, t, g, unknown or other
  modified_base (415)..(415): a, c, t, g, unknown or other
  modified_base (418)..(418): a, c, t, g, unknown or other
  modified_base (428)..(428): a, c, t, g, unknown or other
  modified_base (469)..(469): a, c, t, g, unknown or other
  modified_base (480)..(480): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccctgagactctcctgtgcagcctctggattcaccttcagtggctacttcatgagctggactccgccaggctccgaggggagggctgcaggtggtcncacatattagngactaatgggganaaccanattcacgnagactcngagaagggcattcncatcncgagacacgcaanactnatntanctgactaaangacagtacaagacgaccgaagacgacggcgtagtactgtgngcgaggtcggnggaagacggacgtacgg

SEQ ID NO: 421364 - DNA, 537 bp, Homo sapiens
  misc_feature: GZ8MTXP02IGL82.51.37.D04.1.454.CMB.2.raw
  modified_base (262)..(262): a, c, t, g, unknown or other
  modified_base (375)..(375): a, c, t, g, unknown or other
  modified_base (389)..(389): a, c, t, g, unknown or other
  modified_base (395)..(395): a, c, t, g, unknown or other
  modified_base (489)..(489): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctgggtggaatcgtgggggaggcttggtcaagcctgggagggtccctgagactctcctgtgcagcctntggattcaccttcagtgctacttcatgagctggatccgcaggctcgaggggagggctgcagtggtctcacatatagtgactaagtggggacaaccactattccacgcagactngagagggccattcnccatcncgaggacaacgccaaagaactcactgtactcgtagacaaatcgaactagtactaagacgaccgaaagaccgtacgggccgttagtaccgttcgnggttcgacgtaggttcgggtaggggacggtacgggtaccgtaacgggg

SEQ ID NO: 421365 - DNA, 571 bp, Homo sapiens
  misc_feature: GZ8MTXP02I9AO9.51.37.D04.1.454.CMB.2.raw
  modified_base (333)..(333): a, c, t, g, unknown or other
  modified_base (356)..(356): a, c, t, g, unknown or other
  modified_base (362)..(362): a, c, t, g, unknown or other
  modified_base (441)..(441): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccctgagactctcctgtgcagcctctggattcaccttcagtgctacttcatgagctggatcccgcaggctccgaggggagggctgcaggtggtctccanatattagtgacttaagtgggganaaccanattctaacgcagactcgtaggagaacgggcctattcctccatcctaccgagggacaacggccaaagaactcacttgtanctagacaaagtcgaacagtacgtaaaacgacggacccgaaaggaccgaaccgggtcccgttagtaaccgtttcgtaggtcggtacggtaggttcgggtagggggaacggtaacgggaccgttaacggggg

SEQ ID NO: 421366 - DNA, 542 bp, Homo sapiens
  misc_feature: GZ8MTXP02H4SGZ.51.37.D04.1.454.CMB.2.raw
  modified_base (264)..(264): a, c, t, g, unknown or other
  modified_base (346)..(346): a, c, t, g, unknown or other
  modified_base (383)..(383): a, c, t, g, unknown or other
  modified_base (401)..(401): a, c, t, g, unknown or other
tcagcgatcgtatacacgaccggtgctcgatttagtagcatactgttgagctctgggagaagagcccccagtcccagaattcccaggagtttccattcggtgatcagcactgaacacagaggactcaccatggagtttgggctgagcttgggttttccttgttgctattatagaaggtgtccagtgtcaggtgcagctgggtggaatcgtgggggagcttggtcaagcctgggacgggtccctgagactctcctgtgcagcctntggattcaccttcagtggctacttcatgagctggatcccgcaggctccgaggggagggctgcaggtggtctcacatattagnacttaagtggggaacaaccactattcacgcagactcngtgaacggtccgattccncatccgtaccgacgggacaacgccaaagacctcactgtactcgtagactaaatcgaaactagtactaagacgaccgaaaggaccgacggccgttatacttcgtggtgacggaggtcgggtagggagacggtacgtaacggg

SEQ ID NO: 421367 - DNA, 524 bp, Homo sapiens
  misc_feature: GZ8MTXP02FLU3S.51.37.D04.1.454.CMB.2.raw
  modified_base (261)..(261): a, c, t, g, unknown or other
  modified_base (330)..(330): a, c, t, g, unknown or other
  modified_base (341)..(341): a, c, t, g, unknown or other
  modified_base (400)..(400): a, c, t, g, unknown or other
  modified_base (407)..(407): a, c, t, g, unknown or other
  modified_base (508)..(508): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagccctntggattcaccttcagtgctactcatgagctggactccgcaggctccgaggggagggctgcaggtggtcnccacatatagngactaagtggggacaaccatacttcaacgcagtactcgtagaggaaacgggctaattcnccatccncaagggaccaaacgccaaaagactcactgtaatccgtgacaaatgaacagtcaaaagcgaccgaaagcgacggccgtgttactcgtgtcgacggtagtggnggagacggactacggg

SEQ ID NO: 421368 - DNA, 689 bp, Homo sapiens
  misc_feature: GZ8MTXP02FRL79.51.37.D04.1.454.CMB.2.raw
  modified_base (263)..(263): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagccgtgggacgggtccctgagactctcctgtgcagcctntgattcaccttcagtgctacttcatgagctggactccgcaggcctacggaggggaaggggctggcaggtcgggtctaccgactattagtttaggtcgacgttaaaggtcgggggaaacaaaccctactacgtttaccgtaacggacaacggtaaccttccgtaaggaaagggaaaccgggggtccctaatttcccaccctaacttcccgtaccgaacggggaaaccaaacccggacccaaaagtaaccctacgtaaccgtttagtaattcctaaggaacctaaaagttcgaaaaccgtaacgttaccgaaaaggaaccggaaacccggaaaggaacccgaccgggtaccgtttacgttaccgttcgtgggtaacgacggtaaggttcggggtagggggaacggaacgggtacccgtttaaacgggg

SEQ ID NO: 421369 - DNA, 536 bp, Homo sapiens
  misc_feature: GZ8MTXP02JFQ2H.51.37.D04.1.454.CMB.2.raw
  modified_base (464)..(464): a, c, t, g, unknown or other
  modified_base (503)..(503): a, c, t, g, unknown or other
  modified_base (523)..(523): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggaggtccccagactctcctgtgcagcctctggattcaccttcagtggctacttcatgagctggactccgcaggctcgagggagggctgcagtggtctcgacatattagtgcttaagtgggacgaaccactagttcctacgcagaccttcgtggtacgaaggggcccgtatttccgtcccattcctaccgagggaccaacggaccaaagaacctcactgtatctagcaaatgaaacngtactaaagcgaccgaagaccgacggcctagtacctcgngtgcgtagtcggacgggganacggactacggag

SEQ ID NO: 421370 - DNA, 547 bp, Homo sapiens
  misc_feature: GZ8MTXP02GNH5F.51.37.D04.1.454.CMB.2.raw
  modified_base (355)..(355): a, c, t, g, unknown or other
  modified_base (362)..(362): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagcctctggattcaccttcagtggctacttcatgagctggatccgcaggctccgagggagggctgcagtggtctccacatattagtgactaagtggggaanaacccanattctacgcagactcaggagaacgggccaattccaccatcctaccgagggacaaaccgaccaaagtaactcactgtaatctagacaaaagtcgaaacagttaccaaaaggacgacccgaaaagtccgaacggtccgtagtacctttcaggtcgacggagtggtagggagaacggacgttaacggg

SEQ ID NO: 421371 - DNA, 516 bp, Homo sapiens
  misc_feature: GZ8MTXP02JZL36.51.37.D04.1.454.CMB.2.raw
  modified_base (354)..(354): a, c, t, g, unknown or other
  modified_base (390)..(390): a, c, t, g, unknown or other
  modified_base (395)..(395): a, c, t, g, unknown or other
  modified_base (421)..(421): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagagtgtccagtgtcaggtgcagctggtggaatcgtgggggagcttggtcaagcctggagggtccctgagactctcctgtgcagcctctggattcaccttcagtggctacttcatgagctggatccgccaggctccgaggggagggctgcagtgggtctccgacatattagtgactaagtgggganaacccacattcacgcagactctgagaaggccattcncatcncaggacaacgcaagactcatgtatcngacaaatgaaactagtacaaagacgaccgaaagaccgaacggccgtagtaccttcgtggtcgcggtagtcggtagggagtacggaccttaacggg

SEQ ID NO: 421372 - DNA, 580 bp, Homo sapiens
  misc_feature: GZ8MTXP02IHPW1.51.37.D04.1.454.CMB.2.raw
  modified_base (246)..(246): a, c, t, g, unknown or other
  modified_base (249)..(249): a, c, t, g, unknown or other
  modified_base (251)..(251): a, c, t, g, unknown or other
  modified_base (274)..(274): a, c, t, g, unknown or other
  modified_base (276)..(276): a, c, t, g, unknown or other
  modified_base (279)..(279): a, c, t, g, unknown or other
  modified_base (281)..(281): a, c, t, g, unknown or other
  modified_base (283)..(283): a, c, t, g, unknown or other
  modified_base (308)..(308): a, c, t, g, unknown or other
  modified_base (310)..(310): a, c, t, g, unknown or other
  modified_base (312)..(312): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtggtttcgtgtagctatatagagtgtcagtgtcaggtgcagctggtggaatcgtgggggagcgttggtcaagcctgggagggtccctgagctctcctgngcncnctctgtctctctctgtgtctctntntgngngngcgcgcgcgcgacggagggaggcgngngngtcggtctctatatagtagtagtagtagtggaacgaaactactactacgtacgacacgtacgtcgtaggtacggtacggtacgtcttctacctacgtaccgtaccggacgaaccgaaccgaaccgaaacgtaactacgtacgtacgtactactacgtaactaacgtaacgaacgtaacgtaacgaacgacggaacgaacgacgtaccgtaccgtacgtacgttcgtcgtcggtcggtacggtaggtaggtacggacggtacggtacgg

SEQ ID NO: 421373 - DNA, 522 bp, Homo sapiens
  misc_feature: GZ8MTXP02GFC1H.51.37.D04.1.454.CMB.2.raw
  modified_base (330)..(330): a, c, t, g, unknown or other
  modified_base (333)..(333): a, c, t, g, unknown or other
  modified_base (341)..(341): a, c, t, g, unknown or other
  modified_base (356)..(356): a, c, t, g, unknown or other
  modified_base (377)..(377): a, c, t, g, unknown or other
  modified_base (391)..(391): a, c, t, g, unknown or other
  modified_base (396)..(396): a, c, t, g, unknown or other
  modified_base (425)..(425): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccctgagctctcctgtgcagcctctggattcaccttcagtggctacttcatgagctggactccgccaggcctccgaggggagggctgcagtggtcncanatattagngactaagtggggaanaacccatattcacgcagactnagagacggcattcncatcncgaggacaacgccaaagactcactgtacnctagactaaatgaactagtacaaagacgaccgaaagaccgaccggtccgtagtaccttcgaggtgcgaaggttcggagggaagacggacgtaacggg

SEQ ID NO: 421374 - DNA, 582 bp, Homo sapiens
  misc_feature: GZ8MTXP02JR1SH.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggaggtccctgagactctcctgtgcagcctctggattcaccttcagtggctacttcatgagctggactccgccaggctccgaggggagggctggcaggtcgggtctaccgactatattagtgacttaagtggggaacaaccactattcacgcaagacctgtaggacggaacgggcccgtattcctacccatccgtaccgaaggggaccaaaccggaccaaagaccttacacttagtaactccgtgaactaaagtcgaaactagtaacgaaagacggaccggaaagaccggacgggtccgttagttaccgttcgtaggtcgacggtacggtggaggggaggacggtacgtacggg

SEQ ID NO: 421375 - DNA, 576 bp, Homo sapiens
  misc_feature: GZ8MTXP02GJ31Q.51.37.D04.1.454.CMB.2.raw
  modified_base (260)..(260): a, c, t, g, unknown or other
  modified_base (327)..(327): a, c, t, g, unknown or other
  modified_base (331)..(331): a, c, t, g, unknown or other
  modified_base (337)..(337): a, c, t, g, unknown or other
  modified_base (352)..(352): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctgggtggaatcgtgggggagcttggcaagcctgggaggtccctgagactctcctgtgcagcctntggattcaccttcagtgctacttcatgagctggactccgcaggctcgaggggaggctgcagtggtcncacntatagngactaagtggggaanaaccatattccacgcagactcgtagagacgggcctatttccgccatccgtaccgaacgggaccaaaccgaccaaaagacctacgacttggtaactccgtagaacaaaagtcgaaactagttacaaaaggacgaccggaaagaccgaccgggtaccgttcgtaaccttcgtaggtaacgtcggtaaggtcgggtaggggaaacggtacgggtaaccgtaacgggg

SEQ ID NO: 421376 - DNA, 601 bp, Homo sapiens
  misc_feature: GZ8MTXP02G7MBN.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagtcttgggtcaagcctgggacgggtccctgagactctccgtgtgcagcctctggacttcaccttcagtgcttactcatgagctggactcccgcaggctaccggaggggagggctgcgtaggtggtctaccgacattagttagtgactaagtgggaacaaccatattccgacgcagactcgtagaaggaacgggcctaatttccaccatccgaccgagggaaccaaacggaccaaacgtaacttcacgtgtaactcgtagaacaaagtcgaaaccgtagttacaaaacggacggacccgaaagaaccggtaccggtaccgttagtaacctttcggtggtaacggcggtaaggtcggggaaggggtaacggaacgggtaacggtaacggg

SEQ ID NO: 421377 - DNA, 584 bp, Homo sapiens
  misc_feature: GZ8MTXP02I0L68.51.37.D04.1.454.CMB.2.raw
  modified_base (260)..(260): a, c, t, g, unknown or other
  modified_base (542)..(542): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagcctntggattcaccttcagtgctacttcatgagctggactccgccaggcctccgaggggacggggctggctaggtgggtctaccgacattattaggtgacttaagtgggggaacaaacccactattctacgacagacctcgtggaaggaacggggccgtaattcctaccaattcccgtaccgaaggggaaccaaaccggaccaaaacgacctcaacgttgtaactcctagacaaagtcgaaacagtactaagacgacgaaagacgaaccggtcctagtaccttcgnggtcgacggtagttacgggagggacggacggtacgtacgggg

SEQ ID NO: 421378 - DNA, 672 bp, Homo sapiens
  misc_feature: GZ8MTXP02G1T82.51.37.D04.1.454.CMB.2.raw
  modified_base (330)..(330): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagcctctggattcaccttcagtgctactcatgagctggatcccgcaggctccgaggggagggctgcaggtgggtcnccgacatatagtgactaagtgggggaacaaaccactatttccgacggcaagactcgtaggaacggaacggggccgtaatttcctacccgattcccgacccgaagggggaacccaaaaccgggacccaaaaggtaacccttaccgaacttacggttaactccgttaaggaacctaaaagttacgaaaaccgtaggttaaacctaaaacgggaaccgaacccggaaaacggacccggtaaccggggtacccggtttacggttaaccctttccggtggttaacgggaccggtacgggttacggggtacgggggaaggtaacgggggtaacccgtttaaacggggg

SEQ ID NO: 421379 - DNA, 519 bp, Homo sapiens
  misc_feature: GZ8MTXP02GIYNR.51.37.D04.1.454.CMB.2.raw
  modified_base (330)..(330): a, c, t, g, unknown or other
  modified_base (341)..(341): a, c, t, g, unknown or other
  modified_base (355)..(355): a, c, t, g, unknown or other
  modified_base (361)..(361): a, c, t, g, unknown or other
  modified_base (392)..(392): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagcctctggattcaccttcagtggctacttcatgagctggatccgcaggctccgaggggagggctgcaggtggtcncacatattagngactaagtgggganaaccanattcacgcagactctgtgaagggccattccnccatctcagggacaaacgccaaagactcactgtatctagacaaatcgaaactagtactaaagcgaccgaaagtacgaccggcctcgtacttcgtagtgcgaggtggtgggagtacgggactaacggg

SEQ ID NO: 421380 - DNA, 554 bp, Homo sapiens
  misc_feature: GZ8MTXP02FMQ2B.51.37.D04.1.454.CMB.2.raw
  modified_base (261)..(261): a, c, t, g, unknown or other
  modified_base (290)..(290): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggagggtccctgagactctcctgtgcagcctntggattcaccttcagtgctacttcatganctggactccgcaggctccgaggggagggctggcaggtggtctccacatattagtgactaagtggggaacaaccagtacttcaacgcagtactcgtaggaggtaacggccgtattcgccctatccgtaccgaggaaccaaaccggaccaaagactcactagtactctagacaaagtacaaacgacgtactaaaaggacgaccgaaagaccgaccggcgttactacgttcgagtgacgtagtcgggtaggacgacgggactacggg

SEQ ID NO: 421381 - DNA, 576 bp, Homo sapiens
  misc_feature: GZ8MTXP02HP6LJ.51.37.D04.1.454.CMB.2.raw
  modified_base (250)..(250): a, c, t, g, unknown or other
  modified_base (261)..(261): a, c, t, g, unknown or other
  modified_base (273)..(273): a, c, t, g, unknown or other
  modified_base (362)..(362): a, c, t, g, unknown or other
  modified_base (369)..(369): a, c, t, g, unknown or other
  modified_base (386)..(386): a, c, t, g, unknown or other
  modified_base (414)..(414): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctccngtgcagcctcnggattcaccttnagtggctacttcatgagctggactcccgccgaggcctccgaggggaaggggctggctaggtgggtctccatattattagtgacttaagnggggaanaacccatatttccacgnacgactcgtggtgaagggccctattccnccatcctaccgagggaaccacggaccaaagacctcacgttgtactctagactaaagtcgaaactagtaactaaaggacgtacccggaaagaccgtaaccgggccgttacgtaactttccgtggtaacgcggtacggtggagggtacgacgggtactacgggg

SEQ ID NO: 421382 - DNA, 578 bp, Homo sapiens
  misc_feature: GZ8MTXP02HWRM4.51.37.D04.1.454.CMB.2.raw
  modified_base (345)..(345): a, c, t, g, unknown or other
  modified_base (359)..(359): a, c, t, g, unknown or other
  modified_base (365)..(365): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggcaagcctgggagggtccctgagactctcctgtgcagcctctggattcaccttcagtgctacttcatgagctggactccgccaggctccgaggggagggctgcaggtggtctcgacattattagtnactaagtggggaanaaaccncactttcgacgctagactcgtaggaagaacggggtcctaatttccctacctaattcccgtaccgaaggggaaccaaaccggccaaaagtaacccttcaacgtggtaacctgtagaaccaaagtcgaaactagtactaaaggacgaccgaaagaccgacgggtaccttgtaccttgtggtaagacgaggttggagggagacggtacgtaacggg

SEQ ID NO: 421383 - DNA, 665 bp, Homo sapiens
  misc_feature: GZ8MTXP02ILRV8.51.37.D04.1.454.CMB.2.raw
  modified_base (290)..(290): a, c, t, g, unknown or other
  modified_base (361)..(361): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagcctctggattcaccttcagtggctacttcatganctggactccgcaggctccgaggggagggctggcgagtgggtctcacattatagtgacttaagtgggggaanaaaccactaatttcccgtaacgaccgtaaggaccttcgtaggtacgggaaacggggcccgttaaatttccgtaccctattcccgtacccggaaagggggaaccctaaaaccggaccccgaaaaggtaaacccttaccgaaccgtttaggttaaacctcgttaggaacctaaaaagtcggtaaaaactacgtaaaccgtaaaaggacggacccggaaaagaccgtaaaccgggtccgtttacgttaacctttcggtggtcggtacggtaggttcgggtaggggacgaacgggtacgttaacgggg

SEQ ID NO: 421384 - DNA, 511 bp, Homo sapiens
  misc_feature: GZ8MTXP02JRUL0.51.37.D04.1.454.CMB.2.raw
  modified_base (240)..(240): a, c, t, g, unknown or other
  modified_base (359)..(359): a, c, t, g, unknown or other
  modified_base (406)..(406): a, c, t, g, unknown or other
  modified_base (410)..(410): a, c, t, g, unknown or other
  modified_base (446)..(446): a, c, t, g, unknown or other
tcagcgatcgtatacacgaccggtgctcgatttagtagcatactgttgggtttggggtgggtccaggaggcagaactctgggtgtctcaccatggcctggatccctctacttctccccctcctcactctctgcacaggctctgaggcctcctatgagctgacacagccagcctcggtgtcagtgtccccaggacagacggccaagatcccctgctctggagatgcattgaccaaaacgtntttgctttttaggtacaacagaagccagccaggcccctataataattatatataaagacagtgagaggccctcgagggatcccgtgagcgattctctggccctccagctcaggacaacngccagttgacgattagtgagtccaggcagagacgagctgactatacngtanaatcagcagacgacagtgtactagtgatagttcggngaggtaccgaaggtcgaaccgtcgtaggtcacgcccaaggctcgccccctgcactctcgtacccc

SEQ ID NO: 421385 - DNA, 512 bp, Homo sapiens
  misc_feature: GZ8MTXP02F33AW.51.37.D04.1.454.CMB.2.raw
  modified_base (354)..(354): a, c, t, g, unknown or other
  modified_base (393)..(393): a, c, t, g, unknown or other
  modified_base (398)..(398): a, c, t, g, unknown or other
  modified_base (463)..(463): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccctgagactctcctgtgcagcctctggattcacttcagtgctacttcatgagctggatccgcaggctccgaggggagggctgcagtggtctcgacatattagtgacttaagtggggaanaacccatattcacgcagactcgtagtgaagggccattcncatcnccagggacaacgccaaagaactcaactgtaatcgtagacaaatgaacagtacaagacgacgaaanacgacggccgtagtacctcgtagtgcgagtcggtggagacggactacgg

SEQ ID NO: 421386 - DNA, 648 bp, Homo sapiens
  misc_feature: GZ8MTXP02GWB8W.51.37.D04.1.454.CMB.2.raw
  modified_base (273)..(273): a, c, t, g, unknown or other
  modified_base (288)..(288): a, c, t, g, unknown or other
  modified_base (499)..(499): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagcctctggattcaccttnagtgctactcatganctggactccgccaggcctccggaggggaaggggctggcgaggtggtcacacgtattagttagtgacttaagtgggggaacaaacccatactttaccaacggaccaaggaccttcgtagggaacggaaacgggggccctaatttccgtacccaagttcccaccggaacggggaaccaaaccggcccaaaagaaccttccgaacttggtaacnccgtagaacctaaaagtacggaaaacctaagggttaacaaaacggaacgtacccggaaaaggaccgaaccggggtcccgttagttacccttgtggtaacggcggtaagggttcgggtaggggaaaggtacgggtaacccgttaacgggg

SEQ ID NO: 421387 - DNA, 746 bp, Homo sapiens
  misc_feature: GZ8MTXP02ISF0R.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcgttggcaagccgtgggacgggtccctgagctctcctgtgcagcctctggattcaccttcagtgctacttcatgagctggactcccgaccgaggcctccggaggggaggggctggctaggtcggggtcctaccgactattaagttaggtgaccgttaaagtcgggggaaacaaaccctactacgtttaccaccgacagtaaccttcgtaggaacggaaacgggggtccctaactttaccctacccgtaacttcccgtaacccggaacgggggaaacccaaaacccgggacccaaaacggtaaacccttacgaacccgtttaggttaacctacgttacggaaactaaaacggtacgtaaaaccgtacgttaacggtaaaacggaccggaaaaccccggtaaaacgggaaacccgtaacccgggggtaccgtttaccgggttaaaccttttccggtggggttaaccggtacgggtaaggggtttacgggggaacgggggtaaacggtaacgggggtaaaccgtttaaccggggg

SEQ ID NO: 421388 - DNA, 750 bp, Homo sapiens
  misc_feature: GZ8MTXP02J1QL3.51.37.D04.1.454.CMB.2.raw
  modified_base (289)..(289): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttctttgttgctattatagaaggtgtccagtgtcaggtgcagctggtggaatcgtgggggagcttggtcaagcctgggagggtccctgagactctcctgtgcagcctctggattcaccttcagtgctacttcatganctggactccgcaggctccgaggggagggctgcgagtggtctccacatagttagtgacttaagtgggggaacaaacccgatattccgtaacgcagtacctcgtaggaacgggaaacggggcccgtaatttcccgtacccaacgttcccgtacccggaaacgggggtaaacccaaaacccgggaaccccaaaacggtaaacccttaccgtaaaccgtttacgggttaaaccttccgtacggtaaaccctaaaaagttcggaaaaccgtaacggttaaacccgttaaaacgggaacccgggtaaaccccgggaaaacgggaaacccccggtaaacccgggggttaccccggtttaacggtttaaaccccgttttccggttaacggggttcgggacccgggtaaacggggtttcgggggttaacggggggaacggtaaacgggggtaaccgtttaaacccggggg

SEQ ID NO: 421389 - DNA, 527 bp, Homo sapiens
  misc_feature: GZ8MTXP02GCINT.51.37.D04.1.454.CMB.2.raw
  modified_base (241)..(241): a, c, t, g, unknown or other
  modified_base (315)..(315): a, c, t, g, unknown or other
  modified_base (358)..(358): a, c, t, g, unknown or other
  modified_base (376)..(376): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcctcactctctgcacaggctctgaggcctcctatgagctgacacagccagcctcggtgtcagtgtccccaggacagacggccaagatcccctgctctggagatgcattgaccaaaacgtntttgctttttggtaccaacagaagccaggccaggcccctataataattatatataaagacagtgagaggccctnagggatccctgagcgattctctggcctccagctcaggacaacngccacgttgacgattagnggatccaggcagaagacgagctgactatactgtcaaatcagcagacgacgagtggtacttagtggatagttcgggcggaaggaccaagggtgaccgttcgtacgggtcacgcccaaggctacgccccgtcggtccacgtctcgttaccccc

SEQ ID NO: 421390 - DNA, 575 bp, Homo sapiens
  misc_feature: GZ8MTXP02IN3H3.51.37.D04.1.454.CMB.2.raw
  modified_base (355)..(355): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagcctctggattcaccttcagtggctacttcatgagctggatcccgccaggcctccgaggggagggctgcaggtgggtctcacatattagtgacttaaagngggggaacaaacccactacttcctaacgcagactctaggaaggaacgggggccctattctaccctatcctacccgagggaccaacggacccaaagaaccctcaacttgtaatccgtagacaaagtacgaaactagtactaagacgacccgaaaagccggaaccggtcgtacgttaccttcgtgtaagcgtaggtggtacgggacggtaggacgtaacggg

SEQ ID NO: 421391 - DNA, 530 bp, Homo sapiens
  misc_feature: GZ8MTXP02HH3IR.51.37.D04.1.454.CMB.2.raw
  modified_base (397)..(397): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagcctctggattcaccttcagtggctacttcatgagctggactccgccaggctccgaggggagggctgcaggtggtctcacatattagtgactaagtggggaacaaccactattccacgcagactctagagaagggccattcnccatcctaccgaggacaacgaccaaagaactcactgtatctgacaaatgaactagtactaaagagtacgaaagacgacggtccgtagttacgttctgtcggacgtaggtggtagggagacgggtacgtacggg

SEQ ID NO: 421392 - DNA, 532 bp, Homo sapiens
  misc_feature: GZ8MTXP02H79HE.51.37.D04.1.454.CMB.2.raw
  modified_base (351)..(351): a, c, t, g, unknown or other
  modified_base (383)..(383): a, c, t, g, unknown or other
  modified_base (400)..(400): a, c, t, g, unknown or other
  modified_base (407)..(407): a, c, t, g, unknown or other
  modified_base (430)..(430): a, c, t, g, unknown or other
  modified_base (434)..(434): a, c, t, g, unknown or other
  modified_base (437)..(437): a, c, t, g, unknown or other
  modified_base (447)..(447): a, c, t, g, unknown or other
  modified_base (453)..(453): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggagggtccctgagctctcctgtgcagcctctggattccaccttcagtggctacttcatgagctggatcccgcaggcctccgaggggagggctgcaggtggctcacatatagtgacttaagngggaacaaaccactattcacgcaagacttcgngaggacgggccattccnccatccnccgaggacaacgccaaagacctnactntanctagacaaangaaacngtacgaaagcgaccgaagacgacggcgtacgtacttcgtaggtgcggtaggtcggtaggggacgaagggtactaacggg

SEQ ID NO: 421393 - DNA, 593 bp, Homo sapiens
  misc_feature: GZ8MTXP02H9ZPM.51.37.D04.1.454.CMB.2.raw
  modified_base (260)..(260): a, c, t, g, unknown or other
  modified_base (359)..(359): a, c, t, g, unknown or other
  modified_base (551)..(551): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaaggtgtccagtgtcaggtgcagctggtggaatcgtgggggagcttggtcaagcctgggagggtccctgagactctcctgtgcagcctcnggattcaccttcagtgctacttcatgagctggactccgcaggctccgaggggagggctgcaggtgggtctaccgacattatagtgactaagtggggaanaaacccactattcctaacgcaacgacttcgtagaaggaacggggccctatttccgacctaacgtcctacccggaggggaacccaaaccggacccaaagaaccttcgaacttgtaactcgtagacaaaatcgaaaactagtactaaaggacgaaccggaaagaaccgaccgggtaccgttacgtacgtttccnggtcgcggaagttcgggtagggaaggtacggacgtaacgggg

SEQ ID NO: 421394 - DNA, 517 bp, Homo sapiens
  misc_feature: GZ8MTXP02GL5Z9.51.37.D04.1.454.CMB.2.raw
  modified_base (327)..(327): a, c, t, g, unknown or other
  modified_base (354)..(354): a, c, t, g, unknown or other
  modified_base (393)..(393): a, c, t, g, unknown or other
  modified_base (419)..(419): a, c, t, g, unknown or other
  modified_base (426)..(426): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatctgggggagcttggtcaagcctggagggtccctgagactctcctgtgcagcctctggattcaccttcagtgctacttcatgagctggatccgcaggctccgagggaggggctgcagtgggtcncgacatattagtgactaagtggggaanaaccactattcacgcagactcgtagagaagggcgattcnccatctcgaggacaacgcaaagactnactgtanctgacaaatcgaacagtactaagacgaccgaaagaccgacggccgtcgtacttcgtagtcgcggaggtcggtagggacgaggacgtacggg

SEQ ID NO: 421395 - DNA, 634 bp, Homo sapiens
  misc_feature: GZ8MTXP02I1AYG.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggacgggtccctgagctctcctgtgcagcctctggattcaccttcagtggctacttcatgagctggactccgccaggctccgaggggagggctgcaggtggtctcgacatattagtgactaagtggggaacaaaccactattcacgcaagacctcgtaggaacggaacggggtccctatttcctacccattcccgtacccggaaggggaacccaaaccgggaccctaaaaggaaacccttacgaacttacggttaatcccgttagaacctaaaagtacggaaaacctaaggttaacgaaaacggaaccgaccggaaaacggacccggaaaccgggtcccgttagttaaccttcgtaggtcggacggtaggtagggtacggggaaggtacgggtaaccgtaacgggg

SEQ ID NO: 421396 - DNA, 568 bp, Homo sapiens
  misc_feature: GZ8MTXP02IJRPJ.51.37.D04.1.454.CMB.2.raw
  modified_base (259)..(259): a, c, t, g, unknown or other
  modified_base (264)..(264): a, c, t, g, unknown or other
  modified_base (276)..(276): a, c, t, g, unknown or other
  modified_base (345)..(345): a, c, t, g, unknown or other
  modified_base (409)..(409): a, c, t, g, unknown or other
  modified_base (459)..(459): a, c, t, g, unknown or other
tcagcgatcgtatacacgaccggtgctcgatttagtagcatactgttgagctctgggagaagagcccccagtcccagaattcccaggagtttccattcggtgatcagcactgaacacagaggactcaccatggagtttgggctgagcttgggttttccttgttgcttattatagaaggtgtccagtgtcaggtgcagctggtggaatcgtgggggagcttggtcaagcctggacgggtccctgagactctcctgtcgcngcctntgattcaccttnagtgctactcatgagcgtgactcccgcgaggcctaccgaggggacgggctggcaggtcggtcctcactnttagttagcgtacgtaagtggggaacaaccctatattacagcagactcgagagacggctattcnccatcgacgaggacaacgaccaaagactcacgtgtactcgtagaactaanacgaactaagtacgtaaacggacgaaccggaaagtaccgaaccggtcccgttgttaacccttgtaggcgtacggtaggtcgggtaagggacgtaacggtacgtaacggg

SEQ ID NO: 421397 - DNA, 675 bp, Homo sapiens
  misc_feature: GZ8MTXP02IQCC1.51.37.D04.1.454.CMB.2.raw
  modified_base (344)..(344): a, c, t, g, unknown or other
  modified_base (353)..(353): a, c, t, g, unknown or other
  modified_base (359)..(359): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggacgggtccctgacgactctcctgtgcagcctctggattcaccttcagtggctacttcatgagctggactcccgcaggcctcgaggggagggctgcagtggtctcacatattagngacttaagngggganaaccatacttcgacgcagactcgtggtacggaacggggtcccgtaatttccctaccaactttccgacccggaaacgggggaaaccccaaaaccggaacccccaaaaggtaaaccccttaccgtaaccgttaggttaaacctccgttacggaacctaaaaagtacgaaaacccgtaggttaaccaaaaggggaaccgacccggaaaaggacccgaaacgggggtcccgtttacgggtaacctttcggtacggtcgggtaccgggtaaggtttcgggggtaagggggacggtaaacgggggtaaccgttaaacggggg

SEQ ID NO: 421398 - DNA, 674 bp, Homo sapiens
  misc_feature: GZ8MTXP02GEFL3.51.37.D04.1.454.CMB.2.raw
  modified_base (267)..(267): a, c, t, g, unknown or other
  modified_base (339)..(339): a, c, t, g, unknown or other
  modified_base (365)..(365): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtggtttctgtagctatatagagtgtcagtgtcaggtgcagctggtggaatcgtgggggagcttgggtcaagcctgggagggtccctgacgactctcctgtgcagcctgtgattcaccttnagtgctacttcatgagctggactccgccgaggtcctaccggagggggaacgggtctggctaggtcgggttcnccgactattagttagtgacttaaagnggggaaacaaccctatactttacgacgactaaaggtccttagaggaaggaaaccggggtcctaacgtttcctaccgactttacccgaccggaaacggggtaaccccaaaccggaaccctaaaacggtaccctacgtacctttagggtttaaccctaccgtaacgtaaactaaacgtaacgtaacgtaacgtaacgtaaacggtaacggaaccggaaacggaaccggtaccggtaccggttacgttaccgttcgttacggtaacggtacggtacggtacgggtacggggtacggtacgggtacggtacgg

SEQ ID NO: 421399 - DNA, 513 bp, Homo sapiens
  misc_feature: GZ8MTXP02JY8KY.51.37.D04.1.454.CMB.2.raw
  modified_base (170)..(170): a, c, t, g, unknown or other
  modified_base (363)..(363): a, c, t, g, unknown or other
  modified_base (398)..(398): a, c, t, g, unknown or other
  modified_base (403)..(403): a, c, t, g, unknown or other
  modified_base (435)..(435): a, c, t, g, unknown or other
  modified_base (437)..(437): a, c, t, g, unknown or other
  modified_base (440)..(440): a, c, t, g, unknown or other
  modified_base (442)..(442): a, c, t, g, unknown or other
  modified_base (444)..(444): a, c, t, g, unknown or other
  modified_base (449)..(449): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtggtttctgtgctatatagagtntccagtgtcaggtgcagctggtggaatcgtgggggagcttggtcaagccgtgggaggtccctgagactctcctgtgcagcctcgtggattcaccttcagtggctacttcatgagctggactcccgccaggcctccgaggggaggggctaggcgaggtgggtctacgactattattagtgacttaagtgggaanaaccatattcacgcagcctgtgagagggccattcncatcncgaggacacgacctaagactcactgatcgtananaanananagtanaagacgacgacgacgacgacgtacgtctcgtgtgacgtacgtggaggacggacggtacgtacgg

SEQ ID NO: 421400 - DNA, 604 bp, Homo sapiens
  misc_feature: GZ8MTXP02IZ5A9.51.37.D04.1.454.CMB.2.raw
  modified_base (247)..(247): a, c, t, g, unknown or other
  modified_base (263)..(263): a, c, t, g, unknown or other
  modified_base (276)..(276): a, c, t, g, unknown or other
  modified_base (322)..(322): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtggtttcgtgtagctatatagagtgtccagtgtcaggtgcagctggtggaatcgtgggggagcttggtcaagcctggaggtccctgagctctcctgtgcngctgtgtacttcactnagtcgtactactnagtgagcgtgtacgtccgccgacgcgtaccgagggagggcgtgcgnggtggtcgtccactatagtagtgtagtaagtggaacgaacaactactactacgacacgtactacgtagagaacggacgtacgtactacctactaccgtaccgacggaaccgaaaccgaaccgaaacgaactactactacgtactacgtacgaactaaacgtaacgaacgtaacgtaacgtaaacgaacgaacgaaacgaaccgaaccggtaccggtacgttaccgttacgtacgtaacggtacggtacggtacggtagggtacggtacggtaacggtaacgg

SEQ ID NO: 421401 - DNA, 610 bp, Homo sapiens
  misc_feature: GZ8MTXP02GK2RJ.51.37.D04.1.454.CMB.2.raw
  modified_base (241)..(241): a, c, t, g, unknown or other
  modified_base (258)..(258): a, c, t, g, unknown or other
  modified_base (391)..(391): a, c, t, g, unknown or other
tcagcgatcgtatacacgaccggtgctcgatttagtagcatactgttgggtttgggggtgggtccaggaggcagaactctgggtgtctcaccatggcctggatccctctacttctcccctcctcactctctgcacaggctctgaggcctcctatgagctgacacagccagcctcggtgtcagtgtccccaggacagacggccaagactcccctgctctggagatgcattgaccaaaacgtntttgtcttttagacaanagagcagcacgcctataataatatataataagacagtagagacggcctacgaggactcccgtagacgcgtattctcgtcgcccctccgacgctacgacggaacaacgcgacctacggttagacgtagttaggnggacgtaccgaggacgaagaaacgacggagcgtacgaacttaattacgtagtactaaatcgaagacaagaacgaacgtaggtacgttaacgttagtaggtagttaggttcggggacgggaacgggtaaccgaagggtacgtaccgtacgtacggtacgacggacccgaacggtccgtacccggccccgttacggtacctacgttccgttccgttacccc

SEQ ID NO: 421402 - DNA, 575 bp, Homo sapiens
  misc_feature: GZ8MTXP02IW0AZ.51.37.D04.1.454.CMB.2.raw
  modified_base (242)..(242): a, c, t, g, unknown or other
  modified_base (257)..(257): a, c, t, g, unknown or other
  modified_base (287)..(287): a, c, t, g, unknown or other
  modified_base (290)..(290): a, c, t, g, unknown or other
  modified_base (292)..(292): a, c, t, g, unknown or other
  modified_base (295)..(295): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcctcactctctgcacaggctctgaggcctcctatgagctgacacagccagcctcggtgtcagtcgtccccaggacagacggccaagatcccttgctctggagatgcattgaccaaaagttnttgtctttagacaanagacgcagcacgacctataatatatataanaananagngagacgcctgaggactccgagacgcgtattctcgtcgccctaccgagctacgaacggaaccaacgcgaccgtaacgttacgacgtagttacggtaggtacgtaccgagacgaagaacgacggagtactagtaacttagttacgtagtacaatacgaacgacgaagacgagtagttacgttactagtaggtagtaggtcgggacggacggtaacgaggtacgacgtacgtacgacgacgaccgacgccgtccgtcccgtcgtaccacctccgtaccgtccc

SEQ ID NO: 421403 - DNA, 535 bp, Homo sapiens
  misc_feature: GZ8MTXP02J374V.51.37.D04.1.454.CMB.2.raw
  modified_base (366)..(366): a, c, t, g, unknown or other
  modified_base (492)..(492): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaaggcctgggagggtccctgagactctcctgtgcagcctctggattcaccttcagtggctacttcatgagctggactccgcaggctccgaggggagggctgcaggtggtctcactatattagtgacttaagtggggaacaaaccnattcacgcagactcgtagacggaacgggcccattcctccaatcctaccgaggacaaccgtacaaagaactcactgtatctagacaaatagaactagtaccaagacgaccgaagaccgacggccgtnaccttcgaggtgacggagtcgggtaggagacggtacgtacggg

SEQ ID NO: 421404 - DNA, 610 bp, Homo sapiens
  misc_feature: GZ8MTXP02F8JQU.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagccgtgggagggtccctgagactctcctgtgcagcctctggattcaccttcagtggctacttcatgagctggactccgccaggcctccggaggggaacggggctggcgtaggtcggggtctccactatattaggtgtactaagtggggaacaacctactattccacgcagtaccttcgtaggtaggaaacggggccctaatttcccaccctacttccctacccggaacggggacccaaaccggacccaaagaaccctacacttggttaactcgtacgaacaaagtacgaaacagttaccgaaaggacgaccggaaagaccgacgggtccttacgttaccttgtaggtcggacggtaggtcgggtaggggagtacgggacgttacggg

SEQ ID NO: 421405 - DNA, 671 bp, Homo sapiens
  misc_feature: GZ8MTXP02H2VXL.51.37.D04.1.454.CMB.2.raw
  modified_base (191)..(191): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtncagctggtggaatcgtgggggagcttggtcaagcctgggagggtccctgagctctcctgtgcagcctctggattccaccttcagtgctacttcatgagctggactcccggcaggcctccggaggggaggggctggcaggtcggggtctccgactattagttagtgacttaaagtggggaaacaaacccactatttcctaacggcaaggtacccttcgtaggaagggaaacgggggcccgtaatttcccgtacccacgttcccgtaccccggagggggaaacccaaacccggacccaaaacggaaccttaccaaccgttagtaacttctaacgaacctaaaagtcggaaacctagttaccgaaaaggacgaaacccggaaagaaacccgaccggggtacccgttaggttaccctttcggtaggttaacggacggtaacgggttcgggtaagggggacggtaacggggtaaccgtaacgggg

SEQ ID NO: 421406 - DNA, 548 bp, Homo sapiens
  misc_feature: GZ8MTXP02H6DRF.51.37.D04.1.454.CMB.2.raw
  modified_base (345)..(345): a, c, t, g, unknown or other
  modified_base (352)..(352): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggaggcttggtcaagccgtgggacgggtccccgagactctcctgtgcagcctcgtggattcaccttcagtgctactcatgagctggactccgccaggcctcgaggggagggctgcaggtggctcacatattagnactaagngggacaacactattcacgcagactctgtagaagggcctattcctaccatcctcgaacgggacaaacgaccaaagaacctcaattgtatcctagaactaaaatcgaaacagttacaaaaggacgacccgaaagcccgaacggtcccgttagtacttcgtggtcgcgtaggtggaggggaagacggtacctagggacg

SEQ ID NO: 421407 - DNA, 593 bp, Homo sapiens
  misc_feature: GZ8MTXP02H79T7.51.37.D04.1.454.CMB.2.raw
  modified_base (540)..(540): a, c, t, g, unknown or other
  modified_base (563)..(563): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggaggtccctgagctctcctgtgcagcctctggattccaccttcagtggctacttcatgagctggactcccgcaggcctccgaggggacggggctggcgaggtcgggtctccacgtaattagttagtgacttaagtgggggaacaaaccatattcctacgactaagacctcgtggaagggaacgggcccgtatttccctacccaagttcccgacccgaggggaaaccaaaccggacccaaaggaacttaccacttaggtactaccgtagaactaaaagtcgaaacgagttaccaaaggacgacccggaaanacgaccggtcgtacgtaccttgngtgcgtagtggaggacgtacggacgtacgg

SEQ ID NO: 421408 - DNA, 773 bp, Homo sapiens
  misc_feature: GZ8MTXP02HMJ8Z.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagtcttggtcaagccgtgggacgggtccctggacgactctcctgtgcacgcctcgtggacttccaccttcagtcgctacttcatgagcgtggactcccgccgaggcctaccggaggggacgggctggcgaggtcgggtctaccgactaagtttacgttaggtcgtacgttaaggtacgggggaaactaaaccctaacgtacgtttacccgaacgactaacggtaccttcgaaggggaaacggaaacgggggtcccctaagtttaccctaccctaacgttaccccgtaacccggaaacgggggaaacccaaaaccccggaacccgtaaaacgtaaacccctttactaaccgtttaggttaaccttacgtacggaaactaaaacgttcgaaaaccgtacgttaacgaaaacggaaccggaaccccggaaaaggtaaccccgtaaccgggggtaccgtttaacgggtttaacccctttcgggttagggtaacggtaccgggttaaaggggttcgggggaagggggtaaacggtaaccgggggttaacggtttaaacccggggg

SEQ ID NO: 421409 - DNA, 504 bp, Homo sapiens
  misc_feature: GZ8MTXP02J0F97.51.37.D04.1.454.CMB.2.raw
  modified_base (363)..(363): a, c, t, g, unknown or other
  modified_base (369)..(369): a, c, t, g, unknown or other
  modified_base (398)..(398): a, c, t, g, unknown or other
  modified_base (403)..(403): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagcctctggattcaccttcagtggctacttcatgagctggactccgccaggcctccgaggggaggggctggcaggtgggtctcgacatattagtgacttaagtgggganaaccanattcacgcagactcgtgagagggccatcncatcncaggacacgcaagactcactgtatctgacaaatgaacagtacaagacgaccgaagacgacggcgtcgtacttctgcgcgagtggtaggagacggactacgg

SEQ ID NO: 421410 - DNA, 533 bp, Homo sapiens
  misc_feature: GZ8MTXP02FVULE.51.37.D04.1.454.CMB.2.raw
  modified_base (390)..(390): a, c, t, g, unknown or other
  modified_base (416)..(416): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatctgggggaggcttgggtcaagcctggagggtccctgagactctcctgtgcagcctctggattcaccttcagtggctacttcatgagctggatccgcaggctccgaggggagggctgcagtgggtctccacatattagtgctaatggggagaaccacattctacgcagactctgagaaggcgattcnccatctcaggacaacgccaagactanactagtatctgacaaatagaacagtactaaacggagacccggaaagtaccgaaccggccgttacgtaacttccttggtgcggtaaggtggttaggggaggaacggtacgtaaacggg

SEQ ID NO: 421411 - DNA, 594 bp, Homo sapiens
  misc_feature: GZ8MTXP02FYGC3.51.37.D04.1.454.CMB.2.raw
  modified_base (339)..(339): a, c, t, g, unknown or other
  modified_base (352)..(352): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaaggtgtccagtgtcaggtgcagctggtggaatcgtgggggagcttggtcaagcctggagggtccctgagctctcctgtgcagcctctggattcaccttcagtggctacttcatgagctggatccgcaggctccgagggagggctgcagtgggtctccgacatattgtnactaagtgggganaaccatattctaacgcagactcgtggtggaaacggggtccctaagtttcctcctaacttcccgtaccgaaggggaccaaaccggacccgaaaggaaaccctctaacttaggtaactacctaggaacctaaagttacggaaacctagtacgaaaagacgacgaaacgacaccgggaccgttacgtaccttcgtggaacgtcgggtaacgtcggggaggggtaggaacgggtaccgttaacggg

SEQ ID NO: 421412 - DNA, 536 bp, Homo sapiens
  misc_feature: GZ8MTXP02JQKGH.51.37.D04.1.454.CMB.2.raw
  modified_base (342)..(342): a, c, t, g, unknown or other
  modified_base (359)..(359): a, c, t, g, unknown or other
  modified_base (401)..(401): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccctgagactctcctgtgcagcctctggattcaccttcagtggctacttcatgagctggactcccgcaggctccgaggggagggctgcagtggtctcgacatattagngacttaagtgggggaanaaccactattcctacgcagactcgtagagaagggccgattcnccatcctccgaggacaacgaccaaagaactcactgtatctgacaaatagaacagtactaaagacgaccgaaagaccgacggccgtacgtaccttcgtgtcggacgtaggtaggagggtagacggtacgtaacggg

SEQ ID NO: 421413 - DNA, 546 bp, Homo sapiens
  misc_feature: GZ8MTXP02INLS5.51.37.D04.1.454.CMB.2.raw
  modified_base (291)..(291): a, c, t, g, unknown or other
  modified_base (339)..(339): a, c, t, g, unknown or other
  modified_base (403)..(403): a, c, t, g, unknown or other
  modified_base (410)..(410): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcgttggtcaagccgtgggacgggtccctgagactctcctgtgcagcctctggattcaccttcagtgctactcatganctggactccgccaggcctccgaggggagggctggcaggtggtctccanatattagtgacttaagtcggggaacaaccactattcacgcagactcgagagaagggcctattcnccatccncgaggacaacgcaaagactcatgtatctagacaaagtcgaaaactgtaactaaaggacgacccgaaagaccgaaccggtccttagttaccttcgtggtaacgcggtaggttcggaggggagtacggtacgtacggg

SEQ ID NO: 421414 - DNA, 501 bp, Homo sapiens
  misc_feature: GZ8MTXP02FIB71.51.37.D04.1.454.CMB.2.raw
  modified_base (244)..(244): a, c, t, g, unknown or other
  modified_base (350)..(350): a, c, t, g, unknown or other
  modified_base (356)..(356): a, c, t, g, unknown or other
  modified_base (374)..(374): a, c, t, g, unknown or other
  modified_base (386)..(386): a, c, t, g, unknown or other
  modified_base (392)..(392): a, c, t, g, unknown or other
  modified_base (415)..(415): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaaggtgtccagtgtcaggtgcagctggtggaatcgtgggggagcttggtcaagcctggagggtccctgagactntcctgtgcagcctctggattcaccttcagtggctacttcatgagctggatccgcaggctccgagggagggctgcagtggtctcacatattagtgctaagtgggganaaccanattcaacgcagactctgngaaggccattcnccatcncagggacaaacgccaaagacctnactgtatctagacaaatgaacagtacaaagagaccgaagacacggcctgtaactctgtgcgagtaggtgggagacggtctaacggg

SEQ ID NO: 421415 - DNA, 524 bp, Homo sapiens
  misc_feature: GZ8MTXP02FPW20.51.37.D04.1.454.CMB.2.raw
  modified_base (459)..(459): a, c, t, g, unknown or other
  modified_base (497)..(497): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccccagactctcctgtgcagcctctggattcaccttcagtggctacttcatgagctggatccgcaggctccgagggagggctgcagtggtctcacatatagtgctaaatggggacaaccactatttccaacgcaaggaccttcgtgtagaaagggccgaattctaccattctacccgagggaacaacgccaaagaactcacttgtatcctagacaaatcgaaacngtacaaggagaccgaaagtacacggtcctagtacttcngtcgcgagtgtggagacggactaggtg

SEQ ID NO: 421416 - DNA, 723 bp, Homo sapiens
  misc_feature: GZ8MTXP02HMIZL.51.37.D04.1.454.CMB.2.raw
  modified_base (260)..(260): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggaggcttggtcaagcctggagggtccctgagactctcctgtgcagcctntggattcaccttcagtggctacttcatgagctggactccgcaggctccgaggggagggctgcaggtggtctccgacatattagtgacttaagtgggggaacaaaccacgtattccgtacggccaaggtaccttcgtaggaacgggaaacgggggccctaatttcccgtaccctaacttcccgttacccgaacgggggaacccaaaacccgggacccaaaacggtaaacccttccgaaacctttacgggttaaaccttccccggaaactaaaacgttaacggaaaccgtaaacggttaaccgttaaaacggaaacggaacccggaaaaccggaaaccggaaacccggggtaccccggtttacggttaaccgtttccggtttaacggttccgggtaaccggtacgggtacgggggttagggggaaacgggtaacggggtaaaccgggttaccgggttaaacgggg

SEQ ID NO: 421417 - DNA, 601 bp, Homo sapiens
  misc_feature: GZ8MTXP02HC7IF.51.37.D04.1.454.CMB.2.raw
  modified_base (329)..(329): a, c, t, g, unknown or other
  modified_base (332)..(332): a, c, t, g, unknown or other
  modified_base (339)..(339): a, c, t, g, unknown or other
  modified_base (347)..(347): a, c, t, g, unknown or other
  modified_base (564)..(564): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggacggtccctgagactctcctgtgcagcctctggattcaccttcagtgctacttcatgagctggactccgcaggctcgaggggaggctgcaggtggtcncanatatagngactaagnggggaacaaaccatattccgaacgctaacgtacttcgtaggtacggaacggggccctaatttccctaccaacttccgtaccgaacggggaaccaaaaccggtacccaaaagtaacccttacaacttaggttaactcgtagaacctaaaagtcgaaactagtaacgaaagaacgaccgtaaagaccgacggtaccgttgttaaccttcgtaggtccgnggtaaggtgggtacgggagtaacgggaccgttacggg

SEQ ID NO: 421418 - DNA, 643 bp, Homo sapiens
  misc_feature: GZ8MTXP02F829H.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagctctcctgtgcagcctctggattcaccttcagtggctacttcatgagctggactccgccaggctccggaggggaggggctgcgaggtgggtctccactatatttagtgacttaagtgggggaacaaccactatttcgaacgcaagtactacgtggaagggaaacgggggtccctaatttcccgtacccaatttcccgaccggaaacgggggaaccaaaacccgggacccaaaaggtaacccttacaaccgtttagtaacttccgaggaacaaaaccgttagaaaccgtagttacccgaaaaggaccggacccgaaaaggacctaaccggggccgttaggtacccttggaggttcggacggtaggttcggggaggggaacggacgggtaccgttaacggggg

SEQ ID NO: 421419 - DNA, 569 bp, Homo sapiens
  misc_feature: GZ8MTXP02HJEBA.51.37.D04.1.454.CMB.2.raw
  modified_base (290)..(290): a, c, t, g, unknown or other
  modified_base (330)..(330): a, c, t, g, unknown or other
  modified_base (342)..(342): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagcctctggattcaccttcagtggctacttcatganctggactccgcaggctccgaggggagggctgcagtggtcncgacatattagngactaagtgggggaacaaccactattcctacgcagactcgtaggaagaacggggcctagtttccaccattcccgtaccgacggggaaccaaaccggaccaaaagaacctcaaccttagtaactcgtagactaaatacgaaactagtactaaagacgaccgaagaccgacggtaccgtacgtaccttcgtggtcgcggtaggtcggtaggacgtacggtactacgggg

SEQ ID NO: 421420 - DNA, 669 bp, Homo sapiens
  misc_feature: GZ8MTXP02JP7DR.51.37.D04.1.454.CMB.2.raw
  modified_base (360)..(360): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagccgtgggacggtccctgagactctcctgtcgcagcctcgtggattccaccttcagtggctacttcatgagctggactccgcaggctaccggaggggacgggctggcgaggtcgggtctaccgactattagttaggngtacttaaggtgggggaaaccaaacctactatttaccacggcaacggtacctcgtaggaaacgggtaacggggtccctaactttccaccctagtcccgtacccgaaggggaaacccaaccggacccaaaacgtaacctacaacgttcggtaactccgtagaacctaaaagtacggaaacctagttaaaccgaaagggaccgaaacccggtaaaggacccgtaaccggggtaccgttacgtaaccctttcggaggtccggacggtaaggtcgggggtaaggggaacggtaagggtaacccggttacgggg

SEQ ID NO: 421421 - DNA, 575 bp, Homo sapiens
  misc_feature: GZ8MTXP02FSKDY.51.37.D04.1.454.CMB.2.raw
  modified_base (342)..(342): a, c, t, g, unknown or other
  modified_base (406)..(406): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagcctctggattcaccttcagtggctacttcatgagctggactccgccaggctccgaggggagggctgcagtggtctcacatattagngacttaagtggggaacaaccatacttctaacgcagtactctaggaagaacgggcccgtattccnccatcctaccgaagggaccaaaccggccaaagacctcgacttagtactcgagaactaaagtacgaagtacgtaacgaagaaccggaacgaaacgaccggaccggttcgttacgttacgttcgttagggtgtggtaggtcggggtaggaacggtacggtacggtaacggg

SEQ ID NO: 421422 - DNA, 630 bp, Homo sapiens
  misc_feature: GZ8MTXP02H9OHG.51.37.D04.1.454.CMB.2.raw
  modified_base (192)..(192): a, c, t, g, unknown or other
  modified_base (570)..(570): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtncaggctgggtggaatcgtgggggagcttggtcaagcctgggacgggtccctgagacttctcctgtgcagcctctggacttcaccttcagtcggctacttcatgagctggactcccgcaggcctccggaggggacgggctggcgtaggtcggtctccactattataggtgacgttaaagtgggggaacaaacccactacttcacgcaacgacctcgtaggaacggtacgggccgtatttcccgacacttcccaccgaggaaccaaaccggccaaagacctcactagtactcgtagaactaaagtcgaaaaccgtaggttaacaaaaggaccgaacccgggaaagacccggtaaccgggtccgtttacgttacctttcgnggttaacggcggtaagggttcggggtaaggggacggtaacggggtaaccggttaacgggg

SEQ ID NO: 421423 - DNA, 697 bp, Homo sapiens
  misc_feature: GZ8MTXP02H3L5U.51.37.D04.1.454.CMB.2.raw
  modified_base (297)..(297): a, c, t, g, unknown or other
tcagcgatcgtatacacgaccggtgctcgatttagtagcatactgttgagctctgggagaagagcccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagccgtgggacgggtccctgagactctcctgtcgcagcctcgtggactttccaccttcagtgcttactcatganctggactcccgcaggctccggaggggagggctggccgaggtcggtctcgactattagttagtcgacttaaagtgggggaacaaacccactaactttccgaacgctaaacggtaccttcgaggaaacgggaacggggtccctaattttcccaccctagttcccgtacccggaaggggaacccaaaccggaccgaaaacgtaaccctctaaccgttggttaaacctcgtaacgaaccttaaaagacgtaaaccgtaaggttaccgtaaaaggaccggaaacccggaaaacggacccggtaaacccggggtccgttttacggttaacccgtttcgtaggggtaacgtaccgggtaagggttcggggttaagggggaacggtaacggggtaacgttaccggggg

SEQ ID NO: 421424 - DNA, 637 bp, Homo sapiens
  misc_feature: GZ8MTXP02HGJ5T.51.37.D04.1.454.CMB.2.raw
  modified_base (262)..(262): a, c, t, g, unknown or other
  modified_base (332)..(332): a, c, t, g, unknown or other
  modified_base (336)..(336): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtggggggagcttggtcaagccgtgggagggtccctgagactctcctgtgcagcctntggattcaccttcagtgctacttcatgagctggactccgcaggctccggaggggagggctgcagtggtcnccanatatagtgactagtggggaacaaccatacgttcaacgcaaagtctcgtaggaaggaaacgggggtcctaagtttccacccagttcccgtacccggaaagggggaacccaaaacgggcccaaaaaggaaccttacaacttggtaacttccgtaagacctaaaagtcgaaaacctagtaacaaaacggacggaccgaaaaggacccggtaaccgggtccccgttaagttaccccgtttggtgggtcggtaccggtaggggttcgggtaagggggacggtaaacggggtacccgttaacggggg

SEQ ID NO: 421425 - DNA, 818 bp, Homo sapiens
  misc_feature: GZ8MTXP02G8ZYQ.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggagggtccctgagactctcctgtgcagcctctggattccaccttcagtggctacttcatgagcgtggactcccgcaggcctaccggaggggaacggggtctggacgtaggtcggggtctacccgaactaagttagtttacggtagtaccgttaaaaggtcgggggaaactaaaccccactaacgtttacccgtaacggacctaacgggtaacccttcggttacgggtaacggggtaaaaccgggggtcccgttaacgttttacccctacccgtaacgtttaccccgtaaccccgggaaaccgggggtaaaccccaaaacccgggtaaccccgaaaaacgggttaaacccttacctaaaccgtttacggttaacttaccgtacggtaaaccctaaaaagttaccggaaaaccgtaaacggttaacgttaaaaacgggaaccggaaaacccccgggaaaaggaaaccccggtaaacccgggggtcccggttaacggtttaacccgtttccgttgggttaaccggacggggttaacggggttacggggtaagggggaaacggtaacgggggttaaaccggttaaccggggg

SEQ ID NO: 421426 - DNA, 634 bp, Homo sapiens
  misc_feature: GZ8MTXP02FTABN.51.37.D04.1.454.CMB.2.raw
  modified_base (252)..(252): a, c, t, g, unknown or other
  modified_base (260)..(260): a, c, t, g, unknown or other
  modified_base (268)..(268): a, c, t, g, unknown or other
  modified_base (279)..(279): a, c, t, g, unknown or other
  modified_base (282)..(282): a, c, t, g, unknown or other
  modified_base (284)..(284): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtggtttcgtgtaggctatatagagtgtccagtgtcaggtgcagctggtggaatcgtgggggaggcgttggtcaagcctggagggtcccgtgagctctcctgtgcngctctgtntctactcngtgctactctntgngngtgacgtccgccgacggcgtaccggagggagggcgtgcgtggtggtctcctactatagttagtagtacgtaagtggaacgaactactacgttacgtacgacgacgtacgtacgtacggaaggaacgggtaccgtacgttacgtacctacgtaccgtaccgacggaaccgaaaccgaaccgaaacgaaccgtaccgtacgtacgtactacgtacgaactaaacgtaacgaacgtaacgtaacgtaaacggtaacgaaccgaaacgaacgaaccggtaccggttacgttacgttcgttacggtaacggtacggtacggtacgggtagggtaacggtaacggtacggtaacgg

SEQ ID NO: 421427 - DNA, 596 bp, Homo sapiens
  misc_feature: GZ8MTXP02ITD3C.51.37.D04.1.454.CMB.2.raw
  modified_base (571)..(571): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcggtgggggagcttggtcaagccgtgggacgggtccctggacgactctcctgtgcacgcctctggacttccaccttcagtcgctacttcatgagctggactcccgccgaggcctaccggaaggggacgggctggcgaggtcggtctaccaactattagttagtgacttaaggtggggaacaaacccagtacttccgtaacgcaagtacctcgtaggaacggaacggggcctaatttccctaccgatcccgtaccgaacgggaaccaaaccgaccaaagaaccttcaacttagtactcgtagaaactaaagtacgaaactagtacgaaagacgaccgaagaccgacggtctacgtactcgtgaacgngtaggtggagggagacggacgtagg

SEQ ID NO: 421428 - DNA, 549 bp, Homo sapiens
  misc_feature: GZ8MTXP02JYXTK.51.37.D04.1.454.CMB.2.raw
  modified_base (286)..(286): a, c, t, g, unknown or other
  modified_base (359)..(359): a, c, t, g, unknown or other
  modified_base (375)..(375): a, c, t, g, unknown or other
  modified_base (396)..(396): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggacgggtccccgagactctcctgtgcagcctctggattcaccttcagtggctactnatgagctggatccgcaggctcgaggggagggctgcaggtggtctcacatatagtgctaagtggggacaaccanatttcacgcagacctntgtaggaaggggtccattccnccatcctaccgagggaccaacgaccaaagaactcactgtactctagacaaatcgaaactgtaactaaagacgaccgaaagaccgaccgggtccgtagttaccttcgtaggtcgcggtaggttgggagggaacggacggtaccgtacgggacgg

SEQ ID NO: 421429 - DNA, 521 bp, Homo sapiens
  misc_feature: GZ8MTXP02GBYOL.51.37.D04.1.454.CMB.2.raw
  modified_base (355)..(355): a, c, t, g, unknown or other
  modified_base (361)..(361): a, c, t, g, unknown or other
  modified_base (393)..(393): a, c, t, g, unknown or other
  modified_base (429)..(429): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttgggtcaagcctgggagggtccctgagactctcctgtgcagcctctggattcaccttcagtggctacttcatgagctggatccgccaggctccgagggaggggctgcaggtggtctcacatatagtgctaagtgggganaaccanattctacgcagactctgtgaagggccgattcnccatctccgaggacaacgccaaagactcactagtancctgacaaagtgaacagtactaaagacgaccgaaagaccgacgggccgtagtacttctaggtgtcgaggtgtaggggagacggacgtacggg

SEQ ID NO: 421430 - DNA, 562 bp, Homo sapiens
  misc_feature: GZ8MTXP02HVIFK.51.37.D04.1.454.CMB.2.raw
  modified_base (222)..(222): a, c, t, g, unknown or other
  modified_base (362)..(362): a, c, t, g, unknown or other
  modified_base (380)..(380): a, c, t, g, unknown or other
  modified_base (410)..(410): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcctcactctctgcacaggctctgaggcctcctatgagctgacacagccagcctcggtgtcagtgtccccaggacagacggccaagatcccctgctctgganatgcattgaccaaaacgtatttgcttttttggtaccaacagaagccaggccaggcccctataataattatatataaagacagtgagaggccctgagggactccctgagcgattctctggccctccagctcgaggacaacngccacgttgacgattagngagtccaggcagagacgagctgactatacngtcaatcagcagacgacagtggtaacttagtggagttagttcgggacggaagggaaccgaaagggttcgacccgtcgtaacggtccacggtacccgaaagggccttcggaccccccgttcgggtacctacccgtcgtttccgttaccccccg

SEQ ID NO: 421431 - DNA, 562 bp, Homo sapiens
  misc_feature: GZ8MTXP02J19YE.51.37.D04.1.454.CMB.2.raw
  modified_base (367)..(367): a, c, t, g, unknown or other
  modified_base (376)..(376): a, c, t, g, unknown or other
  modified_base (388)..(388): a, c, t, g, unknown or other
  modified_base (461)..(461): a, c, t, g, unknown or other
  modified_base (503)..(503): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagccgtgggacgggtccctgagactctcctgtgcagcctctggacttcaccttcagtcgctacttcatgagctggactcccgccgaggcctaccggaagggggaacggggctggccgaggtcgggtctccgactatagtttagngacttaagnggggaacaaccntattcgacgcagactcgtgtacggaacgggccctatttccgaccacttcacgaggaaccacggccaaagactnactgtactcgagacaaatcgaactagtacaagacgaccgaanaccgtacggccgtagtacctgagtcgacggtagttcggacgggagtacggacgtacggg

SEQ ID NO: 421432 - DNA, 592 bp, Homo sapiens
  misc_feature: GZ8MTXP02IBGGY.51.37.D04.1.454.CMB.2.raw
tcagcgatcgtatacacgaccggtgctcgatttagtagcatactgttgagctctgggagaagagcccccagtcccagaattcccaggagtttccattcggtgatcagcactgaacacagaggactcaccatggagtttgggctgagcttgggttttccttgtgctattatagaaggtgtccagtgtcaggtgcagctggtggaatcgtgggggagtcttggtcaagcctgggacgggtccctggacgactctcctgtgcagcctctggattcaccttcagtggctacttcatgagctggactcccgccaggcctccgaggggaggggctggcgaggtgggtctaccactattattagtgacgttaagtgggggaacaaaccacgtacttccgacgcaagtacctcgtggtacggaacggggccctagttcctaccgtatccgtaccggaacgggaccaaaccggaccctaaagaaccttctaaccgtgtaactccgtagactaaagtacgaactagtactaaacggacgaccgaaagaccgacggccgttgtaccttgtgtgtaggagtgggtacggagtacggacgtacgg

SEQ ID NO: 421433 - DNA, 606 bp, Homo sapiens
  misc_feature: GZ8MTXP02I21NU.51.37.D04.1.454.CMB.2.raw
  modified_base (289)..(289): a, c, t, g, unknown or other
  modified_base (340)..(340): a, c, t, g, unknown or other
  modified_base (352)..(352): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccctgagactctcctgtgcagcctctggattcaccttcagtggctacttcatganctggatccgcaggctccgagggaggctgcaggtggtctcgactatatagtnactaatgggganaaccacattcctacgcagactcgtgtagaacgggtcccgattccgtacccagttccctaccgaacggggtaaccaaacccggacctaaaacggaacctcgaaccttaggttaaactccgtagaacctaaaagtcggaaacctaaggttaccaaaaggacgacccggaaaaggaccgtaaacgggcccgtttagtaacctttcgaggtcgtaccggtaggtttacgggacgggacggtacgggacgttaacgggg

SEQ ID NO: 421434 - DNA, 693 bp, Homo sapiens
  misc_feature: GZ8MTXP02G6FTO.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcgttggtcaagccgtgggacggtccccgagactctctgtgcagcctctggtattcaccttcaggtcgcttacttcatgagctggactccgccaggcctccggaggggaacgggctggcgtaggtcgggtctcgactattattaggcgtactaaggtcggggaacgtaaacccctaatacttaccgtaacggacacgtaaccgtcgtagggttacggaaaccgggggtccttaactttcccgtaccctacgttacccgtaccggaaacggggaacccaaacccgggaaccctaaaacggtaaaccctacgtaaccttacggttaactcgtacgaaactaaaacgtacggaaaaccttacggttaacgaaaacgggaccgaaaccggaaaacggaccggtaaacccggggccgtttaacgtacgttcgtggttacggcggtaggtcgggtaggggacgtacgggtacggtacgggtacgg

SEQ ID NO: 421435 - DNA, 596 bp, Homo sapiens
  misc_feature: GZ8MTXP02F6R1U.51.37.D04.1.454.CMB.2.raw
  modified_base (319)..(319): a, c, t, g, unknown or other
  modified_base (326)..(326): a, c, t, g, unknown or other
  modified_base (356)..(356): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaaggtgtccagtgtcaggtgcagctggtggaatcgtgggggagcttggtcaagcctgggagggtccctgagactctcctgtgcagcctctggattcaccttcagtggctacttcatgagctggatccgcaggctcgaggggaggctgcngtggtcncacatatagtgactaagtggggacaaaccntattcgacgcagactcgtaggtacgaacggggcctaattccgaccagttccctaccggaaacggggaaccaaaccgggacccaaaacgggtaaccctcgaaccttaggtaattacccggtaagaaacctaaaagtacgaaacgtaacgtacgtaaaggacgaaccggaagaccgtaccggtacgtacgttactcgtagtcgacggtaggtacgggagggtaacggacgggtacgtacggg

SEQ ID NO: 421436 - DNA, 556 bp, Homo sapiens
  misc_feature: GZ8MTXP02GGFIL.51.37.D04.1.454.CMB.2.raw
  modified_base (357)..(357): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagcctctggattcaccttcagtggctacttcatgagctggactccgcaggctccgaggggagggctgcagtggtctccacatattagtgactaagtggggaanaaccactattccacgcaagtacctcgtagagaacggggcctaattccaccatccgtaccgagggaaccaaaccgccaaagacctcacgtagtactcctgaactaaagtcgaaactagtacaaaggacgaccgaaagaccgaacggccttacgtaccttgtaggtcgacggagtcggtagggagacggtacgtaacgggg

SEQ ID NO: 421437 - DNA, 505 bp, Homo sapiens
  misc_feature: GZ8MTXP02FE0EH.51.37.D04.1.454.CMB.2.raw
  modified_base (288)..(288): a, c, t, g, unknown or other
  modified_base (353)..(353): a, c, t, g, unknown or other
  modified_base (359)..(359): a, c, t, g, unknown or other
  modified_base (390)..(390): a, c, t, g, unknown or other
  modified_base (395)..(395): a, c, t, g, unknown or other
  modified_base (423)..(423): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaaggtgtccagtgtcaggtgcagctggtggaatcgtgggggagcttggtcaagcctggagggtccctgagactctcctgtgcagcctctggattcaccttcagtggctacttcatganctggatccgcaggctccgaggggagggctgcaggtggtctcacatattagtgctaaagtgggganaaccanattcacgcagactctggagaaggccattccncatcncagggacaacgccaaagactcactgtanctgacaaatgaaacagtacaaaaggacgaccgaagaccacgggccgtagtactctagtgcgagtggagggagaggactacgg

SEQ ID NO: 421438 - DNA, 566 bp, Homo sapiens
  misc_feature: GZ8MTXP02J0KWG.51.37.D04.1.454.CMB.2.raw
  modified_base (359)..(359): a, c, t, g, unknown or other
  modified_base (532)..(532): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttgggcaagcctgggaggtccctgagactctcctgtgcagcctcgtggattcaccttcagtgctacttcatgagctggatccgcaggctcgagggaggctgcagtggtctcacatatagtgactaagtgggggaacaacccanattcgtacgcagactcgtggaaggaacgggcctagttcctacccatccgtacccgagggggaaccaaaccggacccgaaacgaacctacaccgttaggtactcgtagaccaaaagtcgaaactagtacgtaagacgaccgaagaccgaacggtccgtacgtaccttcgtaggngcgtaggtcggtagggacgtacggacgtaacggg

SEQ ID NO: 421439 - DNA, 732 bp, Homo sapiens
  misc_feature: GZ8MTXP02H9AV7.51.37.D04.1.454.CMB.2.raw
  modified_base (191)..(191): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcacatggagtttgggctgagcttgggttttccttgttgctattatagaaggtgtccagtgtcaggtncagctggtgaatcgtgggggagtcttggtacaaggcctgggacgggtccctggacgtactcctcctggtcgcagccctgtggacttccaccttcgagtcggtcttaacttcatggactcgttggactcccgacgaggtcctaccggaagggggaaggggtctggccgtagggttcgggtctaccgactaattagttaggtgacgttaaggtggggaaacctaaacctacgtattcgtaacgctacggacccttgaggttacggaaacgggtccgaactttccctacctacgttacccgtaccgaacgggggaaacctaaaacccgggaccctaaaaggtaaaccttcccgtaacgttacggttaacttccgtaaggaaaccttaaaagcgttaaaaaccgagtttaaacccggaaaaggtaccgaacccgggaacgtaaaccgaccgggttaccccgttaggtttaaccttccggtggttaacccggacgggaacggttttgggaaccgggggtaaggacgggttaacccgttaacggggg

SEQ ID NO: 421440 - DNA, 603 bp, Homo sapiens
  misc_feature: GZ8MTXP02ID675.51.37.D04.1.454.CMB.2.raw
  modified_base (223)..(223): a, c, t, g, unknown or other
  modified_base (242)..(242): a, c, t, g, unknown or other
  modified_base (319)..(319): a, c, t, g, unknown or other
  modified_base (365)..(365): a, c, t, g, unknown or other
  modified_base (386)..(386): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcctcactctctgcacaggctctgaggcctcctatgagctgacacagccagcctcggtgtcagtgtccccaggacagacggccaagactcccctgctctgganatgcattgaccaaaacgtntttgctttttggtaaccaacagaagccaggccaggcccctaataataattatataataaagacagtgagaggccctnagggactccctgagcgattctctggccctcagctcgaaggacaacncgactacgttgacgtattagngagtccaggcagagacgagctagactatctgtacaatcagcagacgacgagtgtaacttagtacggtagttaagttcgggacgggtaaacggggaccgaaaggggttcggaacccgttaccgtacgggttaccgacggtaccccggaaacggtccgtacccggacccccccgttacgggtaccctaacccgttccgtttacccggtttacccccccg

SEQ ID NO: 421441 - DNA, 605 bp, Homo sapiens
  misc_feature: GZ8MTXP02I6FD9.51.37.D04.1.454.CMB.2.raw
  modified_base (335)..(335): a, c, t, g, unknown or other
  modified_base (570)..(570): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggacgggtccctgagactctcctgtgcagcctctggattcaccttcagtggctactcatgagctggactccggcaggctccgaggggaagggctgcaggtcgggtcnccacagttacttagtgactaagtgggggaaacaaaccactagttccaacgcagtactcgtagtacggaaacggggcctattccgtacctacgttaccgacccgaaaggggaaccctaaaacccggaccccaaaagaaccttaccaaccgttagtaactccgtagaaccaaaagtacgaactaagtacgtaaaggacgaccgaaagaccgaccggtccgttacgtacttcgtaggngcggtaaggtggtacgggagacggtacgtaacggg

SEQ ID NO: 421442 - DNA, 574 bp, Homo sapiens
  misc_feature: GZ8MTXP02FOK00.51.37.D04.1.454.CMB.2.raw
  modified_base (291)..(291): a, c, t, g, unknown or other
  modified_base (333)..(333): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggacgggtccctgagactctcctgtgcagcctctggattcaccttcagtgctacttcatganctggactccgccaggctccgagggagggctggcaggtggtcncgactatattagtgacttaagtgggggaacaacccagtattcacgcagactcgtaggaacgtaacgggccgtaatttccaccctaagttccctaccggaaaggggaccaaaccggacccaaaagtaacctcaacgttgtaatccgtagactaaatcgaaactagtactaaaggacgacgaaagaccgaacgggccttacgtacttctaggtgcgaggtcgggtggaagacggacgtaaggg

SEQ ID NO: 421443 - DNA, 678 bp, Homo sapiens
  misc_feature: GZ8MTXP02IG0ZU.51.37.D04.1.454.CMB.2.raw
  modified_base (225)..(225): a, c, t, g, unknown or other
  modified_base (244)..(244): a, c, t, g, unknown or other
  modified_base (258)..(258): a, c, t, g, unknown or other
  modified_base (296)..(296): a, c, t, g, unknown or other
tcagcgatcgtatacacgaccggtgctcgatttagtagcatactgttgggtttgggggtgggtccaggaggcagaactctgggtgtctcaccatggcctggatccctctacttcctccccctcctcactctctgcacaggctctgaggcctcctatgagctgacacagccagcctcggtgtcagtcgtccccaggacagacggccaagactcccctgctctgganatgcattgaccaaaagttnttgtctttagacanagagcagcacgacctaataataatataataataaaganagtagagacgcctagaggactccgagacgcgtattctcgtcgccctaccgagtctacgaacggaaccaaacgcgtaccgtaacggttacgaaccgtaagttaggagtacggtaccgaaggacgaaaggaacggaacggaggtacgtagtaacttaacgttacgtacgtaactaaacgtacgaacgacgaacggaaccgtaacgtaaggttacggttaacgtttaaggtagggtaacgttacggttacggggaacggggtaacgggaaccggtaaagggtaccggtaaccggttaccggtaacggtaccgaaccggtacccgaacgggtcccgtcccggtacccccgttacggtacctacccgttccgttcccggtacccccg

SEQ ID NO: 421444 - DNA, 530 bp, Homo sapiens
  misc_feature: GZ8MTXP02FKHX8.51.37.D04.1.454.CMB.2.raw
  modified_base (399)..(399): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggaggtccctgagactctcctgtgcagcctctggattcaccttcagtggctacttcatgagctggactccgccaggctccgaggggagggctgcaggtgggtctccacatattagtgacttaagtggggaacaacccatattctacgcagactctagagaagggccgattcnccatctccgagggacaacgccaaagactcactgtatctagacaaatgaacagtacaaaggacgaccgaaagaccgacgggaccgtagttaccttcgtagtgcggtaggtggtagggagacgggactacggg

SEQ ID NO: 421445 - DNA, 622 bp, Homo sapiens
  misc_feature: GZ8MTXP02JISKJ.51.37.D04.1.454.CMB.2.raw
  modified_base (192)..(192): a, c, t, g, unknown or other
  modified_base (294)..(294): a, c, t, g, unknown or other
  modified_base (329)..(329): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtncagctggtggaatcgtgggggagcttggtcaagccgtgggacgggtccctgacgactctcctgtgcagcctctggacttcaccttcagtgctacttcatganctggactccgcaggctccggaggggagggctgcgnggtgggtctccacgtatattaggtgacttaaaggtgggggaacaaaacccctagtacttccgtaacggcaacggtacctcgttaggaaacggaacggggtccctaatttccctacccaacttcccgtacccgaacggggaaccaaaccccggacaaaacggaacctacgaacctttgtaactccgtagaacctaaaagtcgaaacctagtacaaacggacgaccgaaagtaccgacggtccgtacgttaccttcgagtcgacggtagtgggtagggagtacggacgtaacggg

SEQ ID NO: 421446 - DNA, 641 bp, Homo sapiens
  misc_feature: GZ8MTXP02F35AQ.51.37.D04.1.454.CMB.2.raw
  modified_base (261)..(261): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagccgtgggagggtccctgagactctcctgtgcagcctntggattccaccttcagtgctacttcatgagctggactcccggccaggcctccggaggggaacggggctggcgaggtcgggtctccgactattacgttagtgacgttaaagtgggggaacaaacccactattccgtaacgctaaggaccttcgtagggaacggtaaacgggggccctaaatttccctaccctaacttcccgaccgaaacggggaaccaaaccgggacccaaaagtaaccctactaaccgttagttaactaccgtagaacctaaaagtacggaaactaggtaacaaacgaacggacccgaaagaccgaacgggtccgttacgttacttcgttggcgcgtaaggtcgggtagggacgtacggacgtaacgggg

SEQ ID NO: 421447 - DNA, 750 bp, Homo sapiens
  misc_feature: GZ8MTXP02JN2WB.51.37.D04.1.454.CMB.2.raw
  modified_base (262)..(262): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggaggtccctgagactctcctgtgcagcctcgnggattcaccttgagtgctacttcatgagctggactcccgcaggcctccggaaggggacggggctggcgtaggtcggggtccttacccgactaagtttagttaaggtcgacctttaaaggtcgggggaaacaaaccccgtacgtactttaccgaaccggacctaagggtaccctacgttacggggaaagggaaaccgggggtccctaaacgttttccctacccctagtttaccccgtacccggaaacgggggaacccaaaacccggacccgtaaaaggtaaaccccttacgaacccgtttaggtaaacttccgttaggaaacccttaaaagtacggaaaaccgtagtttaaccgtaaaagggaaccggaacccggaaaaccggaccgtaaacccggggtcccgtttacgttaaccgttccgttaggtcggtaccggtaacgggtttcgggggtacggggaagggaacgggtaaccggtttaaccggggg

SEQ ID NO: 421448 - DNA, 614 bp, Homo sapiens
  misc_feature: GZ8MTXP02HRK2F.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagctttgggtcaaggcctgggacgggtccctgagactctcctgtgcagcctctggattcaccttcagtggtctacttcatgagctggactccgccaggcctccgaggggaggggctgcgaggtgggtctccacgtattagttagtgacttaagtcggggaagaaacccacgtatttccaaagcaagtactctggtagaacgggccgtattcctccattcctaccgacggggaccaaccggaccaaacgtaacctcgaccttagtactcgtagaacctaaaatacggaactaacgtacaaaacggacgacccggaaagaccgaaacgggtcccgttaggtaacccttcggttacgtggtacggtaggttagggtaggggacggtacgggtaaccgttacgggg

SEQ ID NO: 421449 - DNA, 531 bp, Homo sapiens
  misc_feature: GZ8MTXP02JQUK4.51.37.D04.1.454.CMB.2.raw
  modified_base (341)..(341): a, c, t, g, unknown or other
  modified_base (356)..(356): a, c, t, g, unknown or other
  modified_base (422)..(422): a, c, t, g, unknown or other
  modified_base (494)..(494): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtggtttctgttgctattatagaggtgtccagtgtcaggtgcagctggtggaatcgtgggggagcttggtcaagcctggagggtccctgagactctcctgtgcagcctcgtggacttcaccttcagtgctactcatgagctggactccgcaggctccgaggggacggggctgcgaggtgggtctacacatattgngactaagtggggaanaaccactattcacgacagactcgtagagaacgggctatctccatcacgaggacacgaccaagaacnaactgtaatctgaactaatcgaactagtacaaaggacgaccgaaagaccgacggtaccgttgtaacccttgngtaagcggaaggttggagggagacggtacgtaacggg

SEQ ID NO: 421450 - DNA, 739 bp, Homo sapiens
  misc_feature: GZ8MTXP02ILRGX.51.37.D04.1.454.CMB.2.raw
  modified_base (263)..(263): a, c, t, g, unknown or other
  modified_base (291)..(291): a, c, t, g, unknown or other
  modified_base (343)..(343): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggacgggtccctgagactctcctgtgcagcctcnggattcaccttcagtgctacttcatganctggactcccgccaggcctccgaggggaaggggctgcgaggtggtctccganattagttagtgacttaaagtgggggaacaaacccactatttcccgtaacgacctaagaccttcgaggttacgggaaacgggggtcccgttaacgtttcctacccgtaacttccccgttaaacccggacgggggaaaaccctaaaaccccgggaccctaaaaacggtaaaacccctttaccaaacccgtttaggtaacctttcgaacggtaaacctaaaaggttacgaaaaaccgtacggttaaacgtaaaacggaccggaaacccggaaaacgtaacccgaaacccggggtccggtttaccgtttaaaccgtttcggttacgggtccgggtacggtaacggggtttcggggtaacgggggtaagggaaccggggttaaaaccggtttaaccggggg

SEQ ID NO: 421451 - DNA, 551 bp, Homo sapiens
  misc_feature: GZ8MTXP02F1U4J.51.37.D04.1.454.CMB.2.raw
  modified_base (340)..(340): a, c, t, g, unknown or other
  modified_base (404)..(404): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagcctctggattcaccttcagtggctacttcatgagctggatccgcaggctccgagggagggctgcagtggtctcacatagttagngactaaagtgggggaacaaaccagtattccaacgcagactctaggagaaaggggcccaattccncccaattcctacccgaagggaccaaaccggccaaagaacctcactgtaactctagacaaatagaacagtactaagacgaccgaaagacaacggccgttagtaacttcagtcgacgaaggttcggaggggagacgggacttaacgggg

SEQ ID NO: 421452 - DNA, 621 bp, Homo sapiens
  misc_feature: GZ8MTXP02JIJVL.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggagggtccctgagactctcctgtgcagcctcgtggattccaccttcagtggcttacttcatgagctggactccgcaggctccggaggggaggggctggcgaggtcgggtctccgactattattaggtgacttaaagtgggggaacaaaccctacgtactttaccgacggcaagtacctcgtaggaacggaaacggggccctaatttccacccattcccgaccgaacggggaacccaaaccggaccccgaaaagacccttaccaccttaggtactcgtacgaactaaaagtcgaaactagtaaccgaaaggacgaccggaaagaccgaaccgggtccgttacgtaccgttcgtggtcgacggtaggtgggagggacgtagggtacgtacggg

SEQ ID NO: 421453 - DNA, 637 bp, Homo sapiens
  misc_feature: GZ8MTXP02H5K0G.51.37.D04.1.454.CMB.2.raw
  modified_base (289)..(289): a, c, t, g, unknown or other
  modified_base (348)..(348): a, c, t, g, unknown or other
  modified_base (360)..(360): a, c, t, g, unknown or other
tcagcgatcgtatacacgaccggtgctcgatttagtagcatactgttgagctctgggagaagagcccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagccgtggagggtccctgagactctcctgtgcagcctctggattcaccttcagtgctacttcatgngctggactcccgccgaggctccgaggggaggggctgcaggtgggtctccacatattagnctaatggggganaaaccactattcctagcagactcgtgtaggaacggggcctattcctaccattccacccgaaggggacccaaacggacccaaagtaaaccctcaccgtagtaactccttagaactaaaatacggaaactagttaacgaaacggaacgacccggaaaacggaaccgtaacccgggggtacccgtttacggttaaaccccttttggtaccggttggaccggggaacgggtttcgggggttagggggaaaacggtacgggggtaaaccgtttaaccggggg

SEQ ID NO: 421454 - DNA, 542 bp, Homo sapiens
  misc_feature: GZ8MTXP02G4ONI.51.37.D04.1.454.CMB.2.raw
  modified_base (343)..(343): a, c, t, g, unknown or other
  modified_base (407)..(407): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagcctctggattcacttcagtgctactcatgagctggactccgccaggctccgaggggaaggggctgcaggtcggtctcacatattagngacgtaagtgggggaacaaccatattcgtacgcaacgtactcgtggtagaacggggcctattcnccatccgtaccgagggacaaaccgccaaacgactcactgtaatcgtagacaaatcgaactagtacaagacgaccgaaagaccgacggccgtagtacctgtgtcgacgtaggtggtagggagtacggacgtacggg

SEQ ID NO: 421455 - DNA, 696 bp, Homo sapiens
  misc_feature: GZ8MTXP02J22FG.51.37.D04.1.454.CMB.2.raw
  modified_base (191)..(191): a, c, t, g, unknown or other
  modified_base (261)..(261): a, c, t, g, unknown or other
  modified_base (274)..(274): a, c, t, g, unknown or other
  modified_base (285)..(285): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtncagctggtggaatcgtgggggagcttggtcaagccgtgggagggtccctgagactctcctgtgcagcctntggattcaccttnagtgctacttnatgagctgactccgcaggctccgaggggacgggctgcgaggtggtctccgactattacgttagtgacgttaagtcgggggaaacaaaccctactatttaccgaacggactaacggaaccctttaccgtaggaaacggggtaaaccggggtcccgttaatttcccgtacctaacgtttcccgtaacccggaaacggggaaacccaaacccggacccaaaaggtaaccctactaaacgttacggttaaactcgttacggaaacctaaaaggttcgaaaaccgtaggttaaaccgaaaaggaccggaaaccggtaaacgaacccggtaaccggtcccggttagttaacccgtttcgaagggttccgacggtacggttcggggtaacgggaaggtacgggtaacgttaccggggg

SEQ ID NO: 421456 - DNA, 584 bp, Homo sapiens
  misc_feature: GZ8MTXP02IY6SA.51.37.D04.1.454.CMB.2.raw
  modified_base (258)..(258): a, c, t, g, unknown or other
  modified_base (285)..(285): a, c, t, g, unknown or other
  modified_base (341)..(341): a, c, t, g, unknown or other
  modified_base (355)..(355): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggcaagcctgggagggtccctgagctctcctgtgcagcctntggattcacctcagtgctactcatganctggactccgcaggcctccgaggggagggctgcaggtggtcctacactattatagngactaagtgggganaaacccatattccacgcagacctcgtagaacggaacgggtccattccacctatccctaccggacggaacaaacccggacaaacgtactcctacttagtactacgtcgaaactaaagtacgaacgtagttaacgaaacgaacgacccgaaagacccgaccggtaccgtacgttaacctcggttagtccggaggtacggttgggagggaacggtacggtaaccgtacgggg

SEQ ID NO: 421457 - DNA, 631 bp, Homo sapiens
  misc_feature: GZ8MTXP02HORJY.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggaggcttggtcaagcctgggagggtccctgagactctcctgtgcagcctctggattcaccttcagtgctacttcatgagctggactccgccaggctccgaggggacggggctggcaggtcgggtctaccacgtattatttaggtgacgttaagtgggggaacaaaccatactttccacgctacgtactcgtaggaaggaacggggtccgaactttcctacccaagttccctacccggaaaggggaaccaaaacccggcccgaaaaagaaccttacgtaaccttagtaactcctagaacctaaatacggaaaactagtacgtaaaagacgaaccggaaaacgaccgtacgggtaccgttagtacctttcgaggttaagcggtaaggttggggtaaggggagtacgggtaacgtaaccgggg

SEQ ID NO: 421458 - DNA, 580 bp, Homo sapiens
  misc_feature: GZ8MTXP02H57LB.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccctgagactctcctgtgcagcctctggattcaccttcagtgctacttcatgagctgatccgcaggctcgaggggagggctgcgaggtcggctcactatatagtgtactaagtggggaacaaacactattacacgcagacctcgagaggaacggccgtattctccattccaccgaggaaccaaacgccaaagaactcacttgtactcgagacaaaagtcgaaactacgtaaacgaaaaggacgaaccggaaacgaaaccgacccgggtaccgttacgtaacctttcgtacggtgtaaccggtaggtttacgggagggggaagtaacgggtaacgtttaaccggggg

SEQ ID NO: 421459 - DNA, 778 bp, Homo sapiens
  misc_feature: GZ8MTXP02I7KY8.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttcctgttgctattatagaaggtgtccagtgtcaggtgcagctggtggaatcgtgggggagcttggtcaagcctgggacgggtccctgacgactctcctgtcgcacgcctcgtggattcaccttcagtggctacttcatgagctggactcccgccaggcctaccggaggggagggcctggctaggtcgggtctaccgactattagttaggtgtaccttaaaggtcgggggaaactaaacccctagtactttaccgtaacgctaacggaccttacgtaggaacggtaaacgggggccctaattttccgtacccctaaagtttcccgtaaacccgggaacgggggaaacccaaaaccccggtaaccccgaaaacggtaaaacccctttccgaaacccgttttagggttaaacctttaccccgtaaggaaacccttaaaaaggttaacgaaaacccgtaaacgggtttaaccgttaaaaaggggaacccggtaacccggggaaaaacggaccccggtaaacccggggttcccgtttaacggttaacccttttcggtagggttaacggaccgggttaggggttacgggggtaacgggggaaggtaaccgggggtacgtttaaacggggg

SEQ ID NO: 421460 - DNA, 702 bp, Homo sapiens
  misc_feature: GZ8MTXP02G3JU9.51.37.D04.1.454.CMB.2.raw
  modified_base (261)..(261): a, c, t, g, unknown or other
  modified_base (291)..(291): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggacgggtccctgagactctcctgtgcagcctntggtattcaccttcagtggctactcatgancgtggactcccggccaggcctaccggaaggggaacggggctggccgtagggtcggggtctccgaactattattaggtcgtactaagtgggggaaacaaacccacgtactttccgaacgctacgtacttccgtaggaaacgggaacggggtcccgtaatttccctacccgtacttacccgtacccgaaacgggggaaaccccaaacccggaccccaaaaggtaaccccttacgtaacccttaggttaaactcccgttagaacctaaaagtacgaaaactacgtaaacgttaaacggaaccggaccgaaacggaacccggaaccgggttcccgtaggtttaccttccggtttaaggtcggaccgggtaaggttcggggttaggggaaaggaacgggtaaccggtttaacgggg

SEQ ID NO: 421461 - DNA, 570 bp, Homo sapiens
  misc_feature: GZ8MTXP02INVSH.51.37.D04.1.454.CMB.2.raw
  modified_base (288)..(288): a, c, t, g, unknown or other
  modified_base (341)..(341): a, c, t, g, unknown or other
  modified_base (349)..(349): a, c, t, g, unknown or other
  modified_base (355)..(355): a, c, t, g, unknown or other
  modified_base (394)..(394): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccctgagactctcctgtgcagcctctggattcaccttcagtggctactcatganctggatccgccaggctccgaggggaagggctgcaggtggtctcacatattagngactaagngggganaaaccatattccagcagactcagagaacggcgtaattcnccgatccgaccagggaaccaacgacccaaagaacctcacttgaactctagactaaatacgaaactagtactaaaggacgaccgaaaagaccaaaccgggtcccgtagttaacccgtttcgtaggtaacggacggtaggttcggggtaggggtagaacggggtaacgttaaccgggg

SEQ ID NO: 421462 - DNA, 576 bp, Homo sapiens
  misc_feature: GZ8MTXP02F6P38.51.37.D04.1.454.CMB.2.raw
  modified_base (408)..(408): a, c, t, g, unknown or other
  modified_base (440)..(440): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagcctctggattcaccttcagtggctacttcatgagctggatccgcaggctccgaggggagggctgcaggtgggtctccgacatattagtgacttaaagtgggggaacaaaccactaattcctaacgcaagactctagagaacgggcctattcnccatcctcgaagggacaaacgccaaagacctnaactgtatcagacaaatcgaaacagtactaaaggacgaccggaaagaccgtaaccgggcccgttagttaacccgttcgttaggcgtaccggaaggttcggggtacggggaaggaacgggtaaccgttaaccggggg

SEQ ID NO: 421463 - DNA, 575 bp, Homo sapiens
  misc_feature: GZ8MTXP02JGGB1.51.37.D04.1.454.CMB.2.raw
  modified_base (263)..(263): a, c, t, g, unknown or other
  modified_base (288)..(288): a, c, t, g, unknown or other
  modified_base (349)..(349): a, c, t, g, unknown or other
  modified_base (400)..(400): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtggggggagcttgggtcaagcctgggacgggtccccgagactctcctgtgcagcctntggattcaccttcagtggctacttnatgagctggactccgcaggctcgaggggagggctgcagtggctcacatatagtgactaagngggacaaccatattcctacgcagtactcgtgtaggaacggggcctattccnccactcctaccgagggaccaacgaccaaagaactcactgtatcgtagactaaaagtcgaaactaggtactaaacggacgtaccgaaaagaccgaccggggtccgttaggttacctttcggtacgtcggaacggtaggttacggtagggggaagtaacgggtacgttacgggtacg

SEQ ID NO: 421464 - DNA, 655 bp, Homo sapiens
  misc_feature: GZ8MTXP02H0SG3.51.37.D04.1.454.CMB.2.raw
  modified_base (348)..(348): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagctttggcaagcctgggacgggtccccgagactctcctgtgcagcctcgtggattcaccttcagtcggcttactcatgagctggactccgccaggctcgaggggaggctgcaggtggtctcacgtatagttagngtactaagtgggacgaaaccataactttccgacgtacgagtacctcgtagtaggaacgggtcctaattcccgtaccattcccgtaccgaacggggaaccaaaccggacccaaaacggtaaccttaccgaacttacggtttacgtctacgaaacctaaaagttacggaaaactaggttaacgaaaacggaacggaacccgaaaaggacgtaaacccgggtccgttaacggtttaaccgttccgttaggtacggtaaccggtaagggtttcgggacggggaaggtaccgggtaacgttacgggtaccgg

SEQ ID NO: 421465 - DNA, 586 bp, Homo sapiens
  misc_feature: GZ8MTXP02F39T9.51.37.D04.1.454.CMB.2.raw
  modified_base (422)..(422): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttcctgttgctattatagaaggtgtccagtgtcaggtgcagctggtggaatcgtgggggagcttggtcaagcctgggaggtccctgagctctcctgtgcagcctctggattcacttcagtggctacttcatgagcgtggactccgcaggtcctacgaggggagggctgcgaggtcgggtctaccactattaagttagtgacgttaaagtggggaaacaaacccatactttccgacgcagtactcgtaggtacggaaaggccctattccncctattcccaccgaagggaacctaaaccgcccgaaaagtacctactaacgttgtaactccgagaactaaagtagaaaccagtaaccgtaaaggaccgaccgaaagaccgacgggtccttagttacctgtgaacgtagaggttgggaggagacggacgttacggg

SEQ ID NO: 421466 - DNA, 573 bp, Homo sapiens
  misc_feature: GZ8MTXP02H6MAN.51.37.D04.1.454.CMB.2.raw
  modified_base (274)..(274): a, c, t, g, unknown or other
  modified_base (284)..(284): a, c, t, g, unknown or other
  modified_base (338)..(338): a, c, t, g, unknown or other
  modified_base (352)..(352): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggacgggtccctgacgctctcctgtacagcctctggattcaccttnagtgctactnatgagctggatccgccaggctcgagggagggctgcagtggctcactatattagngtactaagtggganaaccactattcacgcaagtacctcgtagaaggaacgggcctaattcctacctatcctaccgaagggaccaaaccgaccaaacgtacctcaacgttgtatacgtagaactaaagtcgaaactagtactaaagacgaccgaaagtaccgacgggtccgttagttaccttcgtggcgtaacggtaggttacggtacgggggaagtacggtacgttacggtacgg

SEQ ID NO: 421467 - DNA, 600 bp, Homo sapiens
  misc_feature: GZ8MTXP02HSMG6.51.37.D04.1.454.CMB.2.raw
  modified_base (406)..(406): a, c, t, g, unknown or other
  modified_base (500)..(500): a, c, t, g, unknown or other
  modified_base (552)..(552): a, c, t, g, unknown or other
  modified_base (568)..(568): a, c, t, g, unknown or other
tcagcgatcgtatacacgaccggtgctcgatttagtagcatactgttgagctctgggagaagagcccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggagggtccctgagactctcctgtgcagccctcgtggattcaccttcagtggctacttcatgagctggactcccgccaggcctccggaggggacggggctggctaggtgggtcctaccgaactattagttagtgtacgttaaagtgggggaaacaaacccatacgtttacaccggntaacgacctgtaggaaggaaacggggccctaatttctacccaattccgaccgacgggaacaaaccgccaaaagaccttcacttagtactcgtanacaaagtagaaactgtaacaaaggcgaacccgaaagaccgacggtaccgttntaccttgtggtaacgnggtacgttggaggggagacggtaacgtacggg

SEQ ID NO: 421468 - DNA, 566 bp, Homo sapiens
  misc_feature: GZ8MTXP02GEP5X.51.37.D04.1.454.CMB.2.raw
  modified_base (239)..(239): a, c, t, g, unknown or other
  modified_base (354)..(354): a, c, t, g, unknown or other
  modified_base (372)..(372): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcctcactctctgcacaggctctgaggcctcctatgagctgacacagccagcctcggtgtcagtgtccccaggacagacggccaagatcccctgctctggagatgcattgccaaaacgntttgctttttggacaacagaagcaggccaggcccctataataattatataataaagacagtgagaggccctcagggatccctgagcgatctctggcctccagctcagggacaacngccacgttgacgattagnggagtccagcagaagacgagctgactatactgtcaatcagcagacgacagtggtacttaagtggaagtagttcgggacgggaagggaaccgaaagggttcggaaccggttccgtaacgggtaccgaacggccccgtaaaagggcccttacggcccccccgttcgggtcccaaccggttctcggtttcccccccg

SEQ ID NO: 421469 - DNA, 602 bp, Homo sapiens
  misc_feature: GZ8MTXP02FOP3V.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaaggtgtccagtgtcaggtgcagctggtggaatcgtgggggagcttggtcaagcctggagggtccctgagactctcctgtgcagcctctggattcaccttcagtggctacttcatgagcgtggactccgcaggctccgaggggagggctgcagtcggtctcactatattagtgactaagtggggaacaaccatattctacggcagtaccttgtggtaggaaacggggtccctaatttcctaccctaatcccgtaccgaaacggggacctaaacccgggccaaaaggacctcaaaccgttggtaattccgaggaaccaaaagttcgaaaacctagttaccgaaaaggacgacccggaaaagaccgaaccgggcccgttagtaccttcgtaggtcggcgaaggttcggtaggggacgaacggacgttaacgggg

SEQ ID NO: 421470 - DNA, 518 bp, Homo sapiens
  misc_feature: GZ8MTXP02HIQ0S.51.37.D04.1.454.CMB.2.raw
  modified_base (358)..(358): a, c, t, g, unknown or other
  modified_base (496)..(496): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtggggggaggcttgggtcaagcctgggagggtccctgagactctcctgtgcagcctctggattcaccttcagtggctactcatgagctggatccgccaggctccgaggggagggctgcagtggtctccacatattagtgactaagtgggganaaaccagattcacgcagactctgtagaaggggcctattcctccatcctacgagggaccaacgccaaagactcactgtatcgtagacaaatgaaacagtactaagacgaccgaagacgacggccgtagtactctgtcgngagtgagggagaggactacggg

SEQ ID NO: 421471 - DNA, 642 bp, Homo sapiens
  misc_feature: GZ8MTXP02H32VJ.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagcctctggattcaccttcagtgctacttcatgagctggatcccgcaggctccgaggggagggctgcaggtcgggtctccactatattacgtgacttaagtggggacaaaccacgtatttcacgcacgtactcgtagtaggaacgggcccgtaatttccgtaccaattcccgtaccgaaggggaacccaaaccggaccaaaacggtaaccttcaaccgttaggttactacctagaacctaaaagtacggaaaactacgtacgtaaaacggacgacccggaaaagacccgaaaccgggggtccctttaggttaacccttttcggacggttaacggaccgggttaaggttacgggggtaaggggaacggtaacgggtaaccggtaacggg

SEQ ID NO: 421472 - DNA, 526 bp, Homo sapiens
  misc_feature: GZ8MTXP02I5E82.51.37.D04.1.454.CMB.2.raw
  modified_base (258)..(258): a, c, t, g, unknown or other
  modified_base (263)..(263): a, c, t, g, unknown or other
  modified_base (266)..(266): a, c, t, g, unknown or other
  modified_base (333)..(333): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagccgtgggacgggtccctgagactctcctgtgcngcctntgnttcaccttcagtgctacttcatgagctggactccgcaggctaccggaggggaggctgcaggtggtcncacatagtagtgactaagtggggaacaaccatattcgacgcaagactcgtagaaggaacgggcctattccaccattccaccgaacggacaaccggaccaaagactcactgtactctagacaagtacaacagtacaagacgacgaagacgacgctcgtacttcgagtcgagtagtggaggacgcggacgtacgg

SEQ ID NO: 421473 - DNA, 596 bp, Homo sapiens
  misc_feature: GZ8MTXP02IUGG6.51.37.D04.1.454.CMB.2.raw
  modified_base (243)..(243): a, c, t, g, unknown or other
  modified_base (259)..(259): a, c, t, g, unknown or other
  modified_base (296)..(296): a, c, t, g, unknown or other
  modified_base (311)..(311): a, c, t, g, unknown or other
  modified_base (322)..(322): a, c, t, g, unknown or other
  modified_base (363)..(363): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcctcactctctgcacaggctctgaggcctcctatgagctgacacagccagcctcggtgtcagtcgtccccaggacagacggccaagactcccctgctcgtggagatgcattgaccaaaagtnttgtcttttagacaanagacgcagcacgacctaataataatatataataaganagtagagacgacccngaggactccgngacgcgtattctcgtcgccctccgagcacgacggaacaacncgaccgtagtagacgtagtaggaggacgcgagacgaagaagacggagctagacttatactagtacaatacgacgacgaagacgacgtagttacggtaacttaggtaggtagttacggtacgggacgggaacggtaacgtaacggtacggaccgtacgtacggacgaacggacccgaacggtccgtaccccggtacccccgtcggtacctaccgttccgtttcccggtcccccg

SEQ ID NO: 421474 - DNA, 592 bp, Homo sapiens
  misc_feature: GZ8MTXP02H540U.51.37.D04.1.454.CMB.2.raw
  modified_base (191)..(191): a, c, t, g, unknown or other
  modified_base (261)..(261): a, c, t, g, unknown or other
  modified_base (359)..(359): a, c, t, g, unknown or other
  modified_base (369)..(369): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcacatggagtttgggctgagcttgggttttccttgttgctattatagaaggtgtccagtgtcaggtncagctggtggaatcgtgggggagcttggtcaagccgtgggagggtccctgagctctcctgtgcagccctngacttcaccttcagtggcttacttcatgagtctggactcccgcaggcctaccggaggggaacgggtctgcgtaggtggtctccgactattagttagtnacgttaaagnggggaaacaaacctacgtactttaccacggctagaaccttcgaggaaggaacgggaccctaatttccaccaacttcccgtacgacgggaacaaacccgcaaacgaacttcattgtattacagactaaagtcgaaacagtacaaaagcgaaaccgagaccgacggtccgtagttacctgtaggtgacggtaggttacggtagggaggaacggttaccgtaacgg

SEQ ID NO: 421475 - DNA, 588 bp, Homo sapiens
  misc_feature: GZ8MTXP02GMMZW.51.37.D04.1.454.CMB.2.raw
  modified_base (261)..(261): a, c, t, g, unknown or other
  modified_base (282)..(282): a, c, t, g, unknown or other
  modified_base (287)..(287): a, c, t, g, unknown or other
  modified_base (338)..(338): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagccgtggagggtccctgagactctcctgtgcagcctcnggattcacttcagtgctactnatganctggactccgcaggctcgaggggagggctgcagtggtctcactatattagngactaaagtggggaacaaaccatattccaacgcaagactcgtaggaagaaacgggcctaatttccacctaatccctaccgaaggggaccaaaaccggccaaaagtacctcaacgttagtaactccgtagaactaaaagtgaaaccagttaccgaaaagcgaacccgaaagaccgaccgggtccgttagttaacccgttcgtaggtcggacggtaggttacggggagggaaggacgggtacgttaacgggg

SEQ ID NO: 421476 - DNA, 512 bp, Homo sapiens
  misc_feature: GZ8MTXP02H3P5F.51.37.D04.1.454.CMB.2.raw
  modified_base (273)..(273): a, c, t, g, unknown or other
  modified_base (342)..(342): a, c, t, g, unknown or other
  modified_base (366)..(366): a, c, t, g, unknown or other
  modified_base (381)..(381): a, c, t, g, unknown or other
  modified_base (394)..(394): a, c, t, g, unknown or other
  modified_base (397)..(397): a, c, t, g, unknown or other
  modified_base (433)..(433): a, c, t, g, unknown or other
  modified_base (435)..(435): a, c, t, g, unknown or other
  modified_base (438)..(438): a, c, t, g, unknown or other
  modified_base (440)..(440): a, c, t, g, unknown or other
  modified_base (442)..(442): a, c, t, g, unknown or other
  modified_base (446)..(446): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtggtttctgtagctatatagagtgtccagtgtcaggtgcagctggtggaatcggtgggggagtcttgggtcaagccgtgggagggtccctgagactctcctgtgcagcctcgtggattcacccttnagtggctacttcatgagctgactcccgcaggctccgaggggagggctgcagtggtctcactatattagngactaagtggggaacaaaccctanattcacgcagacctngacgaaggccctntcnctctcgacgacgacacgacaatactcatatactgananaanananaganaagacgacgacgacgacgacgtacgtactcgtgtgcgacggtaggtaggacggacggtacgtacgg

SEQ ID NO: 421477 - DNA, 592 bp, Homo sapiens
  misc_feature: GZ8MTXP02F03R2.51.37.D04.1.454.CMB.2.raw
  modified_base (262)..(262): a, c, t, g, unknown or other
  modified_base (275)..(275): a, c, t, g, unknown or other
  modified_base (348)..(348): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaaggtgtccagtgtcaggtgcagctggtggaatcgtgggggagcttggtcaagccgtgggagggtccctgagactctcctgtgcagcctcgnggtactcaccttnagtggctactcatgagctggactccgcaggctccgaggggacgggctgcaggtcggtctccgatatagttagngactaagtggggaacaaacccagtactttccgaacgcaagtactcgtaggtagggaaacgggccctattcccaccgtatcctaccgaacgggaccaaaccggaccaaagtacctcacttagtactctagactaaatcgaaactagtacaaagacgaaccgaacgaccgtaacggggtcccttagttaccttacgtggtaacgtacggtaacgttggggaacggaaggtacggtacgttaccggg

SEQ ID NO: 421478 - DNA, 520 bp, Homo sapiens
  misc_feature: GZ8MTXP02FL8FR.51.37.D04.1.454.CMB.2.raw
  modified_base (342)..(342): a, c, t, g, unknown or other
  modified_base (388)..(388): a, c, t, g, unknown or other
  modified_base (391)..(391): a, c, t, g, unknown or other
  modified_base (492)..(492): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccctgagactctcctgtgcagcctctggattcaccttcagtggctacttcatgagctggatccgcaggctccgaggggagggctgcaggtcgggtctcacatattagngctaagtggggacaaccatattcacgcagactgtagaggacggctntcnccatccacgaggacaacgaccaaagacctcacttgactctagacaaatgaaactagtacaaagacgaccgaaagccgacggccgttagtaccttcgtgcgngtaggtggtagggacgacggtacgtagg

SEQ ID NO: 421479 - DNA, 812 bp, Homo sapiens
  misc_feature: GZ8MTXP02II9M6.51.37.D04.1.454.CMB.2.raw
  modified_base (259)..(259): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccctgagactctcctgtgcagcctntggattcacctttcagtggctacttcagtgagcgtggactcccgaccgaggtcctccggaagggggaacggggctaggccgtaaggttggggtcctccgaactatttaagttaggtcgtacttaaaggtcggggggaaaacaaaccccgtaaacgttacttttacccgaaacggccgtaaagtaacccgtttcgtaagggttacgggaaaaccgggggtcccggtaaactttccccgtaccctaaacgttaccccgttaacccggaaaccgggggaaacccaaaaccgggtacccccaaaaaaggtaaacccctttacccgaaactttaccgggttaaacttcccggtaagtaaccaaaaagttacgggaaaacccttaaagttaaaccgttaaaaacggaaccgggtaaccccggtaaaaacgggaacccgtaaacccgggggttccccgtttaaggggtttaaaacccttttccgtaaaggggtcggtacggggtaacggttcgggggtaacgggggtaacgggtaaacggggtaacccggttaacggggg

SEQ ID NO: 421480 - DNA, 510 bp, Homo sapiens
  misc_feature: GZ8MTXP02J226H.51.37.D04.1.454.CMB.2.raw
  modified_base (261)..(261): a, c, t, g, unknown or other
  modified_base (273)..(273): a, c, t, g, unknown or other
  modified_base (289)..(289): a, c, t, g, unknown or other
  modified_base (329)..(329): a, c, t, g, unknown or other
  modified_base (343)..(343): a, c, t, g, unknown or other
  modified_base (348)..(348): a, c, t, g, unknown or other
  modified_base (351)..(351): a, c, t, g, unknown or other
  modified_base (354)..(354): a, c, t, g, unknown or other
  modified_base (357)..(357): a, c, t, g, unknown or other
  modified_base (359)..(359): a, c, t, g, unknown or other
  modified_base (363)..(363): a, c, t, g, unknown or other
  modified_base (376)..(376): a, c, t, g, unknown or other
  modified_base (418)..(418): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttgggcaagcctgggagggtccctgagactctcctgtgcagccctntggatcaccttnagtgctacttcatganctggatccgcaggctccagggaggctgcagtggtctccantatatgacttaagnggaanacnatnacnanactnagagaaggcatcncatcacgaggacacgacaaacactcatgtatctacgacaaanagaacagtacgtaagacgacgaacgaacgaccggaccgtacgtacgtacgtcgtgtacggtacggtacggtagggacggacggtacgtacgg

SEQ ID NO: 421481 - DNA, 726 bp, Homo sapiens
  misc_feature: GZ8MTXP02H9I4T.51.37.D04.1.454.CMB.2.raw
  modified_base (291)..(291): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctgggtggaatcgtgggggagcttggtcaagcctggagggtccctgagactctcctgtgcagcctctggattcaccttcagtggctacttcatgagngtggactcccgcgaggcctccggaaggggacgggctggcgtaggtcgggtctaccgactattacgttagtgtaaccgttaaaggtcgggggaacaaacccacgtacttaccgtacggacaacggtaacttcgacggaacggggaacgggggtaccctaacgtttccctacccgtaaacgttccccgtacccgggaaacgggggaaccctaaaacccgggaccccgtaaaaaggtaaaccccttccgaaccgtttacggtaaaccttcccgtaaggaacctaaaagttacgaaaccgtaagtaaacgaaaacggacggaaaccccggtaaagacccgggaaaccggttaccggttacgttaacccgtttggtaacgggttcgaccgggtaaggttccgggggagggtaacgggaaccggggtacggtaaccggggg

SEQ ID NO: 421482 - DNA, 508 bp, Homo sapiens
  misc_feature: GZ8MTXP02HSEXA.51.37.D04.1.454.CMB.2.raw
  modified_base (292)..(292): a, c, t, g, unknown or other
  modified_base (335)..(335): a, c, t, g, unknown or other
  modified_base (343)..(343): a, c, t, g, unknown or other
  modified_base (357)..(357): a, c, t, g, unknown or other
  modified_base (364)..(364): a, c, t, g, unknown or other
  modified_base (378)..(378): a, c, t, g, unknown or other
  modified_base (391)..(391): a, c, t, g, unknown or other
  modified_base (394)..(394): a, c, t, g, unknown or other
  modified_base (416)..(416): a, c, t, g, unknown or other
  modified_base (434)..(434): a, c, t, g, unknown or other
  modified_base (436)..(436): a, c, t, g, unknown or other
  modified_base (439)..(439): a, c, t, g, unknown or other
  modified_base (443)..(443): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaggtgtccagtgtcaggtgcagctggtggaatcgtgggggagcttggtcaagccgtgggagggtccctggagtactctcctgtgcagcctctggattcaccttcagtggctacttcatganctggatccgcaggctcgaggggagggctgcagtggtctccganatattagngctaaagtgggganaaaccanattcacgcagactngagaaggcattcncanctcaggacaacgctaaagactnactgtatcagactaaaananaanatanaagacgacgacgacgacgacgtacgtacgtcgtgtgcgaggtaggtaggaggacggtacgtacgg

SEQ ID NO: 421483 - DNA, 582 bp, Homo sapiens
  misc_feature: GZ8MTXP02I28P3.51.37.D04.1.454.CMB.2.raw
  modified_base (341)..(341): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggacggtccctgagactctcctgtgcagcctcgtggattccaccttcagtgctacttcatgagctggactcccgcaggcctaccggaggggagggctgcgtaggtcgggtcncactattagttagtgacgttaagtgggggaaactaaaccactattcctacggacaagtacttcgaggaaggaaacggggtccctaattcccaccactccgtaccgaggaaccaaccggaccaaagacctcaaccttgtactccgtagaactaaagtacgaactaagtacaaggaccgaacgagaccgtacggcgttacgtacttcgtgtgacggtagtgggaggacgaggtacgtaacggg

SEQ ID NO: 421484 - DNA, 747 bp, Homo sapiens
  misc_feature: GZ8MTXP02HWZQX.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcggtgggggagtcgttggtcaaggccgtgggacgggtccctgagcttctcctgtcgcagccctcgtggacttccaccttcaggtcggcttacttcatgagtcgtggactcccgcaggcctaccggaggggaaggggctggcgtaggtcggggtctaccgactattagttagtgacgttaaggtggggaaacaaacctactactttccgaacggcacgaccttcgaggaaacggaaccggggtccctaatttccctaccgacttacccgtaacccggaacggggaaacccaaaccggacccaaaacggtaaacccttaccgaaaccgtttacggttaaactttcccgtaaaggaaacctaaaagttaacggaaaaccctaggttaaaacccgtaaaaggaccggaaaaccccggaaaggtaaccccgaaaccgggggttcccgttaacgttaacccgtttaccggtgggttaacccgggaacggttaggggtacgggggttaacgggggaaggaacggggtttaaacccggtaaacccggggg

SEQ ID NO: 421485 - DNA, 604 bp, Homo sapiens
  misc_feature: GZ8MTXP02F7IL3.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctgggtggaatcgtgggggagcttgggtcaaggcctgggacgggtccccgagactctcctgtgcagcctctggattcaccttcagtggctacttcatgagctggactccgcaggctccgaggggagggctgcagtggtctcacatatagtgactaaagtggggacaacccacgtaatttcctacggcaaggaccttcgtaggtaggaaacgggggccctaatttcctacccattcctacccgaaggggaaccaaaccggacccaaagaaccttccagttacgtactcctagaacaaaagtgaaaccagttaccgaaaagaccgaccggaaaagacccgtacggtacccgttagtaccgttcgtggtaggcgtaaggtcggtacggggaagtacggaacgtacgggtaacg

SEQ ID NO: 421486 - DNA, 677 bp, Homo sapiens
  misc_feature: GZ8MTXP02J2YKN.51.37.D04.1.454.CMB.2.raw
  modified_base (190)..(190): a, c, t, g, unknown or other
  modified_base (271)..(271): a, c, t, g, unknown or other
  modified_base (286)..(286): a, c, t, g, unknown or other
  modified_base (352)..(352): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaaggtgtccagtgtcaggtncagctggtggaatcgtgggggagcttggtcaagcctgggaggtccctgagctctcctgtgcagccctgtgacttcaccttnagtgctactcatgancgtgactccgcgaggcctcggaggggacgggctggcgaggtcggtctccgactattagttacggtntacgtaaaggtcgggggaaacaaaccacgtattccgacgacacgacttacgtaggaaacggaaccgggggccctatttcccgacctaacgttcccgtaacccggaacgggaacccaaacccggacccaaaacggtacccttacccgaactttacggtaacctttacgacggtaaaccaaaaggttacgaaaacgtacgtaaaccgtaaaggaccgaaacccggaaacgacccggtaccgggtacccgtacgttaacccgttcgtcgggtaacgtaccgggtagggtacggggtaggggacggtaaacgggtaccgttaacggggg

SEQ ID NO: 421487 - DNA, 541 bp, Homo sapiens
  misc_feature: GZ8MTXP02IRU2Y.51.37.D04.1.454.CMB.2.raw
  modified_base (251)..(251): a, c, t, g, unknown or other
  modified_base (264)..(264): a, c, t, g, unknown or other
  modified_base (319)..(319): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtggtttctgtagctatatagagtgtccagtgtcaggtgcagctggtggaatcgtgggggagcttggcaagcctggagggtccctgagctctcctgtgcagcctntggattcaccttnagtgctacttcatgagctggatccgccgaggcgtccgaggggaaggggcgtgcgnggtgggtctccacatattaagtgtacgtaatgggagaacacacttctacgacagacttgtgtagacggacgtactctcctactcgtacgacgacgaacgaaccaacgaactactacgtacgtactactacgactaataacaacgtacgtagaacgacgacgaacgacgacgtacgtacgtacgttcgtgtgtcgtacggtggtaggacggtacggacgtacg

SEQ ID NO: 421488 - DNA, 553 bp, Homo sapiens
  misc_feature: GZ8MTXP02FN4VG.51.37.D04.1.454.CMB.2.raw
  modified_base (521)..(521): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagcctctggattcaccttcagtgctactcatgagctggactccgccaggctccgaggggacgggctgcaggtggtctccgacatatagtgactaaagtggggaacaaccatattcctacgcaagactcgtaggaggaaacgggccaatttccaccatcctccgaaggacaaacggccaaagacctcacttgtaactcctagactaaaagtcgaaactagtacaaaacgacgaccgaagaccgacgggtacctacgttacttcgtagngtcgaggtggtagggacgacggacgtaacggg

SEQ ID NO: 421489 - DNA, 648 bp, Homo sapiens
  misc_feature: GZ8MTXP02GVO8P.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagtcttggtcaagccgtggacgggtccctgagactctcctgtgcagcctctggattcaccttcagtgctacttcatgagctggactccgcaggcctccggaggggacgggctggcgaggtcgggtctaccgacgtagttagtgtacgtaacgttaagggacgggaaacctaactacttacgttaccgaacgacgtaacgtactacggaggaaacgggaccggtaccttacttcccacgtactcccgaacgggaacgaaccgaaaccgaacgaaactacctactagttatacctacgtacaaacgtaagtaacgaacgtacgtaaacgaacgaaccggaaacggaaacgaacccgggaccggttacgttaacgttccgttcggtaggaacggtacggtagggtacggggaggtaacggaccggttaacggtaacggg

SEQ ID NO: 421490 - DNA, 553 bp, Homo sapiens
  misc_feature: GZ8MTXP02JAQ30.51.37.D04.1.454.CMB.2.raw
  modified_base (287)..(287): a, c, t, g, unknown or other
  modified_base (318)..(318): a, c, t, g, unknown or other
  modified_base (439)..(439): a, c, t, g, unknown or other
  modified_base (444)..(444): a, c, t, g, unknown or other
  modified_base (455)..(455): a, c, t, g, unknown or other
  modified_base (519)..(519): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccctgagactctcctgtgcagcctctggattcaccttcagtgctactcatganctggatccgccaggcctccgggaaggggcgngcgagtggtcgtcacactatagtgctagtagggaggaaccacacttactaccgacgacgactcgtagtggaacgggcggacttcgtccactcgtacccagggacgaacgtaccaacgaacnctacngttatacctanacaatacgacagtagaacgacgaaccgacgacgaccggtcgtacgttactcgtgtcggaacggnggtacggtacggaggacggtacggtacggtacgg

SEQ ID NO: 421491 - DNA, 673 bp, Homo sapiens
  misc_feature: GZ8MTXP02I1MZA.51.37.D04.1.454.CMB.2.raw
  modified_base (269)..(269): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcgttggtcaagccgtgggacgggtccctggacgactctcctgtcgcagccctcnggacttccaccttcagtggcctacttcatgagctggactcccgcaggcctaccggaaggggacggggctggccgtaggtcgggtcctaccgactattatttaggtcgaacttaaaggtcgggggaaacaaacccgactactttaccgacgactaaagtactacgtagaggaacgggaccgtacgttctacctacgtcctaccgaacggaccgaaaccgaccgaaacgaactacctacgtacgtactacgtacgaactaaagtaacgaacgtaacgtacgtaaacgaacggaaccgaacggaaaaaaaaccgaccgggtaaccggttacgttaccgttaccgttaggtaacggtacggtacgggttacgggtaggggaacgggtaacgggaacggtaaaccgggg

SEQ ID NO: 421492 - DNA, 541 bp, Homo sapiens
  misc_feature: GZ8MTXP02HI9H1.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctggtgcagcctctggattcaccttcagtggctacttcatgagctggactccgcaggctccgaggggagggctgcaggtgggtctccgacatattagtgacttaagtgggggaacaaaccactattcctacgcagactcgagaggaacgggccgtattctccatcctccgagggaccaacgccaaagactcatgtatctgacaaatgaacagtactaagacgaccgaagaccgacgggtccgtagtaccgttctggtcgacgtaggtcggtaggggacgaggtacgtacgggg

SEQ ID NO: 421493 - DNA, 550 bp, Homo sapiens
  misc_feature: GZ8MTXP02JPN3G.51.37.D04.1.454.CMB.2.raw
  modified_base (510)..(510): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagcctctggattcaccttcagtggctacttcatgagctggatccgccaggctccgaggggagggctgcaggtgggtctccacatattagtgactaagtgggggaacaaccactattcacgcagacctcgtagagaacggggcctattcctccatcctaccgagggaccaaacgccaaagaacctcactgtactcgtagacaaaagtcgaaacagtactaaagacgaccaaaaggaccacggtaccgtagtaccttntacggtgcggtaggtcggtagggaggtacggacgtacggg

SEQ ID NO: 421494 - DNA, 661 bp, Homo sapiens
  misc_feature: GZ8MTXP02JEID1.51.37.D04.1.454.CMB.2.raw
  modified_base (441)..(441): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggacgggtccctggagactctcctgtgcagcctctggacttcaccttcagtgcttacttcatgagctggactcccggccaggcctaccggaggggaacggggctggcgaggtggggtcctccgactattagttagtgtacttaagtgggggaacaaacctactactttcaacgcagtactcgtaggaacgggaacgggtcccgtaatttcccncctaacttcccgtaacccggaacggggaacccaaaccgggacccaaaaggaacccttaccaccttggttattcccgtagaaccaaaagtacgaaactaacggtactaaaagaacggacccggaaaggaaccgtaaccgggtccgtttacgtaacccgtttcgtagggtaacgacggtaacgggttcgggaggggacgggtaaaggtccgttaaacggggg

SEQ ID NO: 421495 - DNA, 682 bp, Homo sapiens
  misc_feature: GZ8MTXP02H22HV.51.37.D04.1.454.CMB.2.raw
  modified_base (191)..(191): a, c, t, g, unknown or other
  modified_base (290)..(290): a, c, t, g, unknown or other
  modified_base (352)..(352): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtncagctggtggaatcgtgggggagcttggtcaagcctgggagggtccctgagactctcctgtgcagcctctggattcaccttcagtggctacttcatganctggactcccgcaggcctccgaggggaagggctgacgaggtgggtctcgactatacttagtnactaagtggggaaacaaccacgtattcctacggcaagacctcgtaggaacggaaacgggggcctaagtttcctacccgtaattccccgttaacccggagggggaaaaccccaaaccggaccccgaaaaggtaaacccttccgaaaccgttggtaactacgttaacggaacctaaaaagttacgaaaacccaggtttaacccgaaaaaggaccggaaaccccggaaaacgaaaccccgaaaccggggtcccgttaacggttaaccctttcggtaggttaacggaccggtaggttcggggtagggaacggtaacggtacgtaaacccggggg

SEQ ID NO: 421496 - DNA, 758 bp, Homo sapiens
  misc_feature: GZ8MTXP02I5HMB.51.37.D04.1.454.CMB.2.raw
  modified_base (357)..(357): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttcctgttgctattatagaggtgtccagtgtcaggtgcagctggtggaatcgtgggggagcttggtcaagcctgggacgggtccctgacgactctcctgtgcagtcctctggacttcaccttcgagtggctacttcatgagctggactccgcaggcctcgaggggagggctggctaggtcggtctaccgactattacgttaggngtacttaaggtgggggaaacaaacccgtacttaacttccgtaacgcgtaaagtaacctcgttaggtacgggaaacggggtcccgttaactttcccgaccctaaacgttcccgtaacccggaacgggggtaaacccaaaacccggaccccgtaaaaaggtaccccttaccgtaaacccgttaggttaaacctccggttaacgaaacctaaaaacgttaccgggaaaacctaaagggtttaaccgtaaaacggaacccgggtaacccggtaaaaacggtaccccggaaacccgggggttccccgtttaagggtttaaccctttccgtaaaggggttccggacggggttaacggtacggggttacggggggtaaacgaaacggggtaaccccgttaaacggggg

SEQ ID NO: 421497 - DNA, 712 bp, Homo sapiens
  misc_feature: GZ8MTXP02IQ3TQ.51.37.D04.1.454.CMB.2.raw
  modified_base (266)..(266): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagtcttggtcaagccgtgggacgggtccctgacgctctcctgtgcacgccctntggattccaccttcgagtcggcttacttcagtgagcgtggactcccgccgaggccgtaccggaaggggacgggctggcgtaggtcgggtactaccgactagttagtttagtcgtaaccgttaaaggtcgggggaaactaaaaccctacgtaacgtttcccgaacggactaaacggtaccttcgtaggtaacgggaaaccggggtcccttaatttcccgtacctaacgttcccgtaacccgggaaggggaaacccaaaccggacccaaaacggtaaccttcaaccgtttaggtaactaccgtacgaactaaaagtacggaaactacgttaaacgaaaaggaaccggaccgaaaacggtaccgaccgggttacgttacgttaccgtttcgtaggtaacggtacggtagggttacgggaggggaacggtaacgggtaaccggtacgggg

SEQ ID NO: 421498 - DNA, 612 bp, Homo sapiens
  misc_feature: GZ8MTXP02G6L9P.51.37.D04.1.454.CMB.2.raw
  modified_base (296)..(296): a, c, t, g, unknown or other
  modified_base (436)..(436): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggaggtccctgagactctcctgtgcagcctcgtggacttcaccttcagtggcctattcatgagctggntccgcaggctccgaggggaacgggctggcgtaggtgggtctccgacaattattaggtgacttaaggtcgggggaacaaacccactactttctaacggcaaggtaacctcgtaggaaggaaacggggtcccgtaatttccnccaactttcccgaacccgaaggggaaccaaaccggacccaaagaaacctcaaccgttgtaactcctaggaacaaaatacgaactaagtcgaaaaggacgacccgaaagaccgaacggtcgtacttaccgttgaggtaagcggtacggtacggtagggacggaggtacggtaacggg

SEQ ID NO: 421499 - DNA, 595 bp, Homo sapiens
  misc_feature: GZ8MTXP02IPVDK.51.37.D04.1.454.CMB.2.raw
  modified_base (223)..(223): a, c, t, g, unknown or other
  modified_base (241)..(241): a, c, t, g, unknown or other
  modified_base (476)..(476): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcctcactctctgcacaggctctgaggcctcctatgagctgacacagccagcctcggtgtcagtgtccccaggacagacggccaagactcccctgctctgganatgcattgaccaaaagtntttgtcttttggtaaccaacagaacgccaggccacggcccctaataataattatataataaagacagtgagacgcctagaggactccctgacgcgtattctcgtggccctccagctacgagggacaacgcgacctaacgttacgacgtattaggtggtaacgtccgaggacaaggaagacggagctaggaactattacgtgtacaaatcaagcagacgacagttagtacttaagnggtaagtaggttacgggacggaacgggtaccgaagggtacgaccgttcggtaacggtacgacggacccgaaggcccgtcggacccccgtacggtaccgtacctccgttccggtcccccg

SEQ ID NO: 421500 - DNA, 559 bp, Homo sapiens
  misc_feature: GZ8MTXP02G92S0.51.37.D04.1.454.CMB.2.raw
  modified_base (249)..(249): a, c, t, g, unknown or other
  modified_base (252)..(252): a, c, t, g, unknown or other
  modified_base (467)..(467): a, c, t, g, unknown or other
  modified_base (473)..(473): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggaggtccctgagactctccngtncagcctctggattcaccttcagtgctactcatgagctggactccgccaggcctacgaggggagggctggcaggtcggtctccacattagtagtgacttaaagtggggaacaaacactacttcacgcagtactcgtaggtagaacgggcctatttccgaccatccacccgagggaaccaaacgccaaaagacctcgatcgtatctagactaaaagngaaacngtacgaaaagcgaacgtaagaccgacggtccttgtacccttgtacggcgacgtaagggtcggaggggaagtacggtaacgtacggg

SEQ ID NO: 421501 - DNA, 579 bp, Homo sapiens
  misc_feature: GZ8MTXP02FIHD4.51.37.D04.1.454.CMB.2.raw
  modified_base (262)..(262): a, c, t, g, unknown or other
  modified_base (334)..(334): a, c, t, g, unknown or other
  modified_base (416)..(416): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtggggggagcttggtcaagcctgggacgggtccctgagactctcctgtgcagcctntggattcaccttcagtggctactcatgagctggactccgccaggctccgaggggagggctgcaggtcggtcncacatatagtgactaagtggggacaaccatactttcacgcagtactctaggaaggaacggggtcccaatttccacccatccnccgaaggggaccaaaccggcccaaagaaccctcgacttagtatccgtagactaaaagtcgaaactaagttcaaaaggacgacccgaaaggaaccaccggggtaccgttagtaccttcgtaggtaacggcggtaggtcgggtaggggagacgggactacggggg

SEQ ID NO: 421502 - DNA, 704 bp, Homo sapiens
  misc_feature: GZ8MTXP02IKE9B.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagtcttgggtcaagcctgggacggtccctgacgactctcctgtgcacgccctcgtggacttccaccttcaggtcggtaccttacttcatggacgcgtaggactcccgccagggcctccggaaaggggacggggtctggccgtagggttcgggtcctaccgaacgtaatttagttttaacgggacgtaacgttaagggtacggggaaaccaaacccgtacgttacgttaccgacgactaaacgtactacggtaagggaaacgggaacgggtacccgttaactacccgtacccttaacgtcccgtaaccggaaacggggaaacccaaacccggtaccgaaaacgtaccctactacgttagtaactcgtaagaaactaaagtacgaaacgtacgtaacgaacggaacggaccgaacgaccgacgggacctttgtaccttcggtggtaacggtacggtagggtcggtacgggggagtacggggtaacctacgggg

SEQ ID NO: 421503 - DNA, 575 bp, Homo sapiens
  misc_feature: GZ8MTXP02HR359.51.37.D04.1.454.CMB.2.raw
  modified_base (259)..(259): a, c, t, g, unknown or other
  modified_base (344)..(344): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggcaagcctgggagggtccctgagactctcctgtgcagcctntggattcaccttcagtggctactcatgagctggactcccgccaggcctcgaggggaggggctgcaggtggtctcacattattagngacttaagtggggacaaaccatacgtttcacgcagactctggaagaacgggccgtatttccacccaattcccgaccgaaggggaaccaaaccgccaaaagtaacctcaacttgtaatccgtaggaaccaaaagtcgaaactagtactaaagggaacgacccggaaaagaccgaaccgggtcctacggttacttcgtgtaagcgtaggtggagggagacgggtacgtacggg

SEQ ID NO: 421504 - DNA, 651 bp, Homo sapiens
  misc_feature: GZ8MTXP02HNU7Y.51.37.D04.1.454.CMB.2.raw
  modified_base (191)..(191): a, c, t, g, unknown or other
  modified_base (287)..(287): a, c, t, g, unknown or other
  modified_base (292)..(292): a, c, t, g, unknown or other
  modified_base (299)..(299): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtncagctggtggaatcgtgggggagcttggcaagcctgggagggtccctgagactctcctgtcgcacgcctctggacttccaccttcagtgctacttnatgancgtgacnccgacgacgccgacggaggggacggctggacgtaggtcggtctaccatagttagttagtacgtaacgttaaggtcgggaaactaaacctaacgttacttaccgaacgacaacgtactacgaggaacggaaccggtacttacttccacctacgttacccgaccggaaacggaaacccaaaccgtaccgaaaacgtaaccttacgtaacgttacgtaactacgtaagaactaaacgtaacgtaaacgtaacgtaaacgtaaaacgaacggaacgaaacgaaccgaccggtacgtacgtacgttacgtacgtcggtacggtacggtacggtagggacggaacggtaacggtacgg

SEQ ID NO: 421505 - DNA, 619 bp, Homo sapiens
  misc_feature: GZ8MTXP02IHANH.51.37.D04.1.454.CMB.2.raw
  modified_base (192)..(192): a, c, t, g, unknown or other
  modified_base (279)..(279): a, c, t, g, unknown or other
  modified_base (289)..(289): a, c, t, g, unknown or other
  modified_base (294)..(294): a, c, t, g, unknown or other
  modified_base (325)..(325): a, c, t, g, unknown or other
  modified_base (351)..(351): a, c, t, g, unknown or other
  modified_base (361)..(361): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtncagctgggtggaatcgtgggggagctttggtcaagccgtgggacgggtccctgagctctcctgtcgcagcctgtggacttcaccttnagtgctactnatganctggactccgcaggctacgaggggacgggcngcaggtggtctaccacattagttagngtacgtaagnggggaacaaacccagtaactttccacgacacgtcttcgtaggtacggaacgggcccttaatttcccgacctattccccgaaccggacgggaacctaaaccggacccaaagtaaccttacaacgtttagtactctagaactaaagtacgaaactaggtaacaaacggacgacgtaaacgaccacgggtacccgttattaaccgtttcgaggttaagcggttaaggttgggtaggggaacgtaacgggacgttaacgggg

SEQ ID NO: 421506 - DNA, 608 bp, Homo sapiens
  misc_feature: GZ8MTXP02H0DKQ.51.37.D04.1.454.CMB.2.raw
  modified_base (341)..(341): a, c, t, g, unknown or other
  modified_base (360)..(360): a, c, t, g, unknown or other
  modified_base (567)..(567): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagccgtggagggtccctgagactctcctgtgcagcctctggattcaccttcagtgctacttcatgagctggatcccgcaggctccgaggggaggctgcaggtggtctcactatatagtnactaagtggggaacaaccncatttaccacgactagtactcgtggtacggaacgggccctaatttccctacccgtacttccgacccgaggggaaccaaaccggtacccgaaaacggtaaccttaccgaaccttaggttaaacttccgacggaaacctaaaagtacggaaacctaagtaccgtaaaagcgaaccggaaagtaccgaacgggtccgttagtactttcgngtaacggcggtaggtcgggtagggacgtacggtaacgtcgg

SEQ ID NO: 421507 - DNA, 691 bp, Homo sapiens
  misc_feature: GZ8MTXP02JBSBK.51.37.D04.1.454.CMB.2.raw
  modified_base (350)..(350): a, c, t, g, unknown or other
  modified_base (359)..(359): a, c, t, g, unknown or other
  modified_base (365)..(365): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagcctcgtggattcaccttcagtcggctacttcatgagctggactccgccaggctccggaggggagggctggcaggtcggtctccgacatattagngacttaagngggganaaacccatacttacctacggcaagtacctcgtaggaacgggtaaacgggcccgttaattcccgtaccctaacgttcccgtaacccggaaacgggggaaacccaaacccggaaccccgaaaacggtaaacccttaccgtaaccgttacggttaacttacccgttagaaacctaaaagttacggaaaacctaagttacccgtaaaaggaaccggaacccggaaaaggacccgaccggggtacccgtttaggttaaccctttcggttaggttcggacgggtaacggttcggggtaggggtaacggaacggggtaacggtttaaccgggg

SEQ ID NO: 421508 - DNA, 562 bp, Homo sapiens
  misc_feature: GZ8MTXP02JTZ0V.51.37.D04.1.454.CMB.2.raw
  modified_base (275)..(275): a, c, t, g, unknown or other
  modified_base (380)..(380): a, c, t, g, unknown or other
  modified_base (391)..(391): a, c, t, g, unknown or other
  modified_base (411)..(411): a, c, t, g, unknown or other
  modified_base (435)..(435): a, c, t, g, unknown or other
  modified_base (452)..(452): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagcgtgggtggaatcggtggggggagcgttgggtcaaggccgtggggacgggtccctggacgtactctcctgtgcacgcctntggattcaccttcagtcgctacttcatgagctggactccgcgaggctccgaggggagggctggcaggtggtctcactattatagtgactaagtggggaacaaccntattcacgcanactgaggagacggctattcncatcacgaggacacgcaaagactnacgtgtactctacgaanaaagtcgaaactagtacaaaggacgaaccggaacgaccggaccggtaccgttacgtaacctttcgaggtcggcggtaggtcggggtagggaggtacgggacgtaacgggg

SEQ ID NO: 421509 - DNA, 845 bp, Homo sapiens
  misc_feature: GZ8MTXP02HY6IP.51.37.D04.1.454.CMB.2.raw
  modified_base (294)..(294): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctgggtggaatcggtgggggaggcgtttgggtacaaggccgtggggacgggttcccctggacgacttctcctggtgcagccctcgtggacttcacccttnagtgctactcatgagctggactcccgacgaggccgtaccggaagggggaacgggcctggacgtaggggtcgggtctaccccgaagtagttattaggtgtaaccgtttaaagtcgggggaaaacaaaaccctaccgttaaactttcccgtaacggacctaacgtaacccgttcgtaggggttacgggaaaaccgggggtcccccgttaatttccccgttacccgaaactttcccccggaaacccccgggaaagggggtaaacccccaaaaaccccggggtaaccccaaaaacggtaaaaccccttaccgtaaaaccggtttaggttaaacctttaccccgttaagggaaaacccttaaaaacggttaggaaaaaacccgttagggttaaaacccctaaaaaggggacccggtaaacccggggaaaaacgacccggtaaaccggggggtcccccttttaagggttaaaaccctttttcggaaggggtttccggacggtaaaggtttccgggggaaggggaacgggtaaaacggttaaccggttaacccggggg

SEQ ID NO: 421510 - DNA, 570 bp, Homo sapiens
  misc_feature: GZ8MTXP02F654X.51.37.D04.1.454.CMB.2.raw
  modified_base (261)..(261): a, c, t, g, unknown or other
  modified_base (264)..(264): a, c, t, g, unknown or other
  modified_base (268)..(268): a, c, t, g, unknown or other
  modified_base (353)..(353): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagtcttggtcaagcctgggaggtccctgagctctcctgtgcagcctcnggnttcnccttcagtcgctacttcatgagctggactccggccaggctaccggaggggaggggctgcgaggtgggtctccgactatattagtnacttaagtggggaacaaccatattccacgcagacttcgtagagacgggtcccatttccctaccgattcccgtaccggaacgggaaccaaccggaccaaaacggacctcgaactagtatcctagaacaaagtcgaaactagtaacgaaggacgacgaaagacgacggccgtagtacttcgagtgacgtaggtcggtaggaaggacggacgttaacggg

SEQ ID NO: 421511 - DNA, 528 bp, Homo sapiens
  misc_feature: GZ8MTXP02I6BJ6.51.37.D04.1.454.CMB.2.raw
  modified_base (325)..(325): a, c, t, g, unknown or other
  modified_base (377)..(377): a, c, t, g, unknown or other
  modified_base (402)..(402): a, c, t, g, unknown or other
  modified_base (408)..(408): a, c, t, g, unknown or other
  modified_base (445)..(445): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggaggcttggtcaagcctgggagggtccctgagctctcctgtgcagcctctggacttcaccttcagtggctacttcatgagctggactccgccaggctccgaggggagggctgcnggtggtctcacatattagtgactaagtggggaacaacccatattctacgcanactctaggaggaacgggcctattcnccatcncgaggacaacgaccaagactcactgatctgacaaatnaactagtacaaagacgaccgaaagccgaacggccgtcgttacttcgtggtcgcgtaggttggagggaggacggacgtacgggg

SEQ ID NO: 421512 - DNA, 618 bp, Homo sapiens
  misc_feature: GZ8MTXP02I9AJ4.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagccgtgggacgggtccctggagactctcctgtgcagcctctggattccaccttcagtcggctacttcatgagctggactccgccaggctccggaggggacggggctggcaggtggtctccactattattagtgacttaagtgggggaacaaaccatattccgtacgacaggtaccttcgtggtaggaacgggtccctatttcctaccctagtcctaccgagggaaccaaccgaaccaaagaacctcaacgttgtaactctacgaactaaaagtacgaaacgtacgtacgaaaaggacgaaccggaaaacgaccggtaaccggtcccgttacgttaccgtttcgtcggtcggacggtaagggtcggtaggggacggtaacgggacgttaacgggg

SEQ ID NO: 421513 - DNA, 789 bp, Homo sapiens
  misc_feature: GZ8MTXP02IJUBP.51.37.D04.1.454.CMB.2.raw
  modified_base (284)..(284): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtaggaatcgtgggggagtcgttggtcaagccgtgggacgggtccctggacgactctccgtgtcgcagcctctggacttcaccttnagtcgtctacttcagtgagtcgtaggactccgcgaggccgtaccggaggggacggtctaggcgtaggtcgggtctaccgactattagttacggtagtacgttaaaggtcggggaaactaaaccgtacttacgtttaccgtaccggactacggtaaccttcgtaaagggaacgggaaaaccggggtccctttaaacgttttccccgaacccgttaacgtttaccccgtaacccgggaaaacgggggtaaaaccccaaaacccggtaaaccccgtaaaacggtaaacccctttacggtaacctttaacgggttaaactaccgttaacggaaaacctaaaagtttaacggaaaaccttaacggtaaaccgtaaaacgggaccggtaaaacccgggaaacggaaacccggtaacccggggtaccgtttaacgttaaccgtttcggtagggttaacggacggttacgggttaggggtaccggggtagggaacggttaacggtaaccgggg

SEQ ID NO: 421514 - DNA, 577 bp, Homo sapiens
  misc_feature: GZ8MTXP02IVRCZ.51.37.D04.1.454.CMB.2.raw
  modified_base (260)..(260): a, c, t, g, unknown or other
  modified_base (288)..(288): a, c, t, g, unknown or other
  modified_base (339)..(339): a, c, t, g, unknown or other
  modified_base (370)..(370): a, c, t, g, unknown or other
  modified_base (459)..(459): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtgggtttcctgttgctattatagaaggtgtccagtgtcaggtgcagctggtggaatcgtgggggagcttggtcaagccgtgggagggtccctgagactctcctgtgcagcctntgattcaccttcagtgctacttcatganctggactccgcaggctcgaggggagggctgcagtggtctcgacatattagnactaagtggggaacaaccgactattcaacgnacgtactgtaggaacggaacggtcctaattcccacctactccgacggaacggacaaaccgaccaaacgactacgacgttagtactcganaactaaagaacgaacgtaacgtacgtaacgaacgacgaaacgaacgaccggtaccgtacgttaccgttcgtcgtaacggtacggtacggtacggtagggacggtacggtacggtacgg

SEQ ID NO: 421515 - DNA, 573 bp, Homo sapiens
  misc_feature: GZ8MTXP02F9FTE.51.37.D04.1.454.CMB.2.raw
  modified_base (422)..(422): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggaggcttggtcaagcctgggagggtccctgagactctcctgtgcagcctctggattcaccttcagtggctacttcatgagctggactccgccaggcctccgaggggagggctgcgaggtgggtctccgacatattagtgacttaagtggggaacgaaaccactattcctaacggcagaccttcgtggtaggaaacggggcccgtatttccncctaatccgtaccgagggaccaaaccggccaaagactacactgtaactcgtagacaaagtacgaactagtaccaaagacgaaccggaaagaccgacgggtccgtagtacttcgtgtcgacggtaggtgggtaggagagggtacgtaacggg

SEQ ID NO: 421516 - DNA, 600 bp, Homo sapiens
  misc_feature: GZ8MTXP02IZ84Y.51.37.D04.1.454.CMB.2.raw
  modified_base (333)..(333): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctgggtggaatcgtgggggagcttggtcaagcctgggagggtccctgagactctcctgtgcagcctctggattcaccttcagtggctacttcatgagctggactccgcaggctccggaggggagggctgcaggtggtcnccgactatattagtgactaagtgggggaacaaaccactattctacgcaagactctaggaaggaacggggccctatttccacctattacccgaccggaagggaacccaaaccggaccaaaagaaccctcaacttagtacttccgaataacaaagtacgaaactagtaaacgaaacgacggaacgaaacggaccggtaccggtaccgttacgttacttcggtaggtcggtacggtaggtacggggagggacggtacggtaacggtacgg

SEQ ID NO: 421517 - DNA, 626 bp, Homo sapiens
  misc_feature: GZ8MTXP02JUWIQ.51.37.D04.1.454.CMB.2.raw
  modified_base (191)..(191): a, c, t, g, unknown or other
  modified_base (269)..(269): a, c, t, g, unknown or other
  modified_base (278)..(278): a, c, t, g, unknown or other
  modified_base (349)..(349): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtncagctggtggaatcgtgggggagtcgttggtcaagccgtgggacgggtccctgacgctctcctgtgcagcctcgtggnttcaccttnagtggctacttcatgagctggactcccgaccaggcctccggaggggaacgggctagcgtaggtcgggttcnccgactattagttaggtgacgtaagtgggggaaccaaacctacgtattccgacgcagactgtaggaagaacgggccgtaattccgtaccacgttcccgtaccggaacggaaccaaaccgaaccgaaacggtaaccctacgtaacctttggtaacttcgtacgaactaaagtacgaaacagttaacgaaggaccgaacgaaacgaccgaccggtccgtacgttaccttcggagtcggtcggtaggtcggtaggggaacgtaacggggacgtaacgggg

SEQ ID NO: 421518 - DNA, 706 bp, Homo sapiens
  misc_feature: GZ8MTXP02GLGYK.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagcctctggattcaccttcagtgctacttcatgagctggactccgccaggcctaccggaggggacggggctggcgtaggtcggggtctaccgacgtattagttaggtagtacgttaaaggtcgggggaaactaaacccaacgttactttacccgtaaccggacaacggtacccttcggtaggaaacgggaaacgggggtcccgttaatttccccgtaccctaacgttcccgtaacccgggaaacggggaaacccaaaacccgggaaccaaaacggtaacctacctaaccgttagttaacttccgagtaacaaaagttacggaaactacgttaaccgaaaaggaccgaaccggaaaagaccggtaaccgggtcccgttacgttacccgttcgtagggtcggtacgggttaagggtggggtagggggaacggtacggggtaccgttaacggggg

SEQ ID NO: 421519 - DNA, 699 bp, Homo sapiens
  misc_feature: GZ8MTXP02H3YD8.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagccgtgggacgggtccctgagactctcctgtgcagcctctggattcaccttcagtggctacttcatgagctggactcccgcaggctaccgaggggacgggctggcgaggtcgggtactccgactattagttaggtgtacgttaagtcgggggaacaaaccacttaagttcctaacggctaaggtacctgtaggtacggaacggggtcccgtaatttccgtaccctaacttcccgtacccggaaacggggaacccaaaccggtaaccccgaaaacggtaaacccttacgaaaccgtttagggtaaccttaccgtacggaaccttaaaagtacggtaaaacctaaggtaacccgtaaaagggacgaaacccggtaaacggaacccgtaacccggggtaccgtttacgtacccgtttcgtaggttaacggaccggtaaggttcggggtaggggaacggtacgggtaacggtaccgggg

SEQ ID NO: 421520 - DNA, 584 bp, Homo sapiens
  misc_feature: GZ8MTXP02IC6K1.51.37.D04.1.454.CMB.2.raw
  modified_base (265)..(265): a, c, t, g, unknown or other
  modified_base (412)..(412): a, c, t, g, unknown or other
tcagcgatcgtatacacgaccggtgctcgatttagtagcatactgttgagctctgggagaagagcccccagtcccagaattcccaggagtttccattcggtgatcagcactgaacacagaggactcaccatggagtttgggctgagcttgggttttccttgttgctattatagaaggtgtccagtgtcaggtgcagctgggtggaatcgtgggggagcttggtcaagcctgggacgggtccctgagactctcctgtcgcagcctntggattcaccttcagtgctacttcatgagctggactcccgccgaggccgtaccgagggggaacggggctaggcgaggttcgggtctccgactatattagtgtactaaaggtggggaacaaccacgtacttaccgcgacagacccttnaggaaggacgggcctattccgtcactcgtaccgagggaccaaaccggacaaagactcgactagtatcagacaaagtcgaaactgtacaaacggacgaccgaaagacgacggtacctagttaccttcgtaggtcggacgtaggtcggtagggacggtaacgtacggtaacggg

SEQ ID NO: 421521 - DNA, 509 bp, Homo sapiens
  misc_feature: GZ8MTXP02FYT4I.51.37.D04.1.454.CMB.2.raw
  modified_base (352)..(352): a, c, t, g, unknown or other
  modified_base (386)..(386): a, c, t, g, unknown or other
  modified_base (410)..(410): a, c, t, g, unknown or other
  modified_base (427)..(427): a, c, t, g, unknown or other
tcagcgatcgtatacacgaccggtgctcgatttagtagcatactgttgagctctgggagaagagcccagtcccagaattcccaggagtttccattcggtgatcagcactgaacacagaggactcaccatggagttgggctgagctgggtttccttgttgctattatagaaggtgtccagtgtcaggtgcagctgtggaatcgtggggagcttggtcaagcctggagggtccctgagactctcctgtgcagctctggatcaccttcagtggctacttcatgagctggatccgccaggctccgagggaagggctgcagtggggtctcacatattagtgctaagtggagaaaccncattctacgcagactctgaagaagggccgattcnccatctcaggacacgccaagactnactgtatctgacaaatnaaacagtctaaaagacgaccgaaagacgaacggccgtacgtaacctctggtgcgtaagtggtggagaacggactaaccgggg

SEQ ID NO: 421522 - DNA, 558 bp, Homo sapiens
  misc_feature: GZ8MTXP02GYON1.51.37.D04.1.454.CMB.2.raw
  modified_base (264)..(264): a, c, t, g, unknown or other
  modified_base (355)..(355): a, c, t, g, unknown or other
  modified_base (425)..(425): a, c, t, g, unknown or other
  modified_base (464)..(464): a, c, t, g, unknown or other
  modified_base (476)..(476): a, c, t, g, unknown or other
  modified_base (522)..(522): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagccgtgggacgggtccctgagactctcctgtgcagcctcnggattcaccttcagtgctactcatgagctggactccgccaggcctccgaggggacgggctggcgaggtcgggtctaccgactattattagngtactaaagtgggggaaacaacccatactttccaacgcacgactcgtaggtaggaacggggcctattccnccgatcctaccgaggaaccacgcaaagactcactagtanctgaactaaagngaaactgtacaaaggacgaccgaaagccgacggccttagtaccttnggtcgcggtaggtggagggacgacggtacgtacggg

SEQ ID NO: 421523 - DNA, 634 bp, Homo sapiens
  misc_feature: GZ8MTXP02JNLLH.51.37.D04.1.454.CMB.2.raw
  modified_base (352)..(352): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggaggtccctgagctctcctgtgcagcctctggacttcaccttcagtggactacttcatggagctggactcccgccaggctccgaggggacggggctggcaggtggtctccgactattacttagngtacttaaaggtggggaacaaacccataacttccgtaacgcagaaccttcgaggaacggaaacggggccctattccgtcccaattcccgtaccgaacggggaaccaaaccggacccgaaaacgtacctactaacgtagtactcgtagaactaaagtacgaaacgtaggtactaaaaggacgaaccggaaacgaaccgtaccgggtaccgttacgtaaccgtttccgaggttaacggacggtaagggttcgggaaggggacggacgggtaacgttaacggggg

SEQ ID NO: 421524 - DNA, 712 bp, Homo sapiens
  misc_feature: GZ8MTXP02G2ET7.51.37.D04.1.454.CMB.2.raw
  modified_base (260)..(260): a, c, t, g, unknown or other
  modified_base (351)..(351): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagcctntggattcaccttcagtggctacttcatgagctggactccgccaggctaccgaggggaagggctgcgaggtcgggtctcgactatagttagngtacgtaagtcggggaacaaccacgtactttaccgaacgactacggtaaccttcgttaggtacgggaaacgggggcccttaagtttcccctaccctaacgttacccgttacccgaaacgggggaaacccaaaacccgggaccccaaaaacggtaaacccttaccgtaacccgtttaggttaaacttacccgttaggaaaccctaaaagttacggaaaacctaagttaaccgtaaaagggaaccgaacccggaaaacggacccgaacccggggttaccgttacgtttaaccgttccgttgggttaacggacggttaagggttcggggtacgggggaacggtacggggtaacgttaacggggg

SEQ ID NO: 421525 - DNA, 714 bp, Homo sapiens
  misc_feature: GZ8MTXP02JC6C9.51.37.D04.1.454.CMB.2.raw
  modified_base (258)..(258): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggaggtccctgagactctcctgtgcagcctntggacttcaccttcaggtgctactcatgagcgtggactccgcaggcctaccggaggggacggctgcgtaggtcgggtctaccgaactagttaagttaggtcgtaacgttaaggtcgggggaaacaaaccctaacgttacgtttccgtaacggaccgtacggtaaccgttccgttagggtacgggtaaaacgggggtcccttaacgttttcccctaccctaacgtttccccgtacccgggaaacggggaaaccctaaaaccccggacccgtaaaacgtaaccttcgaactttacgggttacttaccgtaacgtactaaaacgttacggaaacctacggttaaacgaaaacgaaccggaccgaaacggaaccgaccggggtacccgtttaggtttaacctcggttaggtccgtacgggagggttacggggagggacggtaacggtaacggttacgggg

SEQ ID NO: 421526 - DNA, 597 bp, Homo sapiens
  misc_feature: GZ8MTXP02GASHT.51.37.D04.1.454.CMB.2.raw
  modified_base (241)..(241): a, c, t, g, unknown or other
  modified_base (315)..(315): a, c, t, g, unknown or other
  modified_base (358)..(358): a, c, t, g, unknown or other
  modified_base (397)..(397): a, c, t, g, unknown or other
  modified_base (406)..(406): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcttcactctctgcacaggctctgaggcctcctatgagctgacacagccagcctcggtgtcagtgtccccaggacagacggccaagatcccctgctctggagatgcattgaccaaaacgtntttgtctttttggtaccaacagaagccaggccaggcccctataataattatatataaagacagtgagagccctnagggatccctgagcgattctctggcctcagctcgaggacaacngccacgttgacgattagtgagtccagcagaagacgagcngactatacngtacaatcagcagacgaacgagtacggtaacttagtagggaattagttacggggacgggaacggggtaaccgaaaggggtcgtaacccggtaccgttaacggggttaccgaaaccggccccgaaaagggcccgtacccggtcccccccgttacgggtaccctaaccgttcccgttaccggtttcccccccg

SEQ ID NO: 421527 - DNA, 542 bp, Homo sapiens
  misc_feature: GZ8MTXP02HEQ75.51.37.D04.1.454.CMB.2.raw
  modified_base (287)..(287): a, c, t, g, unknown or other
  modified_base (330)..(330): a, c, t, g, unknown or other
  modified_base (352)..(352): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccctgagctctcctgtgcagcctctggattcaccttcagtggctactcatganctggactccgccaggctccgaggggagggctgcgagtgggtcncactatattagtgacttaaggngggaacaaccactattcacgcacgtactgaggaaggacggctattcaccatcacgacggaacacgaccaaagacctcactagtactcgtacgaactaaagtacgaacagtacgaaagacgaccgaagaccgtacggccgttacgtactcgtgtcggacggtaggtcgggtagggacgtacggacgtacgg

SEQ ID NO: 421528 - DNA, 578 bp, Homo sapiens
  misc_feature: GZ8MTXP02F9KDT.51.37.D04.1.454.CMB.2.raw
  modified_base (371)..(371): a, c, t, g, unknown or other
  modified_base (433)..(433): a, c, t, g, unknown or other
  modified_base (544)..(544): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctgggtggaatcggtggggggagtcgttggtacaaggccgtgggacgggtccctgacgtacctctccgtgtgcagtcctgtgtacttccaccttcagtcggcttacttcatgagctggactccgccgaggtcctccggaaggggacggggctggcgaggtcggtcacactatatagngactaagtggggaacaaaccatacttccacgcagaccttcgagaagggaacggcctattccnccaatccgaccgacggacaaaccgccaaagacctagactagtactcgtagaactaaagcaaacgagtacgtaagacgacgaaacgacgaaccgggcttacgtacttcgtgngtcgtaggtggtacggaggaacggtacgtacggg

SEQ ID NO: 421529 - DNA, 518 bp, Homo sapiens
  misc_feature: GZ8MTXP02FRUHX.51.37.D04.1.454.CMB.2.raw
  modified_base (347)..(347): a, c, t, g, unknown or other
  modified_base (358)..(358): a, c, t, g, unknown or other
  modified_base (370)..(370): a, c, t, g, unknown or other
  modified_base (402)..(402): a, c, t, g, unknown or other
  modified_base (425)..(425): a, c, t, g, unknown or other
  modified_base (430)..(430): a, c, t, g, unknown or other
  modified_base (496)..(496): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagcgtgggtggaatcggtggggggagtcgttgggtacaaggcccgtgggacgggttccctgacgtacctctcctgtgcagcctctggattcaccttcaggtgctacttcatgagctggactccgcaggctccgaggggaggctgcgaggtggtcncacatatagtnactagtgggganaccatattcacgcagctgagagaggctattcncatcgcgaggacaacgccgaaanacctnacttgtaactctgacaatacgaactagtacaaaggacgacgaaagcacggtctagtacctgtgcgngtagtggaggagaggacgtagg

SEQ ID NO: 421530 - DNA, 517 bp, Homo sapiens
  misc_feature: GZ8MTXP02JBDPM.51.37.D04.1.454.CMB.2.raw
  modified_base (282)..(282): a, c, t, g, unknown or other
  modified_base (432)..(432): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggtttcctgttgctattatagaaggtgtccagtgtcaggtgcagctggtggaatcgtgggggagcttggtcaagcctggagggtccctgagactctcctgtgcagcctctggatcactcagtgctactcatganctggatccgcaggctccgaggggaggctgcgagtgggtctcgacatatagtgacttaagtgggagaaccatattctacgcagactctagaagagggaccgattctccaatctaccgagggaaccaacgacctaaagaactacactagtanctgacaaatgaaactagtacaagacgacccgaaagaccacgggcctagtacttcagtgcgagtggaggtaggacggagtaacggg

SEQ ID NO: 421531 - DNA, 643 bp, Homo sapiens
  misc_feature: GZ8MTXP02FRA6G.51.37.D04.1.454.CMB.2.raw
  modified_base (244)..(244): a, c, t, g, unknown or other
  modified_base (263)..(263): a, c, t, g, unknown or other
  modified_base (288)..(288): a, c, t, g, unknown or other
  modified_base (293)..(293): a, c, t, g, unknown or other
  modified_base (320)..(320): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcctcactctctgcacaggctctgaggcctcctatgagatgacacagccagcctcggtgtcagtcgtccccaggacagacggccaagactcccctgctcgtggagatgcattgaccaaaacgtnttgtctttagacacagacncagcacgacctataatatatataanaaganagtagagacgcctagacggactcccgngacgcgtacttcgtcgtcgccctaccgacgtactacgaacggaaccaacgacgaccgtacgttacgaacgtagttaggtacggacgtacgaggacgaaggaaacggaacggacgtactacgtaaacttacgttaacgtacgtaactaaatacaagacgaacgaacgtaacgtaggttacgttaacgttaggtaggtaacggttacggtacggggacgggaacgggtaacgtaagggtaccgtaccggtacgtacggtaccgaccgaccggacggtccgtcccggaccccgttcggtacctaccgttccgttacccgttacccc

SEQ ID NO: 421532 - DNA, 692 bp, Homo sapiens
  misc_feature: GZ8MTXP02IXIDN.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagccgtgggacgggtccctggagactctcctgtgcagcctctggacttccaccttcagtgctacttcatgagcgtggactcccgaccgaggcctccggaagggggaaggggctggcgtaggtcggggtcctaccaactattagttaggtcgacttaaaggtcgggggaaacaaacccaacgtatttaccgtaacgacaagtaccttcgaggaaacgggaacggggacccttaacgtttcctacccaacgttcccgtaacccggaaacggggtaaacccaaaacccggaccctaaaaaggtaaaccccttactaaacccgttaggtaaaccttaccgttaggaaacctaaaaagtcggaaaaccgtagttaaaccgaaaaggaccgaccggaaaacgaccggaccgggtaccgttcgttaacttcgtaggtgcggtaaggttgggaggggaagacgggtacgtaacgggg

SEQ ID NO: 421533 - DNA, 728 bp, Homo sapiens
  misc_feature: GZ8MTXP02IZ89S.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggacggtccctgagactctcctgtgcagcctctggacttcaccttcagtgctacttcatgagctggactccgccaggcctaccggaggggacggggctggcgtaggtcgggtctaccgaactattagttacgtgtaacgttaagtgggggaacaaacccagttactttccaacggactaacggtaccttcgtaggtacgggaaacggggtcccgttaatttcccgtacccattacccgtacccggaaacggggaacccaaacccgggaaccctaaaacggtaaccctttacgtaaacctttaggttaaacttccgttaaggaacctaaaagttacggaaaaccttagttaaccgaaaaggaccggaaacccggaaacggtaaacccggaaccggggtaccccgtttaggttaaacccgttttccggtaggttaaccgggaggttaacggggttggggtaaccggggtagggaaaccggtttaacgggtaaacccggggg

SEQ ID NO: 421534 - DNA, 548 bp, Homo sapiens
  misc_feature: GZ8MTXP02JNF0C.51.37.D04.1.454.CMB.2.raw
  modified_base (343)..(343): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaaggtgtccagtgtcaggtgcagctggtggaatcgtgggggagcttggtcaagcctgggagggtccctgagactctcctgtgcagcctctggattcaccttcagtggctacttcatgagctggatcccgcaggcctccgaggggagggctgcaggtggtctcgacatattagngactaagtgggggaacaaccatattccgtacgctagactctaggaggacgggcctattcgaccatcctaccgagggaccaacgccaaagactcactgtactccgtgactaaagtcgaaactagtacgaaagacggaccgaagaccgaccgggtaccgttgtacttcgaggcgacggtaggttcggaggggatacgggacttaggg

SEQ ID NO: 421535 - DNA, 658 bp, Homo sapiens
  misc_feature: GZ8MTXP02F1USI.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggacgggtccccgagactctcctgtgcagcctctggattcaccttcagtggctacttcatgagctggactccgccaggcctccggaggggaaggggctggcgaggtgggtctcacctattattagtgtactaagtgggacgaaccactacttaccacgcacgtctcgtgtaggaacgggcctaagttcctacccgacttaccgtacccgaacggggaaaccaaaccggaacccgaaaacgtaaaccctccgtaaccttaggttaacttacgttacgaaactaaaacgtagaaaaccgtacgttaacctaaaacgggaaccggaaccgaaaacggaaccgtacccgggtaccgttacgttacccgtttcgtaggttcggaacggttaaggtcgggtacgggggaagacggggtaaccgttacgggtaacgg

SEQ ID NO: 421536 - DNA, 605 bp, Homo sapiens
  misc_feature: GZ8MTXP02I6QP9.51.37.D04.1.454.CMB.2.raw
  modified_base (345)..(345): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggacggtccctgagactctcctgtgcagcctctggattccaccttcagtcggctacttcatgagctggactcccgccaggcctaccggaaggggaggggctggcgtaggtggggtcnccgactattacgttagtgacttaagtgggggaaacaaaccctacgtatttcccgtaacgcaaacgtacttcgtggtacgaaacggggtccgaactttccacccatcccgtaccgagggaccaaacgccaaagacctcacttgtactctgaacaaagtcgaaactagtactaaaggacgtaccgaaagacccggaacggtccgtagttaccttcgtggtaacgcggtaggtcgggtagggaacggacggtaaccggtaggg

SEQ ID NO: 421537 - DNA, 624 bp, Homo sapiens
  misc_feature: GZ8MTXP02JSPGN.51.37.D04.1.454.CMB.2.raw
  modified_base (332)..(332): a, c, t, g, unknown or other
  modified_base (344)..(344): a, c, t, g, unknown or other
  modified_base (564)..(564): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagcctctggattcaccttcagtggctacttcatgagctggactccgcaggcctccgaggggagggctgcaggtggtcncacatattagtnactaagtggggaacaaccactatttccgacgctaaggaccttcgtaggaacgtaacgggggcctaatttcccgacctaagtcccgtaccggaacggggaaccaaaccggccaaaacgacctactagttcgtaactcgtaagaccaaaagttcgaaacgtagtaacaaaaggacgaacccggaaagaccgtaccggggtaccgttacgttaaccgtttcgnggttggaccggtaaggttcggggtaggggaacggtaacggggtaacggtttaaccggggg

SEQ ID NO: 421538 - DNA, 539 bp, Homo sapiens
  misc_feature: GZ8MTXP02F4PUS.51.37.D04.1.454.CMB.2.raw
  modified_base (261)..(261): a, c, t, g, unknown or other
  modified_base (408)..(408): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttgggcaagcctgggagggtccctgagactctcctgtgcagcctntggattcaccttcagtggctacttcatgagctggactccgcaggctccgaggggaggggctggcaggtgggtctccactatagttagtgacttaaagtgggggaacaaaccacatttctacgcagactctgtgaacgggcccattcnccatcctccgacggacaaaccgaccaaagactacactagtactctagacaaatagaaacagtactaaggacgaccgaagacgacgccgtacgtacttcagtgcgtagtgggtggtaggacggacgtacggg

SEQ ID NO: 421539 - DNA, 587 bp, Homo sapiens
  misc_feature: GZ8MTXP02J3A1P.51.37.D04.1.454.CMB.2.raw
  modified_base (191)..(191): a, c, t, g, unknown or other
  modified_base (261)..(261): a, c, t, g, unknown or other
  modified_base (371)..(371): a, c, t, g, unknown or other
  modified_base (378)..(378): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtncagctggtggaatcgtgggggagcttggtcaagcctggagggtcccctgagactctcctgtgcagccctntggattcaccttcagtggctacttcatgagctggatcccgcaggcctccgaggggacggggctggctaggtgggtcctccgactatacttagtgacttaagtgggggaanaaacccnctatttcacgcaagactcgtggaagaacggggccctaatttccgaccatcctacccgaggggaccaaaccggtccaaaagactcactgtatcgtagacaaagtcggaaacaggtaacctaaaaggacgacccggaaagaccgaccggggtccttacgtaccttcgaggtcgacggtagtcgggtagggaggtacggaccgttaacgggg

SEQ ID NO: 421540 - DNA, 573 bp, Homo sapiens
  misc_feature: GZ8MTXP02GGZDT.51.37.D04.1.454.CMB.2.raw
  modified_base (261)..(261): a, c, t, g, unknown or other
  modified_base (469)..(469): a, c, t, g, unknown or other
tcagcgatcgtatacacgaccggtgctcgatttagtagcatactgttgagctctgggagaagagcccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagccgtgggacgggtccctgagactctcctgtgcagcctntggattcaccttcagtgctacttcatgagctggactccgcaggctccgaggggaggctgcgtaggtggtctccactatagttaggtgacttaagtgggggaacaaacccatattacctacgactagacttcgtggtaggaacggggccctaattccgccctatcccgtaccgaagggaaccaaccggccaaagacctacactagtacncgtagacaaagtcgaactagtacgaaagacgaccgaaagacgaccggtcgttacgtacttcgtaggcgacggtaggtcgggtagggacgacggtacgtacgggg

SEQ ID NO: 421541 - DNA, 558 bp, Homo sapiens
  misc_feature: GZ8MTXP02HPYRE.51.37.D04.1.454.CMB.2.raw
  modified_base (252)..(252): a, c, t, g, unknown or other
  modified_base (273)..(273): a, c, t, g, unknown or other
  modified_base (415)..(415): a, c, t, g, unknown or other
  modified_base (453)..(453): a, c, t, g, unknown or other
  modified_base (465)..(465): a, c, t, g, unknown or other
  modified_base (470)..(470): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgngcagcctctggattcaccttnagtgctactcatgagctggatccgccaggctccgaggggaagggctggcaggtcgggtctccgaacatattagtgacctaaagtgggggaacaaacccatattccacggacagacctcgtagaggaaaggggcccatttccnccaatccacccgaggggaacaaccgaccaaagtaaccncatagtactcanacaanacgaacacgtaacgtaagaacgacgaacgaacgaccggaccgtacgtacttctgtgcgaggtaggtagggacggacggaacggtacgg

SEQ ID NO: 421542 - DNA, 740 bp, Homo sapiens
  misc_feature: GZ8MTXP02F7KND.51.37.D04.1.454.CMB.2.raw
  modified_base (266)..(266): a, c, t, g, unknown or other
  modified_base (274)..(274): a, c, t, g, unknown or other
  modified_base (279)..(279): a, c, t, g, unknown or other
  modified_base (377)..(377): a, c, t, g, unknown or other
  modified_base (384)..(384): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagccgtgggacgggttccctggacgactctcctgtgcacgcctntggattcnccttnagtgcttactcatgatcgtggactccgcaggcctccgaggggacggggctgcgaggtcggtctcccgactattagttagtgacttaagtcgggggaanaaacccncgtacttccgtaacgctaacgactcgtaggaacggaaacgggtccgtaatttcccgtaccctaagttcccgtaccgaaacggggacccaaaacccggtacccgaaaaggtaacccttaccgaaccgtttaggttaactaccctacggtaaacctaaaaggtacgtaaaacgtacggtttaaaccgtaaaacgggacggaaaccccgggtaaaacgaacccggtaaaaccccgggggtcccgtttaacggtttaacccgtttccggttaggggtaacgggtaaccgggttaacggggttacgggggttaaccgggggaaacggttaaccgggggtaaacccgggtttaaaccggggg

SEQ ID NO: 421543 - DNA, 722 bp, Homo sapiens
  misc_feature: GZ8MTXP02H8HMT.51.37.D04.1.454.CMB.2.raw
  modified_base (227)..(227): a, c, t, g, unknown or other
  modified_base (247)..(247): a, c, t, g, unknown or other
tcagcgatcgtatacacgaccggtgctcgatttagtagcatactgttgggtttgggggtgggtccaggaggcagaactctgggtgtctcaccatggcctggatccctctacttcctccccctcctcactctctgcacaggctctgaggcctcctatgagctgacacagccagcctcggtgtcagtcgtccccaggacagacggaccaagactcccctgctcgtgganatgacattcgacaaaacgtntttgtcttttaggtaccaacagaagccaggccacggcccctaataataatataataataaagacagtgaagacggcctcgaagggactccctaggacgcgattcctctcggccctaccgagtcacgaggggaaccaacgtcgacccgtaacgttacgaaccgtaaatttaggtacggacgttaacccgaaggggaaccaaagggaaaacggtaacgggaacgggggtaccttaggtaaaacccgtttaattttaaacgaccgggttaaactaaactaacgaacgaacgaaacgaaacgtaacggtaacggttaacggttaacgttaaggtaggtaacggttaacggtacgggacgggtaacgggaacggtaacggtacggtaccggtaccggtaacggtaccgtaccgaaccgaccggtaaccgtcccggtaccccgtacccgtaccgtaccgttacccgttacccgtacccccg

SEQ ID NO: 421544 - DNA, 536 bp, Homo sapiens
  misc_feature: GZ8MTXP02HDW5G.51.37.D04.1.454.CMB.2.raw
  modified_base (332)..(332): a, c, t, g, unknown or other
  modified_base (338)..(338): a, c, t, g, unknown or other
  modified_base (361)..(361): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggagggtccctgagactctcctgtgcagcctctggattccaccttcagtggctacttcatgagctggatccgcaggctccgaggggagggctgcagtgggtcncccganatattagtgactaagtggggaanaaccagtattcacgcagtactcgtgtagaacggggctattccgccatcccgtacgacggacaacgccaagactcactgtatcgtgacaagtgaactagtataacgacgaccgaagaccgacggccgtgtacgttctgtaagtcgggagtcgggtagggacgtaggacgtacgggg

SEQ ID NO: 421545 - DNA, 599 bp, Homo sapiens
  misc_feature: GZ8MTXP02HNL0M.51.37.D04.1.454.CMB.2.raw
  modified_base (261)..(261): a, c, t, g, unknown or other
  modified_base (346)..(346): a, c, t, g, unknown or other
  modified_base (367)..(367): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgacgactctcctgtgcagcctntggattcaccttcagtgctactcatgagctggactccgcaggctcgaggggacgggctgcaggtgggtctccgactatagttagngactaagtcggggacaaccanattcacgcaacgctcgtagagaacggggcctaatttccacctaatccgtaccgaagggaccaaaccgccaaagaccttacactgtaactccgtagaccaaatcgaaactaggtacaaacggacgaccggaaagaacccgacgggtacccgttaggttaaccttcgtaggtaacggtacggtaacggttcggggtacgggggaacgtaacgggggtaacgtttaaaccggggg

SEQ ID NO: 421546 - DNA, 638 bp, Homo sapiens
  misc_feature: GZ8MTXP02IR5LY.51.37.D04.1.454.CMB.2.raw
  modified_base (262)..(262): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggacgggtccctgagactctcctgtgcagcctcnggattcaccttcagtgctactcatgagctggatcccgccgaggcctccgaggggaggggctggcaggtgggtctccactattagttagtgtactaagtgggggaacaaaccctagtactttacgaacgcaagtacttcgaggtacggaaacggggccctattccctccgaatcccgtaccggaagggaacccaaaccggaccaaacggaacccttcaaaccgttgtaactccgttagaacctaaaagtcgaaactacgtaacaaagggaccgacccggaaaggacccgtaccgggtaccgttacgttaacctttccggtaggtcggtaccggaggtttacggggacgggaaggtaacgggtaaccgtttacggggg

SEQ ID NO: 421547 - DNA, 550 bp, Homo sapiens
  misc_feature: GZ8MTXP02FHOM7.51.37.D04.1.454.CMB.2.raw
  modified_base (382)..(382): a, c, t, g, unknown or other
  modified_base (398)..(398): a, c, t, g, unknown or other
  modified_base (403)..(403): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaaggtgtccagtgtcaggtgcagctggtggaatcgtgggggagcttggtcaagcctgggagggtccctgagactctcctgtgcagcctctggattccaccttcagtggctacttcatgagctggactccgcaggcctcgaggggagggctgcgaggtcggtctcgactatattagtgactaagtggggaacaaccatattcaacgcagactntagagaaggccattcncatcncgaggacacgcaaagacctcgactgatcctagaacaaatcggaaactaggttacaaaacggacggaccgtaaagaccgaccgggtaccgtagttaccttcgtggcggacgtaaggtcgggtagggaagtacggggacttaaccgggg

SEQ ID NO: 421548 - DNA, 656 bp, Homo sapiens
  misc_feature: GZ8MTXP02IVCH0.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagcgtgggtggaatcggtgggggagtcgttggtcaaggccgtgggacgggtccctgacgctctcctgtgcacgccttcgtggacttccaccttcaggtcgcttacttcatgagctggactcccgccgaggcctaccggaaggggacggggctggacgtagggtcgggtacctaccgaactagttagttaggtgtaacttaaggtcgggggaaacctaaaccctacgtactttaccgaacgacaacggtactcgtaggaacggtaacgggccttacttcctaccacttccgaccgaagggaaccaaaccggaccctaaaacgtacctcgaacgttacgtaactcgtacgaaactaaagtcgaaactacgtaacgaaacgacggaaccgaaagaccgacgggtaccttacgtacttcgtaggtcgtacggtaggttacgggacgggaacgtacggtacgtacggg

SEQ ID NO: 421549 - DNA, 653 bp, Homo sapiens
  misc_feature: GZ8MTXP02HQDGS.51.37.D04.1.454.CMB.2.raw
  modified_base (190)..(190): a, c, t, g, unknown or other
  modified_base (275)..(275): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaaggtgtccagtgtcaggtncagctggtggaatcgtgggggagtcttggtcaagcctgggacgggtccctggagactctcctgtgcagcctctggattcaccttnagtgctacttcatgagctggatccgcaggctccgaggggagggctggctaggtcggtcctcaacgtattagttaggtgaccttaagggtggggaaacaaacctacgtactttccgaacgcaaggtacccttcgtaggtacggaaacggggtccctatttcctccctaagtcccgttaccgaacgggaaccaaaccgacccgaaaagtaaccttcaacttcggtaactctagaaccaaagttacgaaagtacgttaacgaaacgggacgaacccggaaagtccccggtaaacggggttcccttaaggttacccctttcgtaggttaacggacggtaaggttcggggtaggggaacggtacgggtaacggtttaccgggg

SEQ ID NO: 421550 - DNA, 750 bp, Homo sapiens
  misc_feature: GZ8MTXP02JOU0X.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtggggggagcttgggtcaagcctgggacgggtccctgagactctcctgtgcagcctctggattcaccttcagtgctactcatgagctggactccgcaggcctaccggaggggacggggctaggcgaggtcgggtctaccgactattacgttaggtcgacttaagtgggggaaacaaaccctactactttaccgtaacggcctaaggtacccttacgtagggaaacgggtaaacgggggcccttaaagtttccctaccctaacgttaccccgtaacccgggaacgggggtaaaccctaaacccgggacccaaaacgggtaaaccctttacccaaaccgtttcggttaaattacccgttaggaaaccctaaaagttcggaaaacctaacgggtttaacccgtaaaagggaaccggaacccccggaaaaggtaaccccggaacccgggggttacccgtttacggttaaacctttccggttagggttcggaccgggttaacggttcggggtacgggggaacggtaacgggtaaccggtttaaccgggg

SEQ ID NO: 421551 - DNA, 632 bp, Homo sapiens
  misc_feature: GZ8MTXP02GI3O9.51.37.D04.1.454.CMB.2.raw
  modified_base (292)..(292): a, c, t, g, unknown or other
  modified_base (334)..(334): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttgggtcaaggcctgggacgggtccctgagactctcctgtgcagcctctggattcaccttcagtgctacttcatganctggatcccgcaggctccgaggggagggctggcaggtggtcncactatatagtgactaagtggggaacaaccatatttccaacgcaacgtacctcgtaggtaggaaacggggtccctaagtttcccacctacgttcccgtacccggaaacggggaacccaaaccggacccaaaaggtaacccttcgaacttcggttaaactcccgttaggaacctaaaagtacggaaacctaagtacgtaaaacggacggacccggaaagacccggaaccgggtccgttagtaacccttgtggtcggcggtaaggttgggtaacggggagtaacgggacgttaaacgggg

SEQ ID NO: 421552 - DNA, 567 bp, Homo sapiens
  misc_feature: GZ8MTXP02JRD6A.51.37.D04.1.454.CMB.2.raw
  modified_base (291)..(291): a, c, t, g, unknown or other
  modified_base (532)..(532): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctggacgggtccctgagactctcctgtgcagcctctggacttcaccttcagtgctacttcatganctggactccgcaggcctccggaggggagggctgcgaggtggtctcccgactatagttagtgacttaagtggggaacaaccactattctacgacagactcgtggtaggaacggtcccttaagttctaccacgtcctacccgagggtaccaaacgcccaaagtacctcacgttgtatccgtagactaaatcgaaacctagtacaaggacgaccgaaagaccgacggccgttacgtaccttcgngtggtcgtaggtggtacgggagacggtacgtacgg

SEQ ID NO: 421553 - DNA, 636 bp, Homo sapiens
  misc_feature: GZ8MTXP02IS7LB.51.37.D04.1.454.CMB.2.raw
  modified_base (596)..(596): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggacgggtccctgacgactctcctgtgcagcctcgtggacttcaccttcagtcggctacttcatgagcgtggactccgccaggcctccgaaggggacgggctgcgaggtcggtcacccgacaagttattaaggtgaccgttaaaggtgggggaaactaaaccccacttaactttccgaaccggacaaggtaacccttcgtaggaaacgggaacggggtccctaatttcccacctattcccgtaaccggagggaaccaaaccgaccgaaagaaaccttcaacgttagtacctctacggaaactaaagtcgaaaccgtagtaccgaaaagaccgacgtaaagacccgaacgggtcccgttagtaccttcgnggtcgcggaggttgggagggaaggtaccggaattacgggg

SEQ ID NO: 421554 - DNA, 600 bp, Homo sapiens
  misc_feature: GZ8MTXP02F1RWE.51.37.D04.1.454.CMB.2.raw
  modified_base (566)..(566): a, c, t, g, unknown or other
  modified_base (584)..(584): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggaggtccctgagctctcctgtgcagcctctggattcaccttcagtgctcttcatgagctggactcccgccgaggcctccggaaggggtacgggctggcgaggttcgggtcctccgaactattagttaggtgaccgtttaaagcgggggaacaaaccctagtactttcaacgcacgtactcgtaggaaggaacgggcctatttccaccgtattcccgaccggaacggaccaaaccgaccgaaagaaccttcgacttagtactccgagaacaaagtacgaaacgtacgtagaaaacgacggaccgaaagaccgtaccggtcgttacgttacctcgtagngcggtaggttggaggganacgggtacgttacggg

SEQ ID NO: 421555 - DNA, 533 bp, Homo sapiens
  misc_feature: GZ8MTXP02GWR0U.51.37.D04.1.454.CMB.2.raw
  modified_base (344)..(344): a, c, t, g, unknown or other
  modified_base (357)..(357): a, c, t, g, unknown or other
  modified_base (363)..(363): a, c, t, g, unknown or other
  modified_base (464)..(464): a, c, t, g, unknown or other
  modified_base (501)..(501): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccccgagactctcctgtgcagcctctggattcaccttcagtggctacttcatgagctggactccgcaggctccgaggggagggctgcaggtgggtctcactatattagngctaagtgggganaaccanatttcacgcagactcgtgtaggaacggccgattcctccagttcctacccgaaggggaccaaacggaccaaaggaactcactgtatctagacaaatgaaacnggtacaaagcgacgaagacacggccgtagtacttcgngtgcgtagtggtgggagacggacgtaggtacg

SEQ ID NO: 421556 - DNA, 536 bp, Homo sapiens
  misc_feature: GZ8MTXP02GPCNK.51.37.D04.1.454.CMB.2.raw
  modified_base (259)..(259): a, c, t, g, unknown or other
  modified_base (271)..(271): a, c, t, g, unknown or other
  modified_base (286)..(286): a, c, t, g, unknown or other
  modified_base (315)..(315): a, c, t, g, unknown or other
  modified_base (325)..(325): a, c, t, g, unknown or other
  modified_base (329)..(329): a, c, t, g, unknown or other
  modified_base (337)..(337): a, c, t, g, unknown or other
  modified_base (351)..(351): a, c, t, g, unknown or other
  modified_base (357)..(357): a, c, t, g, unknown or other
  modified_base (443)..(443): a, c, t, g, unknown or other
  modified_base (455)..(455): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaaggtgtccagtgtcaggtgcagctggtggaatcgtgggggagcttggtcaagcctgggagggtccctgagactctcctgtgcagcctntgattcaccttnagtgctactcatganctggactccgcaggctcgaggggagggcngcagtggtcnccanatattagngactaagtgggaanaacccnattcacgcagactctggtagaaacgggccctatttccacctagtcctaccgagggaccaaacgtacccaaagaacctcaactgtanctagacaaagtnaaacagtacaagacgacgaaagactaccggaccgtgtacccttgtgtgacgtaggtcgaggggagacgggtactaacgggg

SEQ ID NO: 421557 - DNA, 553 bp, Homo sapiens
  misc_feature: GZ8MTXP02HJ8CN.51.37.D04.1.454.CMB.2.raw
  modified_base (259)..(259): a, c, t, g, unknown or other
  modified_base (326)..(326): a, c, t, g, unknown or other
  modified_base (366)..(366): a, c, t, g, unknown or other
  modified_base (372)..(372): a, c, t, g, unknown or other
  modified_base (390)..(390): a, c, t, g, unknown or other
  modified_base (470)..(470): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttgggtcaagcctggaggtccctgagactctcctgtgcagcctntggattcaccttcagtgctacttcatgagctggatccgccaggctcgaggggaggctgcagtggtcncactatattagtgactaagtggggaacaacacattcacgnagactntagagaagggcctattcncatcgtacgaggacaaacgccaaagactcactgtatcgtagacaaagtcgaaactagtacaaacggtacgaccggaaaancccgaaacgggttccgttacgtaccctttcgtaggtaacggtcgtaagggtcggtaggggaacggtacggtaacggttacggg

SEQ ID NO: 421558 - DNA, 562 bp, Homo sapiens
  misc_feature: GZ8MTXP02IYN93.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggaggcttggtcaagccgtgggacgggtccctgagactctcctgtgcagcctcgtggattcaccttcagtgctactcatgagcgtggactccgccaggcctaccggaggggacggctgctaggtgggtctccactatattagtgacttaagtgggggaacaaaccactattaccacgcagtctcgtggtagacgggccgtattctaccactcctaccgacgggaccaaaccgaccaaagacctcactgtactcgtagaacaaagtacgaactagtactaagacgaccgaagaccgacggtccgtacgtacttcgtgtgcgtaggtgggtagggagaacgggtaccgtaggg

SEQ ID NO: 421559 - DNA, 601 bp, Homo sapiens
  misc_feature: GZ8MTXP02I6DG7.51.37.D04.1.454.CMB.2.raw
  modified_base (564)..(564): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtggggggagcttggtcaagccgtgggacggtccctgagactctcctgtgcagccctcgtggattccaccttcagtggctacttcatgagctggactccgcaggctccgaaggggagggctggctaggtcggtctaccgactagttattagtcgacttaagtgggggaacaaacccactatttccaacggcagtacctcgtaggtaggaaacggggtccctaattcctccgaactccgtaccgaacggggaaccaaaccggaccaaaggtaaacctctaccgttagtactcgtacgaacaaaagtgaaactagtacgaaaagacggaaccgaaagaccgacggtccgtgtaccttcgngtcgcggtagttgggagggacgaagggacgtaacggg

SEQ ID NO: 421560 - DNA, 615 bp, Homo sapiens
  misc_feature: GZ8MTXP02JBDBX.51.37.D04.1.454.CMB.2.raw
  modified_base (265)..(265): a, c, t, g, unknown or other
  modified_base (269)..(269): a, c, t, g, unknown or other
  modified_base (273)..(273): a, c, t, g, unknown or other
  modified_base (278)..(278): a, c, t, g, unknown or other
  modified_base (294)..(294): a, c, t, g, unknown or other
  modified_base (350)..(350): a, c, t, g, unknown or other
  modified_base (509)..(509): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagtcttggtcaagccgtgggacgggtccctgacgactctcctgtgcagcctntggnttcnccttnagtgctacttcatgancgtggactcccgccgaggcctaccggaaggggacggggtctggctaggtcgggtcnccgactattagttagtgactaaagtggggaacaaccactatacgtacgcaagacctgtaggaaggaacgggccctattcccaccattaccgaccgaacgggaacccaaaccggacccaaaagtaccctacgtacttagtaactccgtagaacttaaaanacgaaactaacgtaacgaaacgacgaccgaaacgaccgtaccggtacgttacttacgtcgtaggtcgacggtaggtggggtagggacggtacggaccggtaacggg

SEQ ID NO: 421561 - DNA, 631 bp, Homo sapiens
  misc_feature: GZ8MTXP02JV764.51.37.D04.1.454.CMB.2.raw
  modified_base (260)..(260): a, c, t, g, unknown or other
  modified_base (289)..(289): a, c, t, g, unknown or other
  modified_base (353)..(353): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagccgtggagggtccctgagactctcctgtgcagcctntggattcaccttcagtgctacttcatganctggactccgcaggcctaccgaggggaggggctgcgtaggtcgggtctcgactattagttaggnactaagtggggaacaaaccacgtattcacgcagtactcgtaggtagggaacgggtcctaactttccacccgtaattcccgaccggaaggggaacccaaaccggcccaaaaggacctcaacttggtaactccgtagaactaaaagtcggaaaacctagttaaccgaaaaggacggaacccggaaaagccgtaaacccggggtccgttacggtaccctttcggtggtaacggcggtaagggtttcgggacgggggaaggaacgggtaacgttaaccgggg

SEQ ID NO: 421562 - DNA, 619 bp, Homo sapiens
  misc_feature: GZ8MTXP02IJ4T2.51.37.D04.1.454.CMB.2.raw
  modified_base (244)..(244): a, c, t, g, unknown or other
  modified_base (265)..(265): a, c, t, g, unknown or other
  modified_base (380)..(380): a, c, t, g, unknown or other
tcagcgatcgtatacacgaccggtgctcgatttagtagcatactgttgggtttgggggtgggtccaggaggcagaaatctgggtgtctcaccatggcctggatccctctacttctcccccctcctcactctctgcacaggctctgaggcctcctatgagctgacacagccagcctcggtgtcagtgtccccaggacagacggccaagactcccctgctctggagatgcattcgaccaaaacgtntttgtctttttggtaaccaanagaagccaggccacggccctataataatatataataaagacagtgagacggccctgagggatcccgtgacgcgtattcctcgtggccctccgagtctacgaacggggaacaaccncgaccctaacggttacgaaaccgtagtttagggtcggaacgtacccgaggaccaaggaaacggacgaagggctaggaacttattacgtgtacaaatcgaagcaagacgacagttgtaacttagtagggaagttagttacgggacgggaacggtaacgaagggtccgaccgttacgtaacggtcgaaccgccgaaacggcctccgacccccgtggtacccacgtttccgtacttaccccc

SEQ ID NO: 421563 - DNA, 651 bp, Homo sapiens
  misc_feature: GZ8MTXP02FKH83.51.37.D04.1.454.CMB.2.raw
  modified_base (266)..(266): a, c, t, g, unknown or other
  modified_base (297)..(297): a, c, t, g, unknown or other
  modified_base (622)..(622): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttcctgttgctattatagaaggtgtccagtgtcaggtgcagctggtggaatcgtgggggagtcgttggtcaaggccgtgggacgggtccctgacgactctcctgtgcagcctntgactccaccttcgagtggtctactcatgancgtggactccgccaggcctaccggaaggggacggggctcggacgtaggttcggggtcctaccgaactagttaagtttacggcgtaacgttaaagggtcggggaaacgaaacccctacttaacgtttaccgaaccgactaaggtaaccctttcggaacggaaacgggtaaacggggtccctaaagttttccccacctacgtaccgtacccgaaacggggaacccaaaccggaccctaaaagtaccctactaacgttacgtatccgtagaactaagtacaagtacgtacaagacgacgaaagcgtaccggtctcgtactcgtagcgnggtagtcggaggtacgacggtacgtacgg

SEQ ID NO: 421564 - DNA, 641 bp, Homo sapiens
  misc_feature: GZ8MTXP02GAMQD.51.37.D04.1.454.CMB.2.raw
  modified_base (286)..(286): a, c, t, g, unknown or other
  modified_base (291)..(291): a, c, t, g, unknown or other
  modified_base (356)..(356): a, c, t, g, unknown or other
  modified_base (366)..(366): a, c, t, g, unknown or other
  modified_base (395)..(395): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagcgtggtggaatcggtgggggagtcttggtcaagccgtggacgggtcctgagctctcctgtgcagcctgtggattcacctcgagtgctactnatgancgtggactccgcgaggcctcggaggggagggctgcgaggtcggtctaccgactattagttaggtnaacttaaggnggggaacaaaccgatacttaccacggtanacgtactgtaggaaagggaacgggtcccttattcccgtacctacgtacccgtaccgggaaaacggggaacccaaaccgggacccaaaacggtaacccttacgtaccttaggttactaccgtaaagaaactaaagtacgaaacgtagtaacgaaacggacggaaccgaaacggacccgtacgggtccgttagtaccgttgacggtcggacggtagggtacgggagggacggtaacggtacggtacgg

SEQ ID NO: 421565 - DNA, 581 bp, Homo sapiens
  misc_feature: GZ8MTXP02IXO6R.51.37.D04.1.454.CMB.2.raw
  modified_base (288)..(288): a, c, t, g, unknown or other
  modified_base (338)..(338): a, c, t, g, unknown or other
  modified_base (346)..(346): a, c, t, g, unknown or other
  modified_base (355)..(355): a, c, t, g, unknown or other
  modified_base (380)..(380): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccctgagctctcctgtgcagcctctggattccaccttcagtggctactcatgancgtggactccgccaggctcgaggggagggctggcaggtgggtctcccganatatagtnacgttaagnggggaacaaaccactattctaacgntaacgactcgtagtacggaaacggcccgtaattcctcccgtaattcccgacggaaacgggaaccaaaccggaccaaaacgacccttacaccgttaggtaactctaggaactaaagtagaaaccgtagtacaaagacgacgaaagaccgacggtaccgtgtacctgtcgtaagcggtagttggagggacgacgtacgtacgg

SEQ ID NO: 421566 - DNA, 619 bp, Homo sapiens
  misc_feature: GZ8MTXP02FOISG.51.37.D04.1.454.CMB.2.raw
  modified_base (266)..(266): a, c, t, g, unknown or other
  modified_base (537)..(537): a, c, t, g, unknown or other
  modified_base (580)..(580): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagcgtggtaggaatcgtggggggagcttggtcaagccgtgggacgggtccccgagactctcctgtgcagcctntgattcacttcagtgctacttcatgagctggactccgccgaggcctcggaggggacgggctggcgtaggtcgggtctcactattagttagtgtactaaggttcgggacaacctactacttaccgtacgctacgtacttcgtagggtacggaacggggtcctactttcctacccagttcccgaccggaaagggaaacccaaccggtaaccaaaacggtaaccttccgaattacggtactactagaaccttaaagacggaaactacggttaanaaacggaccgacgaaaacgcgaccggttccgtaatcgtttcgnggtcgaaggtaggtcgggaggagtacggacgtacggacg

SEQ ID NO: 421567 - DNA, 632 bp, Homo sapiens
  misc_feature: GZ8MTXP02J3CV6.51.37.D04.1.454.CMB.2.raw
  modified_base (191)..(191): a, c, t, g, unknown or other
  modified_base (279)..(279): a, c, t, g, unknown or other
  modified_base (359)..(359): a, c, t, g, unknown or other
  modified_base (379)..(379): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtncagctggtggaatcggtgggggagcttggtcaaggccgtgggacggtccctgagactctcctgtcgcagcctcgtggacttcaccttnagtgctacttcatgagctggactccgccaggcctccggaaggggacgggctggcgtaggtcggtctcactattagttagngactaagtgggaacaaaccntacttcacgcacgacttacgaggaacggaacggggtccctaacttcctaccaagttcccgaaccgggaacgggaaacccaaaccgggaacccaaaacggtacccttacaacgttacgttaactccgttaaggaaacctaaaagtacgaaaccgtagtaaccgtaaaaggccggaaccgaaagaccgtaaccggtcccgttagaccttcgtaggtcgacggtaggtggggtacggacggtacggacgttacggg

SEQ ID NO: 421568 - DNA, 696 bp, Homo sapiens
  misc_feature: GZ8MTXP02H4OUE.51.37.D04.1.454.CMB.2.raw
  modified_base (324)..(324): a, c, t, g, unknown or other
  modified_base (355)..(355): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaaggtgtccagtgtcaggtgcagctgggtggaatcgtgggggagcttggtcaagcctgggagggtccctgagactctcctgtgcagcctcgtggacttcaccttcagtgctacttcatgagctggatcccgcgaggctccgaggggaggggtcnggcgtaggtgggtctccgactattagttagngacgttaaagtgggggaaactaaacccgtaactagtttaccgtaacggctaacgtaaccttcgtgggttaggaaacgggggcccgtaatttcccttcccaagttcccgtaacccgagggggaacccaaaaccggacccgtaaaacggtaaaccttcctaaaccgttagggttaacttacccgtaaggaacctaaaagtcggaaaacctaaggttaacctaaaaggaacggaacccggaaaaggaccgaacggggtccccgttagttaaccctttccggtacggtggaccggtaaaggttcggggtagggggaaccggtaggggtaaaaccgttaccggggg

SEQ ID NO: 421569 - DNA, 755 bp, Homo sapiens
  misc_feature: GZ8MTXP02GXQHC.51.37.D04.1.454.CMB.2.raw
  modified_base (258)..(258): a, c, t, g, unknown or other
  modified_base (263)..(263): a, c, t, g, unknown or other
  modified_base (296)..(296): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctgggtggaatcgtgggggaggcttggtcaagcctgggacgggtccccgagactctcctgtgcngcctntggattcacttcagtggctactcatgagctggntcccgcaggctccgaggggagggctgcaggtgggtctcaccatattagtgctaaagtggggacgaaaccactactttccgtacgacacgtaccttcgtggtacggggaaacggggtcccgtactttccctaccctaacgttcccgtacccgaaacgggggaacccaaaacccgggaaccccaaaacggtaaacccttcccgaaaccgtttagggttaacttcctaacggaaactaaaaacgttcggaaaaccgtaaggtttaaccgtaaaaacgggaaccggaaacccggaaaaccgggtaacccgtaaacccgggggtaccccgggtttaacggttttaacccgtttacccggttggtttaacccgggggaacgggttaaaacgggttcggggggttaaacgggggaaaacgggtaccgggggttaaaacccgggtttaacccgggggttaaacgggg

SEQ ID NO: 421570 - DNA, 685 bp, Homo sapiens
  misc_feature: GZ8MTXP02JWS5J.51.37.D04.1.454.CMB.2.raw
  modified_base (264)..(264): a, c, t, g, unknown or other
  modified_base (382)..(382): a, c, t, g, unknown or other
  modified_base (451)..(451): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagtcgttggtcaagccgtgggacggtccctgagactctcgtgtgcagcctntggattcaccttcagtggcttacttcagtgagtctggactcccgccgaggcctaccggaggggacgggctggcgtagggtcggtcctaccgactagttacgttaggtcgtacgtaagnggggaacgaaaccctactattccaaccgctaacgtacgtctagggaaagggacgggtacccgtattccncccgtaattcccgtaccgaagggaaccaaacgaccaaagtaaacctcgacttagtactacgtacgaacctaaatcggaaactaacgttaaccgtaaaacgggcccgggaaaaccggaaaacggtacccgggtaaacccgggtccggttacggttaccttaccgggttgggtaaccgggttacggtaacggggttcgggtacgggggaaggtaaccgggggtacgttaacggggg

SEQ ID NO: 421571 - DNA, 648 bp, Homo sapiens
  misc_feature: GZ8MTXP02GCK9J.51.37.D04.1.454.CMB.2.raw
  modified_base (254)..(254): a, c, t, g, unknown or other
  modified_base (263)..(263): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggacgggtccctgagactctcctgtncagcctcgnggattcaccttcagtgctacttcatgagctggactcccgcaggctccggaggggagggctggcaggtgggtcctccgactattagttagtgacgttaagtcgggggaacaaaccctagtactttacccgaacgacgtacgaccttcgtaggaaacgggaacgggggcccttaactttcccgacccgtaattcccgtaccgaaacgggggaacccaaacccgggacccaaaaggtaacccttaccaaccgttagttaactcccgttaggaaacctaaaagttaccgaaactacgttaacgaaacggacggacccgaaagacccgtacggggccttacgttacttcgtggcggcggtaggttcgggagggacgacgggacgtacggg

SEQ ID NO: 421572 - DNA, 641 bp, Homo sapiens
  misc_feature: GZ8MTXP02G5HI4.51.37.D04.1.454.CMB.2.raw
  modified_base (518)..(518): a, c, t, g, unknown or other
  modified_base (624)..(624): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagtcttgggttttccttgttgctattatagaaggtgtccagtgtcaggtgcagctggtggaatcgtgggggagcttggtcaagccgtgggacgggtccctgacgtactctcctggtgcacgtccctgtggtacttcctaccttcgaggtcggtaccttaccttcagttggacgcgtggactccccggaccgaggccgtaccgggaagggggaacggggtcctggcgtagggtcgggtcctaccaactattagttacggtgtacgtaaggtcggggaactaaacctatacttctaacggcaacgtactgtggtaggaacggggtctacttcctaccattcccgaccgaagggaacccaaaccgaccaaagtacctnacgttgtactcgacaactaaagtcgaaactagtacgaaacgacgacggaaacgaccgtacggtccgttatacccgttgaggtggacgtaggggtggtacggggaanacgggtacgtaacgggg

SEQ ID NO: 421573 - DNA, 500 bp, Homo sapiens
  misc_feature: GZ8MTXP02I3BRU.51.37.D04.1.454.CMB.2.raw
  modified_base (288)..(288): a, c, t, g, unknown or other
  modified_base (326)..(326): a, c, t, g, unknown or other
  modified_base (336)..(336): a, c, t, g, unknown or other
  modified_base (347)..(347): a, c, t, g, unknown or other
  modified_base (360)..(360): a, c, t, g, unknown or other
  modified_base (365)..(365): a, c, t, g, unknown or other
  modified_base (368)..(368): a, c, t, g, unknown or other
  modified_base (380)..(380): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccctgagactctcctgtgcagcctctggattcaccttcagtgctacttcatganctggactccgcaggctcgagggagggctgcagtggtcncacatatagnctaatgggganaaccatatcacgnagctntgngaagggctatcncatctcgaggacaacgcaaagactcactgtaatctagacaaagtcgaacagtactaaagacgacgaaagacgacggcctgtaccttgtgtgacgtagtggtaggagtacggacgtacggg

SEQ ID NO: 421574 - DNA, 558 bp, Homo sapiens
  misc_feature: GZ8MTXP02IGY3Z.51.37.D04.1.454.CMB.2.raw
  modified_base (263)..(263): a, c, t, g, unknown or other
  modified_base (345)..(345): a, c, t, g, unknown or other
  modified_base (362)..(362): a, c, t, g, unknown or other
  modified_base (387)..(387): a, c, t, g, unknown or other
tcagcgatcgtatacacgaccggtgctcgatttagtagcatactgttgagctctgggagaagagcccccagtcccagaattcccaggagtttccattcggtgatcagcactgaacacagaggactcaccatggagtttgggctgagcttgggttttccttgttgctattatagaaggtgtccagtgtcaggtgcagctgggtggaatcgtgggggagcttggtcaagcctgggagggtccctgagactctcctgtgcagcctntggattcaccttcagtgctacttcatgagctggactcccgcaggctccgaggggagggctgcaggtggctccactatattgngtactaagtcggggganaaaccactattccacgcagacttgngtagaacgggcctattctcatcgtaccgaggacaacgccaaagactcatgtactctagacaagtacgaacgtagtactaaaggacgaccgaaagtaccgaacggtccgttagtaccttcgtcggtaagtacggtaggttacgggaggggacgtaacgggacgttaacgggg

SEQ ID NO: 421575 - DNA, 744 bp, Homo sapiens
  misc_feature: GZ8MTXP02HP2SH.51.37.D04.1.454.CMB.2.raw
  modified_base (303)..(303): a, c, t, g, unknown or other
  modified_base (352)..(352): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagcgtgggtggaatcggtgggggagcgtttggtcaagccgtgggacgggtccctgacgactctccgtgtgcacgccctctggactttccaccttcagtggcttaccttanatgagcgtaggacctcccgacgacggtccgtacggaaggggacgggtcnggcggtggtcggtctaccgaacttagtttagttacggtcgtaacgttaaaggtcggggaaacctaaaccctacttaacgtttaccgaacgactaacgtaccttacggaaggaaacgggaaccgggtacccttacgtttccctacccgtaacgttacccgtaccgggaaacggtaaaccccaaaccggtaacccaaaacgtaacccttacgtaaccgtttacgtaactacgtaacgtaaacgtaaagtaacggaaacgtacgtaaacgtaaaacggaaccggaaccggaaaacggtacccggtacccgggttacgttacgttaccgttcggtacggtaacgggtacggtaggggttacggggtaaggggaaccggtacggttaaccggtacgg

SEQ ID NO: 421576 - DNA, 630 bp, Homo sapiens
  misc_feature: GZ8MTXP02IDLF6.51.37.D04.1.454.CMB.2.raw
  modified_base (260)..(260): a, c, t, g, unknown or other
  modified_base (283)..(283): a, c, t, g, unknown or other
  modified_base (343)..(343): a, c, t, g, unknown or other
  modified_base (358)..(358): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagcctnggattcaccttcagtgctacttnatgagctggactccgcaggctccgaggggaagggctgcaggtcggtctccacatattagngactaagtggggaanaaccatatttccacgacagacttcgagaggaacgggcctatttcctacgattccgacccgagggaaccaaaccggaccaaaaggaaccttacaaaccgttggtaaacttcgtagaacctaaaagtcgaaaaccgtgtaaccgtaaaaggcgaaacccggaaacggaaacctaaccggggtcccggttatttaaaccccgttttcgagggttaacgccggggttaaaggttcggggaagggggtaccgaaaggggtaacccgttaaacggggg

SEQ ID NO: 421577 - DNA, 599 bp, Homo sapiens
  misc_feature: GZ8MTXP02FY7K3.51.37.D04.1.454.CMB.2.raw
  modified_base (375)..(375): a, c, t, g, unknown or other
  modified_base (570)..(570): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggaggtcttggtcaaggccgtgggagggtccctggagactctcctgtgcagcctctggattcaccttcagtgctacttcatgagctggactcccgccgaggcctccgaaggggacgggctgcgaggtgggtctccgactatattagtcgacttaagtgggggaanaaaccctactattcctaacgcaacgtactctaggaagggaaacgggccgtaatttccacctagttcccaccgaagggaaccaaaccggacccaaaggaaccctcaacttgtaactccgtagaaccgtaaatacggaaacctagtaaccgtaaagaacgaccggaaagaccgacggcgttacgtactcgtgtcggngtaggtggtacgggaggaggtacgtacgg

SEQ ID NO: 421578 - DNA, 723 bp, Homo sapiens
  misc_feature: GZ8MTXP02HG30F.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagccgtgggacgggtccctgagctctcctgtgcagcctctggattcaccttcagtggctactcatgagctggactccgcaggcctacgaggggaggggctggctaggtcgggtctccacgtattagtttaggtgaccgttaaagtgggggaaactaaacccactacgttttacccaacggcctaaaggtacccttcgtacgggaaacggggaaaccgggggtcccgttaaacttttcccgtacccgtaactttcccgtaaccccggaaacgggggaaacccaaacccgggtacccaaaacggtaaaacccttccaaaccgtttacggtaacttcccggtaaacgaacgtaaaacgtacgaaaacgtaacgttaacgaaaacggaaccggaacccggaaaacggacccggtaaccgggttccgtttacgttaccgtttcgtgggtaacggtacggtacggggttacgggtacggggaacggtaacgggtaaccgtaacgggg

SEQ ID NO: 421579 - DNA, 600 bp, Homo sapiens
  misc_feature: GZ8MTXP02ISJKK.51.37.D04.1.454.CMB.2.raw
  modified_base (252)..(252): a, c, t, g, unknown or other
  modified_base (259)..(259): a, c, t, g, unknown or other
  modified_base (357)..(357): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtgggtttcctgtagctatatagagtgtccagtgtcaggtgcagctggtggaatcgtgggggagcttggtcaagccgtgggacgggtccctggagactctcctgtncagctgngatcaccttcagtcgctacttcatgagctcggactccgccaggcctacccggagggggaacgggctggacgtaggtcgggtctaccactatagttagngactagtggggaacaaccactacttcacgcagactgtaggaggtaacggtcccgtattcctacctacgttacccgaacggacgggaaccaaacccgaaccctaaaaggtaaccctctaacgtacgttaactcttaggaacctaaagtacgaaactacgtacgaaaagacgacgaaagaccacggtcgttacgtacttcggtgtaacgacggtacggttcgggaggtaggacggtacggtacgg

SEQ ID NO: 421580 - DNA, 595 bp, Homo sapiens
  misc_feature: GZ8MTXP02IM8MY.51.37.D04.1.454.CMB.2.raw
  modified_base (191)..(191): a, c, t, g, unknown or other
  modified_base (255)..(255): a, c, t, g, unknown or other
  modified_base (261)..(261): a, c, t, g, unknown or other
  modified_base (272)..(272): a, c, t, g, unknown or other
  modified_base (287)..(287): a, c, t, g, unknown or other
  modified_base (345)..(345): a, c, t, g, unknown or other
  modified_base (465)..(465): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtncagctggtggaatcgtgggggagcttggtcaagcctgggagggtccctgagactctcctgtgcngcctcnggattcacctnagtgctactcatganctggactccgcaggctccggagggagggctgcaggtggtctaccgactatattaggtnacttaaagtgggggaaacaaaccacgtattccgtaacgctaagacctgtaggtaggaaacggggccctaatttccacctatcccgtaccgagggaccaaaccggcctaaagaacccttanacgttagtactacgtagaaactaaagtacgaaactagtactaaagtacgaccgaaacggaccgtaccggccgttacgtaccttgtacggtggacggtaggttacgggaggacggtacggtaacggtacgg

SEQ ID NO: 421581 - DNA, 616 bp, Homo sapiens
  misc_feature: GZ8MTXP02G15IK.51.37.D04.1.454.CMB.2.raw
  modified_base (420)..(420): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggaggtccctgagactctcctgtgcagcctctggattcaccttcagtggcttacttcatgagcgtggactccgccgaggcctaccggaggggacggggctaggcgaggtcgggtcaccgtacgattagttagtgtaccttaaagtgggggaaccaaaccgtactatttccgacggacaacggtaccttacggnggaaacggaacggggtcctaactttccgaccctactccgtaccgaacgggaaccaaccggaccaaaagtaccttacacgttagtataccgagaacctaaagtacgaactagtacgaaagacgaccgtaagaccgacggtccgttagtacccttgtagtcggagtaaggtggtacgggaaggacggtacgtaacggg

SEQ ID NO: 421582 - DNA, 550 bp, Homo sapiens
  misc_feature: GZ8MTXP02J0H9K.51.37.D04.1.454.CMB.2.raw
  modified_base (273)..(273): a, c, t, g, unknown or other
  modified_base (345)..(345): a, c, t, g, unknown or other
  modified_base (384)..(384): a, c, t, g, unknown or other
  modified_base (400)..(400): a, c, t, g, unknown or other
  modified_base (440)..(440): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagccgtgggaggtccctgagactctcctgtgcagcctctagattcaccttnagtggctacttcatgagctggactccgcagctcggagggagggctgcgtaggtggtctccgactatattagngacttaagtggggaacaacccatattcacgcagactcgngagaacggcctattcncatccacgaggaccaacgacaaagacctcacgtgtactcngtaacaaatcgaactagtacgtaaaaggacgaacccgaagacccgacgggtcccgttagtaccgttcgtagtcggacggaggtgggtacgggaggtacggacgttacggg

SEQ ID NO: 421583 - DNA, 678 bp, Homo sapiens
  misc_feature: GZ8MTXP02GQOGE.51.37.D04.1.454.CMB.2.raw
  modified_base (263)..(263): a, c, t, g, unknown or other
  modified_base (290)..(290): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagtcttggtcaagccgtgggacgggtccctgagctctcctgtgcagcctngacttcaccttcagtgctactcatganctggactccgcaggcctcggaaggggagggctgcaggtcggtctccactattagttaggtcgacttaaagtcgggggaaacaaaccctacgtactttaccgaacgactaaggtacctcgtaggaaacggaaacggggtccctaatttccccacctaacgttcccgtaacccggaaagggggaaccccaaaaccgggacccctaaaaaggtaaccccttacgaaacctttaggtaacttacccgtaggaaacctaaaaagtacggaaactaacggttaaccgaaaaggaacgaccccggaaaagacccgaaaccggggtcccgttagttaaccgttcgtaggtcggacggtaggttacggggagggaaggacgggtaacgttaaccggg

SEQ ID NO: 421584 - DNA, 689 bp, Homo sapiens
  misc_feature: GZ8MTXP02JVCBC.51.37.D04.1.454.CMB.2.raw
  modified_base (267)..(267): a, c, t, g, unknown or other
  modified_base (360)..(360): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagccgtgggagggtccctgacgactctcctgtcgcagcctctggnttccaccttcagtcggctactcatgagctggactccgccaggcctaccggagggggacgggctagcgtaggtgggtctccacgtatattaggngtacgttaagtggggaacaaccactacttcctacgctacgtactcgtaggaacggaacgggcccgtaattcctaccattcccgtacccggaggaacccgaaaccgcccgaaacggtaacctacctacgttcggtaacttcgtacggaacctaaaagttacggaaaacctaggtttaaccgtaaaggaaccggaaccggaacggtaaacccggaaccggggttacccgtttacggtttaaccgtttaccggttggttcgggaccgggttacgggggttacggggttaccgggggaacgggttacggggtaaaccggtttaacccgggggg

SEQ ID NO: 421585 - DNA, 621 bp, Homo sapiens
  misc_feature: GZ8MTXP02GUTZ9.51.37.D04.1.454.CMB.2.raw
  modified_base (475)..(475): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggcaagccgtgggacgggtccctgacgctctcctgtcgcagcctctggtattcaccttcaggtcggctactcatgagcgtggactccgccgaggcctaccggaggggtaacggggctggcgtaggtcgggtcaccgactatagttagtgacttaaggtggggaacaacctatacgttccacgcagtactcgtaaggaacgaacggggctattcctccactccgacgacgggacaaccgacaaacgactctagtgtaancgtaagtaacaaagtacaaacgtaacgtaacgtaaaacgacggtaacccggaaagaacccggtacgggtacccgttacgttaccgttcgtggtaacggtcggtacggggttggacgggggtaaggtacggtaaacggttaccgggg

SEQ ID NO: 421586 - DNA, 576 bp, Homo sapiens
  misc_feature: GZ8MTXP02JV40E.51.37.D04.1.454.CMB.2.raw
  modified_base (278)..(278): a, c, t, g, unknown or other
  modified_base (341)..(341): a, c, t, g, unknown or other
  modified_base (354)..(354): a, c, t, g, unknown or other
  modified_base (548)..(548): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctgggtggaatcgtgggggaggcttggtcaagccgtgggagggtccctggagactctcctgtgcagcctctggattcaccttnagtgctacttcatgagctggactcccgcgaggcctccggaggggagggctggcgaggtggtcncactattattagngacgtaagtggggaacaaccatacttctacgacaagtactcgtaggaacggaacgggccctaatttcccacctagtccgtaccggaagggacccaaacgccaaaagtacctcacgttgtaacttcacggacaaaagtgaaactacgtacgaaagacgaccgaagaccgacggtcgttacgtacttgtaggtcgnggtaggtcggaggagtacggacgtacgg

SEQ ID NO: 421587 - DNA, 529 bp, Homo sapiens
  misc_feature: GZ8MTXP02FZ6O4.51.37.D04.1.454.CMB.2.raw
  modified_base (274)..(274): a, c, t, g, unknown or other
  modified_base (344)..(344): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttgggtcaagcccggagggtccctgagactctcctgtgcagcctctggattcaccttnagtggctactcatgagctggatccgcaggcctaccgaggggagggctggcagtgggtctcacatatagtnactaaagtgggagaaccatattcacgacagactcgtgaagacgggcattctacatcacgaggaccaacgaccaaagactcgacttgtaatctacgacaaatgaaacagtataagacgaccgaagacgaccggcgtacgttactcgtgtcgaaggtagtacggtgggaagaggtacgtacggtacg

SEQ ID NO: 421588 - DNA, 589 bp, Homo sapiens
  misc_feature: GZ8MTXP02HHF6S.51.37.D04.1.454.CMB.2.raw
  modified_base (272)..(272): a, c, t, g, unknown or other
  modified_base (307)..(307): a, c, t, g, unknown or other
  modified_base (352)..(352): a, c, t, g, unknown or other
  modified_base (361)..(361): a, c, t, g, unknown or other
  modified_base (367)..(367): a, c, t, g, unknown or other
  modified_base (387)..(387): a, c, t, g, unknown or other
  modified_base (461)..(461): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctgggtggaatcggtggggggaggtcgtttgggtcaaggccgtggggacgggttccctggagaccttctcctgtacngcctcgtgattccaccttcagtgctacttcatganctggactcccgcaggcctaccggaggggagggctgcaggtggctnacatattgnctaagngggacaaccatacttcacgnatactcagaaggaacgggcctattccgacatccaccgaagggaacctaacgaaccaaagaacctcaactgtacnctagaacaaagtcgaaaacagtaacaaaagacgaccgaaaaggtccgaaccggccgttaatccgttacgtggtacggcggtaaaggttcggggaggggaaacgacggggtaaaccgttacgggaacgg

SEQ ID NO: 421589 - DNA, 569 bp, Homo sapiens
  misc_feature: GZ8MTXP02FOY3E.51.37.D04.1.454.CMB.2.raw
  modified_base (272)..(272): a, c, t, g, unknown or other
  modified_base (369)..(369): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggaggtccctgagactctcctgtgcagcctctggattcaccttnagtgctactcatgagctggactccgccaggcctccgaggggaggggctgcaggtcgggtctcgacatattagtgacttaagtggggaacaaacccanatttccacgcagactcgtagagaacgggccctaattccacctatcccgtaccgaacggggaaccaaaccggcccaaagacctcaacttgtaactcgtagacaaagtacgaaactagtactaaaagcgaccgaaagaccgacggtccgttacgtaccttcgtagtcggcgtaggtgggtaggacggacggtacgtaacggg

SEQ ID NO: 421590 - DNA, 558 bp, Homo sapiens
  misc_feature: GZ8MTXP02FULTB.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggagggtccctgagactctctgtgcagcctctggattcaccttcagtgctactcatgagctggactccgcaggctcgaggggacggctgcaggtggtctccactatattagtgacttaagtggggaacaaaccatattctacgcagactcgtaggaggaaacgggcctaatttccacctatcctaccgaagggaccaaacggccaaagacctcactgtatcgtagacaaatgaaactagtactaaaggacgaccggaaacgacgaaccgggtccgtacgttaacctcgtaggtgacggtaggtcggtagggaggaacgggactacgggg

SEQ ID NO: 421591 - DNA, 742 bp, Homo sapiens
  misc_feature: GZ8MTXP02FYUR1.51.37.D04.1.454.CMB.2.raw
  modified_base (707)..(707): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgcttattatagaaggtgtccagtgtcaggtgcagcgtggtaggaatcggtgggggagtcgttggtacaacggccgtgggacggtccctaggacgtactctccgtgtcgcacgtcctcgtaggtacttcctaccttcgaggtcgtaccttacgttcagttcggacgtcgtcgggacctcccggaccgacggtcccgtaccgggaaggggggtacggggcgttggaccgtaggggttcggttcctaccctaacgttaagttagtttacggtacgtaaaccgttaagggtacgggggaaacctaaaccctaacgttaccgtttaccgtaaccggacgtaacgttacttacgggtacggttaaacggggaaccgggttccttaacgttttcccacccgtacgttacccgaccgggaaaccggaaacctaaaccgggaaccctaaaacggaacccttacgtacgttagttaactccgtaggaaacctaagtaacgactagtacgaagacgtacgaaagccgtacgtccgttactacgtcgtgtaacgggngtaggtacggggaggtacgaacgggtactaacggg

SEQ ID NO: 421592 - DNA, 684 bp, Homo sapiens
  misc_feature: GZ8MTXP02JHR0J.51.37.D04.1.454.CMB.2.raw
  modified_base (260)..(260): a, c, t, g, unknown or other
  modified_base (362)..(362): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagtcttggcaagccgtgggacgggtccctgacgtactctccgtgtcncagccctgtgacttccacttcgagtcggcttatcatgagctggactcccgcgaggcctacggaggggaggctgcgaggtcgggtctaccactattagttagngtacgtaagtcgggaaacaacccgattacttccgacgacgtaacgaccttggaaggaacgggtaacggggcccttaagtttcccacccgtacgttacccgtacccggaaggggaaacccaaaccggacccgtaaaacggtaccctacgtaacctttaggttactaccgttaggaaaccttaaagtacgaaacgttacgttaacgaaacggacggaaacccgaaacggtaacggtcccggggtacccgtttagttaaccgttccgtagggttggacggtttaaaggtcgggggtaaggaacgggaacggtacgggttaacggg

SEQ ID NO: 421593 - DNA, 539 bp, Homo sapiens
  misc_feature: GZ8MTXP02JE7V7.51.37.D04.1.454.CMB.2.raw
  modified_base (289)..(289): a, c, t, g, unknown or other
  modified_base (329)..(329): a, c, t, g, unknown or other
  modified_base (354)..(354): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagcctctggattcacttcagtggctacttcatganctggactccgccaggctccgagggagggctgcagtggtcncgacatatagtgcttaagtgggganaaccatattctacgcagactctagagaagggccgtattctccatctaccgagggacaaccggccaaagactacactgtactcgtagacaaatgaaacagtactaaggacgacgaaagaccgaacggacgttcgtaaccttcgtaggtcgacggtaaggttggagggacggtaggacgttaacggg

SEQ ID NO: 421594 - DNA, 657 bp, Homo sapiens
  misc_feature: GZ8MTXP02GRCX3.51.37.D04.1.454.CMB.2.raw
  modified_base (264)..(264): a, c, t, g, unknown or other
  modified_base (569)..(569): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcggtgggggagtcttggtcaagccgtgggacgggtccctgagactctcctgtgcagcctntggattcaccttcaggtgactacttcatgagctggactccgaccaggcctccggaagggggaacgggctaggcgtagggttcgggtctaccatattagttaggtgaacgttaaggtcgggggaacaaaccctagtactttccaacggctaacgtaccttcgttgggacgggaaacggggtcctaactttccaccctattcccgaccggaaacgggaaccaaccggtacccaaaagacttacacttagtaacttcaacgaataaaactacggaaactacggtaactaaacggccgaaccgggaaanaccggtaaccgggggtcccttagttaacctttgtcgggtaagtacggtagggttacggagggggaagtacgggttacgtaaccggggg

SEQ ID NO: 421595 - DNA, 707 bp, Homo sapiens
  misc_feature: GZ8MTXP02H59PG.51.37.D04.1.454.CMB.2.raw
tcagcgatcgtatacacgaccggtgctcgatttagtagcatactgttgagctctgggagaagagccacagtcccagaattcccaggagtttccattcggtgatcagcactgaacacagaggactcaccatggagtttgggctgagcttgggttttcctgttgctattatagaaggtgtccagtgtcaggtgcagctgggtggaatcggtgggggagtcttgggtcaagccgtgggacgggtccccgagacttctccgtgtcgcagccctctggattcaccttcagtcggctacttcatgagctggactcccgcgaggctaccgaggggaggggctggcgtaggtggggtcctaccgactatagttagtgacttaagtcgggggaacaaaccactattccgacgacagacctgtggtacggaacgggcccgtatttcctccctaagttcccgtaacccgagggggaaacccaaaccggacccaaaacggtaacccttaccgtaaacccgttaggttaactaccgttaaggaaccctaaaaagtcggtaaaacctacggttaaaccgtaaaacggaaccggtaccgggtaaaaacggacccggaaaccggggttacccgttacggttaaacccgtttcggtacggtaacggtacggtaagggttacggggtagggggaaacggtaacggggtaacccgtttaacggggg

SEQ ID NO: 421596 - DNA, 580 bp, Homo sapiens
  misc_feature: GZ8MTXP02GLADP.51.37.D04.1.454.CMB.2.raw
  modified_base (262)..(262): a, c, t, g, unknown or other
  modified_base (291)..(291): a, c, t, g, unknown or other
  modified_base (330)..(330): a, c, t, g, unknown or other
  modified_base (341)..(341): a, c, t, g, unknown or other
  modified_base (543)..(543): a, c, t, g, unknown or other
  modified_base (566)..(566): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccctgagactctcctgtcgcagcctcgnggattccaccttcagtgctacttcatganctggactccgcaggctccgagggagggctgcagtggtcncacatattagngactaaagtggggaacaaccacgtatttaccgacgacaggtaccctgtaggaaggaacggggccctaatttcccacccaagtccctaccgaggggaaccaaaccggcccaaaagacctcgaaccttgtaactccgagaacctaaagtcgaaactagtacgaaaagacggacccgaaagaccgaccggccgttagtaccttgngtaagcgtaggtcggtagggganacgggtacctaggg

SEQ ID NO: 421597 - DNA, 697 bp, Homo sapiens
  misc_feature: GZ8MTXP02HLY50.51.37.D04.1.454.CMB.2.raw
  modified_base (295)..(295): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagccgtgggacggtccctgacgactctcctgtcgcagcctctggacttcaccttcagtcggctacttcatgancgtggatcccgcgaggcctaccggaggggacggggtctaggcctagggtcggggtctccccgactattagtttaggtgaccgtttaaagcgggggaactaaaccctacgtaatttcccgtaacgcgaacgtactcgtaggaaacggaacgggggaccctatttccctacctattaccccgtaccgaacgggggaaccaaaacccgggacctaaaacggtaacctccaaaccgtttggtaccttacgtacgaacaaaacgttaacgaaccctaaggttaaacgaaacggacggaacccggaaagaacccggtaaacccggggttcccgtagttaaccgtttccgtggtaacggacggtaacggggttcggggtaggacggggaacggttaccgttaacggggg

SEQ ID NO: 421598 - DNA, 582 bp, Homo sapiens
  misc_feature: GZ8MTXP02J0G0R.51.37.D04.1.454.CMB.2.raw
  modified_base (330)..(330): a, c, t, g, unknown or other
  modified_base (334)..(334): a, c, t, g, unknown or other
  modified_base (341)..(341): a, c, t, g, unknown or other
  modified_base (362)..(362): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccctgagactctcctgtgcagcctctggattcaccttcagtcggctacttcatgagctggactccgccaggctccgagggagggctgcagtggtcncacntattagngactaagtggggacaaaccanattcacgcagactcgtaggaacggaaggggccctaatttcccgaccagtttcccaccgacggggaaccaaaccgggcccaaaagaacctcaaccgtgttaactcctagacaaaagtcgaaacctagtactaaaacggcgaacccgaaagaccaccgggcgttacgtaccttcggtagtcggacggtagtcgggttggggacgtacgggtacgtaccgggg

SEQ ID NO: 421599 - DNA, 753 bp, Homo sapiens
  misc_feature: GZ8MTXP02GPAA1.51.37.D04.1.454.CMB.2.raw
  modified_base (249)..(249): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcctcactctctgcacaggctctgaggcctcctatgagctgacacagccagcctcggtgtcagtcgtccccaggacagacggacaagactccctgctcgtggagatgctattacgaacctaaaacgttntttcgttacgtttttacggaacccaaacgaggaacgccgaacggaccgaccggtacccctaaattaaacttaaattataataaataaagactaggtagacggaccgccctagacgggtacctcccgtaggacgtacgtactttcctcgtcggcccctccgacgtccgtacggaacgggaaccaacgcgtacccgtacggttacgaacgttaagtttacggacgggtacgtacccgaggacaaaggaacgacgggacgtacgtacggtaacttaacgttacgtacgtactaaatacggaagaccggaagaaccgaacggtaggttaacggttaacttagggtacgggttaacgttacgggttaccggggacgggggtaaacgggtaaccgtaacggggttaccgtaaccccggttcggtaaacggtccgaaaccgtcccggaaggtcccgtacccggtacccccggttcggtaccctaccgttcccgtttacccgtttacccccc

SEQ ID NO: 421600 - DNA, 654 bp, Homo sapiens
  misc_feature: GZ8MTXP02G8M19.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagtcgttgggttttccttgttgctattatagaaggtgtccagtgtcaggtgcagcgtggtggaatcggtggggggagtcgttggtacaaggccgtgggacgggtccctggacgtacctctccgtggtcgcagtccctcgtggtacttccaccttcgaggttcggaccttacttcagttggagtcgttcggactcccgccgaggccgtaccgggaaggggaggggctggcgtaggtcggtcacgactattagttagtgacttaaggcggggaaacaacctactacttccaacgcacgtacttcgaggaacgacgggtcctattccaccgattcccgacgacggaacaaaccggccaaagacctcgaacttgtaactcgtaacaaacgtaaaactacgtaaactaacgtaacgaaaacgaacggaacccgaaacgacccgggtaaaccggtccttcggttaaccctgtacggtggcggtaagggtgggtagggaacggtacggagtttacggg

SEQ ID NO: 421601 - DNA, 578 bp, Homo sapiens
  misc_feature: GZ8MTXP02HK2W8.51.37.D04.1.454.CMB.2.raw
  modified_base (291)..(291): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggacgggtccctggagactctcctgtcgcagcctctggattcacttcagtgctactcatganctggactccgcaggcctcgaggggagggctgcgagtggtctcgacattattaggtgtactaagtggggaataaacccataactttcgaacgcaacgtacttcgtggtagaacggggtcctaattctccatccgtacgaggacaaccgtacaaagactgactgtactcgagacaaaagtgaaactagtacgaaagacggacgaaacgaccgacggaccgtttaggtacccttggtggtaacgccgtaagggttacgggagggaacggtacgggtaaaccttacggggg

SEQ ID NO: 421602 - DNA, 542 bp, Homo sapiens
  misc_feature: GZ8MTXP02G6R30.51.37.D04.1.454.CMB.2.raw
  modified_base (343)..(343): a, c, t, g, unknown or other
  modified_base (358)..(358): a, c, t, g, unknown or other
  modified_base (397)..(397): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagcctctggattcaccttcagtggctacttcatgagctggatccgcaggctccgaggggagggctggcaggtggtctccacatattagngactaagtggggaanaaccacattcacgcagactcgtgtgaacgggcctattcnccatcctacgaggacaacgcaaagactcactgtactcgtagacaaagtcgaaactagtactaaagacgacccgaaagaccgacggtccgttacgtaccttcgtaggtgacgtaggtcggtaggggacgtacgggacgttacgggg

SEQ ID NO: 421603 - DNA, 626 bp, Homo sapiens
  misc_feature: GZ8MTXP02IEYQV.51.37.D04.1.454.CMB.2.raw
  modified_base (514)..(514): a, c, t, g, unknown or other
  modified_base (592)..(592): a, c, t, g, unknown or other
tcagcgatcgtatacacgaccggtgctcgatttagtagcatactgttgagctctgggagaagagcccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcgttggtcaagcctgggacggtccctgagactctcctgtcgcacgtcctcgtggtacttcaccttcgaggtcggtcttacttcattggagtcgtggactcccggccgaggccgtaccgaagggggacggggtctggcgtaggtggtcctccaacgtatttattaggtcgtacttaaagtcgggggaaacctaaaccactaactttccgacgacaacgtaccttgaggaaaggacgggtccctaatttccaccctatccgtacccggaaggaccaaaccgtacccaaaagtacctaccncttagtactcgtagtaacaaaatgaaacctgtaaactaacggacgaccgaaaggtccacggggtcctagtacctttgnggtcgcggtaggtcggaggacgtacggacgtcgg

SEQ ID NO: 421604 - DNA, 498 bp, Homo sapiens
  misc_feature: GZ8MTXP02IL2H2.51.37.D04.1.454.CMB.2.raw
  modified_base (264)..(264): a, c, t, g, unknown or other
  modified_base (276)..(276): a, c, t, g, unknown or other
  modified_base (290)..(290): a, c, t, g, unknown or other
  modified_base (320)..(320): a, c, t, g, unknown or other
  modified_base (330)..(330): a, c, t, g, unknown or other
  modified_base (342)..(342): a, c, t, g, unknown or other
  modified_base (357)..(357): a, c, t, g, unknown or other
  modified_base (378)..(378): a, c, t, g, unknown or other
  modified_base (396)..(396): a, c, t, g, unknown or other
  modified_base (430)..(430): a, c, t, g, unknown or other
  modified_base (432)..(432): a, c, t, g, unknown or other
  modified_base (435)..(435): a, c, t, g, unknown or other
  modified_base (437)..(437): a, c, t, g, unknown or other
  modified_base (439)..(439): a, c, t, g, unknown or other
  modified_base (441)..(441): a, c, t, g, unknown or other
  modified_base (443)..(443): a, c, t, g, unknown or other
  modified_base (445)..(445): a, c, t, g, unknown or other
  modified_base (447)..(447): a, c, t, g, unknown or other
  modified_base (474)..(474): a, c, t, g, unknown or other
  modified_base (477)..(477): a, c, t, g, unknown or other
tcagcgatcgtatacacgaccggtgctcgatttagtagcatactgttgagctctgggagaagagcccccagtcccagaattcccaggagtttccattcggtgatcagcactgaacacagaggactcaccatggagtttgggctgagctgggttttccttgttgctattatagaaggtgtccagtgtcaggtgcagctgggtggaatcgtggggggagcttggtcaagcctgggagggtccctggagactctcctgtgcagcctnggattcaccttnagtgctatcatganctggatcccgcaggctccgaggggagggcngcagtggtcncaacatattagngactaaagtgggganaaaccatattcacgcagactnagagaacgggcctattcnccatccacgacggacaacgtacaaagactcattnancanananananananaagacacaacacgacgacgtcgtactntgngcgagtgaggagacgacgtag

SEQ ID NO: 421605 - DNA, 637 bp, Homo sapiens
  misc_feature: GZ8MTXP02FSZ6D.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagtcttgggtcaagccgtgggacgggttccctggagacctctcctgtgcagcctcgtggacttcacttcagtgctacttcatgagctggactccgccaggcctccgaaggggaggggctgcaggtcgggtctccgactatattagtgacttaaggtgggggaacaaacctactaatttcctaaacgctaaggtacctcgttaggttaggaaacggggtccctaagtttcccgaccctaatcccgtaccggaacggggaaccaaaccggacccaaagtaacctcaaccttgtaactcgtacgacaaagttacgaactagtaacgtaaaagacggaacccgaaaggaccaaccgggtccgttacggttacccttgtaggtaacgcggttagggtggtacgggggagaaacgggtacgttaacgggg

SEQ ID NO: 421606 - DNA, 532 bp, Homo sapiens
  misc_feature: GZ8MTXP02G3VPL.51.37.D04.1.454.CMB.2.raw
  modified_base (190)..(190): a, c, t, g, unknown or other
  modified_base (255)..(255): a, c, t, g, unknown or other
  modified_base (267)..(267): a, c, t, g, unknown or other
  modified_base (328)..(328): a, c, t, g, unknown or other
  modified_base (333)..(333): a, c, t, g, unknown or other
  modified_base (343)..(343): a, c, t, g, unknown or other
  modified_base (348)..(348): a, c, t, g, unknown or other
  modified_base (410)..(410): a, c, t, g, unknown or other
tcagcgatcgtatacacgaccggtgctcgatttagtagcatactgttgagctctgagagaagagccccagtcccagaattcccaggagtttccattcggtgatcagcactgaacacagaggactcaccatggagtttgggctgagctgggttttcctgttgctattatagaaggtgtccagtgtcaggtncagctggtgaatcgtgggggagcttggcaagcctggacggtccctgagactctctgtgcagcctntggatcaccttnagtgctactcatgagtctggactccgcaggctccggaggggaggctgcaggtggcctcacntatgnactagtgganaccanattcacgcaagctcgtagaggaacgggccctattccccactactacccgacggacgaaaccncgaaaccgactacactagtatcctagacaaatacgacgaagtacgtaacgaacgaccgaaagacgacggtcgtacgtactctagtcggagtcgggtacgagggtacggacggtacgtacggg

SEQ ID NO: 421607 - DNA, 556 bp, Homo sapiens
  misc_feature: GZ8MTXP02F6U4B.51.37.D04.1.454.CMB.2.raw
  modified_base (340)..(340): a, c, t, g, unknown or other
  modified_base (349)..(349): a, c, t, g, unknown or other
  modified_base (400)..(400): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttgggtcaagcctgggaggtccctgagactctcctgtgcagcctctggacttcaccttcagtggctacttcatgagctggatccgcaggctcgagggagggctgcagtggtctcgacatattagngacttaagnggggacaaaccatattcacgcagactgtaggagaacggggcctaagttccncctatccgtaccaggggaacaaccggccaaaagacctacactagtactactacggaacaaagtgaaacctaggttacaaaaggacgaccgaaagaccgaacggtcgtacgttaacttcgtaggtgcgtaaggtcggtagggagtaggacgtacggg

SEQ ID NO: 421608 - DNA, 736 bp, Homo sapiens
  misc_feature: GZ8MTXP02G2P8M.51.37.D04.1.454.CMB.2.raw
  modified_base (284)..(284): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctgggtggaatcggtgggggagtcgttggcaagccgtgggacgggtccctgacgtactctcctgtcgcagcctcgtggacttcaccttnagtgctacttcatgagctggactcccgcaggcctccggaggggaggggctggcgtaggtcggtctccacgtattagttaggtgacttaaaggtcgggggaaacaaaccactactttcgaaccgacaacggtaccctgtaggaaacgggaacggggtcccttaaatttcccgtaccctaacgtttaccccgtaacccgggaaacgggggaaaccccaaaaccgggaacccaaaaggtaaaccccgttactaaacccgtttaggttaaaccttcccggttaaaacgaaacctaaaagtaacgtaaaaccgtaacgtaaacgtaaaacgggaaccggtaaacccggaaacggaacccgggtaaccgggttacccgttacgttaccgtttcgtagggtaaccggtacggttacgggtagggtaacggggaacggtaaccggggtaacggtaacggg

SEQ ID NO: 421609 - DNA, 613 bp, Homo sapiens
  misc_feature: GZ8MTXP02HZV5D.51.37.D04.1.454.CMB.2.raw
  modified_base (191)..(191): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtncagctggtggaatcgtgggggagcttggcaagccgtgggagggtccctgagctctcctgtgcagcctctggattccaccttcagtcggctacttcatgacgctggactccgccaggctccggaggggaggggctgcgaggtcgggtctccgaactattagttaggtgacgttaaaggtgggggaaactaaaccactattaccgacggcagtaactcgaggacggaacgggccctattcctacctaagtccctaccggaggggaaccaaaccggtaccaaaacggtaaccttacgaaccttggtactcgtacgaactaaaagtcgaaactagtaacaaaacggcgaaacccgaagaccgaccgggcgttacgtacttcgtagcggtacggaggttcgggagggagtaacgggtactaacgggg

SEQ ID NO: 421610 - DNA, 531 bp, Homo sapiens
  misc_feature: GZ8MTXP02IHRGR.51.37.D04.1.454.CMB.2.raw
  modified_base (265)..(265): a, c, t, g, unknown or other
  modified_base (333)..(333): a, c, t, g, unknown or other
  modified_base (379)..(379): a, c, t, g, unknown or other
  modified_base (397)..(397): a, c, t, g, unknown or other
tcagcgatcgtatacacgaccggtgctcgatttagtagcatactgttgagctctgggagaagagcccccagtcccagaattcccaggagtttccattcggtgatcagcactgaacacagaggactcaccatggagtttgggctgagctgggttttccttgttgctattatagaaggtgtccagtgtcaggtgcaggctgggtggaatcgtgggggagcgttggtcaagcctgggacggtccctgagacttctcctgtgcagcctntggattcaccttcagtggctacttcatgagctggatccgcaggctccgagggagggctgcagtggtcncacatatgtgactaagtggggacaaccacattccacgcagacctgngtagaacggggcagttcnccatctaccgagggacaacgaccaaagactacgacttgtatcctagacaatagacagtactaaggacgaccgaagactacgcggtccgtacgttacttcgtggtcgacggtagtggacgggtagtacggaaccg

SEQ ID NO: 421611 - DNA, 827 bp, Homo sapiens
  misc_feature: GZ8MTXP02F8VTF.51.37.D04.1.454.CMB.2.raw
  modified_base (299)..(299): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagcgtggtggaatcgtgggggagtcttggtcaagccgtgggacgggtccctgacgactctcctgtgcacgcctcgtggacttcaccttcagtggctacttcatganctggactccgccaggcctaccgaggggacgggctggctaggtcggtctaccgactattagttaggtcgacgttaaagtcgggggaaacaaacccgtactacgtttacccgtaaacgcctaaacggtaaccttcgtaagggaaacggggtaaaccgggggtacccgttaaacgttttcccctacccccgtaaacgttcccccgttaacccggaaaacgggggtaaaccccaaaaccccgggaaaccccgaaaacggtaaaccccttacccgtaacgtttaacggttaacctacccgttaagggaaacccttaaaagttaaccgggaaaaccgttaacgggtttaaaaccgtaaaacggggaaacccggtaaaaccccgggtaaaacggaaccccgggtaaacccggggttccccggtttaacgtttaaacccgttttccggttagggttaacggggtaccgggttaaaggggtttcgggggttaacggggggaaaggtaacccgggggtaacccggtttaaaccggggg

SEQ ID NO: 421612 - DNA, 566 bp, Homo sapiens
  misc_feature: GZ8MTXP02FNURF.51.37.D04.1.454.CMB.2.raw
  modified_base (347)..(347): a, c, t, g, unknown or other
  modified_base (361)..(361): a, c, t, g, unknown or other
  modified_base (367)..(367): a, c, t, g, unknown or other
  modified_base (403)..(403): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaaggtgtccagtgtcaggtgcagctggtggaatcgtgggggagcttggtcaagcctgggagggtccctgagactctcctgtgcagcctctggattcaccttcagtggctacttcatgagctggactcccgccaggcctccgaggggaaggggctgcaggtggtctccacatattagngactaagtgggganaaccanattcacgcagactctgagaacgggcccgtatttccncccatccctaccgaagggaccaaacggccaaagacctcactgtaactctagacaaaagtgaaacagtacaaaggacgacccggaaagacccgaccgggtcccgttagttaccttcgtggtcggcgtaaggttcgggtagggggagaacgggacgttaacgggg

SEQ ID NO: 421613 - DNA, 588 bp, Homo sapiens
  misc_feature: GZ8MTXP02GHGA8.51.37.D04.1.454.CMB.2.raw
  modified_base (344)..(344): a, c, t, g, unknown or other
  modified_base (498)..(498): a, c, t, g, unknown or other
  modified_base (553)..(553): a, c, t, g, unknown or other
  modified_base (568)..(568): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttgggtcaaggccgtgggacgggtccctggagcctctcctgtgcagcctctggacttcaccttcagtggctacttcatgagcgtggactccgccgaggcctccggaaggggagggctgcgaggtggtcncactatattagtgacttaaaggtggggaaacaaaccctagtactttccgaacgcacgtaccttcgtaggtacggaacggggtccctatttcccgaccctacgtcccgtaccgaacggggaaccaaacccgaccaaaaggaaccctcacgtgtanctagacaaatcgaactagtacgtaagacgacgaaagacgacgtcgttactactcnggcgcgaggttcggnggaacgtacggacgtaacgg

SEQ ID NO: 421614 - DNA, 654 bp, Homo sapiens
  misc_feature: GZ8MTXP02I0YES.51.37.D04.1.454.CMB.2.raw
  modified_base (280)..(280): a, c, t, g, unknown or other
  modified_base (294)..(294): a, c, t, g, unknown or other
  modified_base (610)..(610): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcggtgggggaggcgttggtcaaggccgtgggacgggtccctgagactctcctgtgcagcctgtgacttcaccttnagtgctatcatgancgtggactcccgccaggcctccggaaggggacgggctggctagggtcgggtactccacgtattagttagtcgtacgttaaagggtcgggggaaacaaaccctacgtaactttccgaacgactaacggtaccttcggtaggaacgggaaacggggtcccttaaatttcccacccgtacttaccccgtaccggaacgggaaccaaaccggacccgaaaacgtaacccttccaacgtttggtaactcccgtagaaactaaagtacgaaactacgtacgtaaagaccgacgaaacgacgaccggtacgtcttaccgttgnggtaacggacggtggttacggggaggaggaacggtacggtacgg

SEQ ID NO: 421615 - DNA, 647 bp, Homo sapiens
  misc_feature: GZ8MTXP02IS5QO.51.37.D04.1.454.CMB.2.raw
  modified_base (273)..(273): a, c, t, g, unknown or other
  modified_base (331)..(331): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagccgtgggaggtccctgagactctcctgtgcagcctctggattcaccttnagtggcttactcatgagctggactccgccaggctccgagggagggctgcaggtggtcncacattattagtgacttaaagtgggggaaacaaacccgactactttccgtaacgcgaagaccttcgtaggaaggaaacggggccctaatttcctacctaacttccgtaccgaaaggggacccaaacggacccaaagaaaacctcaaccgtagtaactcgtacggaactaaaagtacgaaacctaagttaccgaaaaggacggaacccggaaaaggaccgaaccggggtaccgtttaccgttaccgtttccgtggttaacggaccgggtagggttacgggtagggggtaccggtaaggggtaaccgttaaccggggg

SEQ ID NO: 421616 - DNA, 594 bp, Homo sapiens
  misc_feature: GZ8MTXP02H0NZ4.51.37.D04.1.454.CMB.2.raw
  modified_base (358)..(358): a, c, t, g, unknown or other
  modified_base (365)..(365): a, c, t, g, unknown or other
  modified_base (386)..(386): a, c, t, g, unknown or other
  modified_base (400)..(400): a, c, t, g, unknown or other
  modified_base (480)..(480): a, c, t, g, unknown or other
  modified_base (542)..(542): a, c, t, g, unknown or other
tcagcgatcgtatacacgaccggtgctcgatttagtagcatactgttgagctctgggagaagagcccccagtcccagaattcccaggagtttccattcggtgatcagcactgaacacagaggactcaccatggagtttgggctgagcttgggttttccttgttgctattatagaaggtgtccagtgtcaggtgcagctgggtggaatcggtgggggagcgttgggtacaaggccgtgggacgggtccctgacgactctccgtgtgcacgtcctctggacttccaccttcagtggctacttcatgagctggactccgccgaggcgtccggaggggagggctggcaggtggtctcgactnttattgngtactagtcggggaacaaacnctattccgtacganactctcgagaagggaacgggccgtattcctaccgactccgtaccgagggacaaaccgtaccaaagtacctcacgtgtacnctagacaatagaacctagtacaaaggacacgaacgaccgacggtcgtacgttaccgttacgnggttaacggacggttaggttcggggagggaacggtaggtaaaccggtcgggg

SEQ ID NO: 421617 - DNA, 629 bp, Homo sapiens
  misc_feature: GZ8MTXP02GGFG4.51.37.D04.1.454.CMB.2.raw
  modified_base (268)..(268): a, c, t, g, unknown or other
  modified_base (594)..(594): a, c, t, g, unknown or other
  modified_base (601)..(601): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagtcttgggttttccttgttgctattatagaaggtgtccagtgtcaggtgcagctggtggaatcggtgggggagtcgttggtacaaggccgtgggacgggtccctggacgacctcttcctgtgcngccctcgtggacttccaccttcaggtgtccttacttcatgagctggactcccgccgacggcctaccggaagggggacgggcttgacgtaggtcggtacctaccgaactagtttacgttaggtagtacttaaagggtcgggggaaactaaacccacgttacttaccgtaacgcgtaaagtaccctcgtaaaggaagggaaacgggcccttaattcccacgtactcgacccgaaagggacccaaaccgaccaaataccgtctactcgtatacctagaactaaatacgaaactagtacaagacgacgaagcgtacgcgtactacttcgngtaacgnggtagtacggaggaagacggacgtacgg

SEQ ID NO: 421618 - DNA, 599 bp, Homo sapiens
  misc_feature: GZ8MTXP02IHJ8X.51.37.D04.1.454.CMB.2.raw
  modified_base (261)..(261): a, c, t, g, unknown or other
  modified_base (274)..(274): a, c, t, g, unknown or other
  modified_base (291)..(291): a, c, t, g, unknown or other
  modified_base (499)..(499): a, c, t, g, unknown or other
  modified_base (561)..(561): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaggtgtccagtgtcaggtgcagctgggtggaatcgtgggggagctttggcaagccgtgggaggtccctgagcttctcctgtgcatcctntggattcaccttnagtggctacttcatganctggactcccgcaggctcgaggggaggctgcgaggtggtctccaactattagttacgtagtaccgtaaagttcgggggaaactaaacccactaacgtttacccgtacggactaaaggaccttacgaaggaaggaaacggggcctaacgtttccaccgtatccgtacgaacgggaccaaacgacccaaagaacctcacctgtatcgtanaactaaagtacgaactacgtactaaggacgaccgaaagacgaccggtacgtacgtacttcgnggtaacgcggaagtggagggtggaacggtacgtaacgg

SEQ ID NO: 421619 - DNA, 552 bp, Homo sapiens
  misc_feature: GZ8MTXP02JD5LB.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctggaggtccctgagactctcctgtgcagcctctggattcaccttcagtggctacttcatgagctggactccgcaggctccgagggagggctgcagtggtctcgacatatagtgactaaagtggggaacaaacccgtatactttctaacgcaacgtactcgtagaacggaacggggccgtaatttcctacccatccgtaccgacgggaaccaaccggaccaaagaaccttcacttgtactctagactaaatgaacagtactaaagacgaccgaagaccgacggccgtcgtactcgtagcgtgacgtggtggaggacggacgtacgg

SEQ ID NO: 421620 - DNA, 767 bp, Homo sapiens
  misc_feature: GZ8MTXP02G6BKY.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagccgtgggacgggtccctgagactctcctgtcgcagcctctggtacttcaccttcagtcgccttacttcatgagcgtggactcccgcaggcctaccggaaggggacggggctcggacgtaggtcggggtctacccgactattagtttaggcgtaacgttaaaggtcgggggaaaccaaaccctactagtttccgaaacgctaaacggtacttcgtaggtacggaaacgggggtccctaatttcccgtaccctaacgttcccgtaacccgggaaaggggtaacccaaaacccgggacccctaaaaaacggtaaccccttacccgtaaacccgtttaggtaaaccttccgttaaacggaaccctaaaaagttacgggaaaacccttagggtaaaacccgtaaaagggaaccggaaaccccggaaaaacggcccggaaacccggggttcccgtttaacgggttaacccttttcgggtaacggtcggtaccgggtaacgggttaggggtacgggggaaacgtacgggggtaaaccgtttaaccggggg

SEQ ID NO: 421621 - DNA, 721 bp, Homo sapiens
  misc_feature: GZ8MTXP02HOCTD.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagtcttggtcaagccgtgggacggtccctgagactctccgtgtcgcacgcctcgtggtacttcctaccttcaggtcggccttacttcattggacgtcgtggactcccgccgaggcctaccggaggggtaacggggctggaccgtaggttcgggttacacccgaactaagtttagtttaacggttgaaccgttaaagtcgggggaaacctaaaacccgtactacgttttaacccacgggtaccaaacgtaccgttcgttagggttaacggaaacgggggtcccgttaatttccgacccctaagttcccctacgggaaacggggaaccaaaccggaccaaacgtaacctctaaacgttgtaaacttccgtaagaacctaaagttcggaaactacggttaaaccgaaagacggaacccggaaagacccgaccgggttaccgttagttaccctttacggtgtaacggtcggtaaggttcgggaggggaacgtacggtaacgggtttaaccggg

SEQ ID NO: 421622 - DNA, 620 bp, Homo sapiens
  misc_feature: GZ8MTXP02IQJUJ.51.37.D04.1.454.CMB.2.raw
  modified_base (243)..(243): a, c, t, g, unknown or other
  modified_base (375)..(375): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcctcactctctgcacaggctctgaggcctcctatgagctgacacagccagcctcggtgtcagtcgtccccaggacagacggccaagactcccctgctctggagatgcattgaccaaaacgtntttgctttttaggaaccaacagaagcaggccaggccctataataattatataataaagacagtagagacggccctagaagggactcccgtgagcgtattcctcgtggaccctccagctacgaggaccaacgngcctacgttgactagtaggtggatccgagcaagaagacgagctagtacttattaactgtacaaatcgaaagacagacgtacgaaggttacggttaacttagtaggtaagttacgttacgggacgggaacgggtaaccgaaaggggttaccgtaccggttaacccgtaaggggtaccaacgggaccccaaagggtcccgtaaccggcccccgttcggtacctaccgttcgttacccggtttccccc

SEQ ID NO: 421623 - DNA, 802 bp, Homo sapiens
  misc_feature: GZ8MTXP02GRZ1E.51.37.D04.1.454.CMB.2.raw
  modified_base (257)..(257): a, c, t, g, unknown or other
  modified_base (266)..(266): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagtcttggtcaagccgtgggacggtccctgagctctcctgtgcngcctgtggnttcaccttcgagtcggctacttcatgagcgtggactccgccgaggcctaccggaaggggaaggggctggcgtagggtcgggtcctaccgactaagttaagttaggtgacttaaaggtgggggaaaccaaacccgaactacgtttacccgtaacggacctaacgtaaccgttcgtaagggaaacggggtaaaccgggggtcccttaaagttttacccctacccgtaactttaccccgtaccccgggaaaacggggaaaccccgtaaaacccggaaacccgaaaaacgttaaacccgttccttaaaacccggttaggtttaaaacccttcccggttaaggaaaactaaaaacgttaacgggaaaaccgtacggtttaaaaccgtaaacgggaaacccgaaaccccggggaaaaggtaaaccccggaccggggttaacccggttacgttttaaaccccggttcgttggggttaaccggacgggttaagggttagggggttaaccgggggaaggtaccgggggtaactttaaccgggggg

SEQ ID NO: 421624 - DNA, 623 bp, Homo sapiens
  misc_feature: GZ8MTXP02HUBZY.51.37.D04.1.454.CMB.2.raw
  modified_base (336)..(336): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagcctctggattcaccttcagtggctacttcatgagctggactccgccaggcctccggaggggaggggctgcaggtgggtcnccactattattaggtgtacttaaagtgggggaactaaaccactatttcaacggcagactcgtaggaggtaaacggggcctatttcctcctactcctacccgaggggaaccaaccgggacccaaaggaaccctacacttaggtacttcgacgaacctaaaagttcaaaccgtagtacctaaaaggcgaaccgaacggaacgacccgggtccgttacggttacctttcgtaggtcggtccgggtaaggttcggggtaggggaacggacggggttaaccgttaacggggg

SEQ ID NO: 421625 - DNA, 611 bp, Homo sapiens
  misc_feature: GZ8MTXP02IFHVV.51.37.D04.1.454.CMB.2.raw
  modified_base (359)..(359): a, c, t, g, unknown or other
  modified_base (576)..(576): a, c, t, g, unknown or other
tcagcgatcgtatacacgaccggtgctcgatttagtagcatactgttgagctctgggagaagagcccccagtcccagaattcccaggagtttccattcggtgatcagcactgaacacagaggactcaccatggagtttgggctgagcttgggttttccttgttgctattatagaaggtgtccagtgtcaggtgcagctgggtggaatcgtgggggagcttggtcaagcctgggacgggtccctgacgactctcctgtgcacgcctctggattcaccttcagtggctactcatgagctggactcccgcgaggcctccggaggggaggggctggcgaggtgggtctccactattagttagngtactaagtgggggaacaaccactattaccacgcaagtacctcgtaggaacggaacggggtcctaactttcctaccatttcccgaccggaaacggggaccaaaccggacccctaaaaggacccttacgaccttagtactctacgaacaaagtacgaactaggtaactaacggacgacccgaaagacccgaacgggtccgttaggttacctcgtaggngtacggaggtcggtagggaggacggtacgtacggg

SEQ ID NO: 421626 - DNA, 575 bp, Homo sapiens
  misc_feature: GZ8MTXP02JAPQI.51.37.D04.1.454.CMB.2.raw
  modified_base (184)..(184): a, c, t, g, unknown or other
  modified_base (460)..(460): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtggtttcctgtgctatatagagtgtcagtgtcaggtncagctggtggaatcgtgggggagcttggtcaagcctgggagggtccctgacgactctcctgtgcagcctctggattcaccttcagtgctacttcatgagctggatccgcctagctacgagggagggctgcagtggtctccgactatattagtgaccttaagtcgggggaactaaacctaccgtatttacacgacgagtaaaccctcgttaggaagggaaacgggccgtaacttcctacctacttccctacggacgggaaccaaacgtaccggaaanaacctcaacgtgtacttacgagacaaactaacgaactagtacgaagacgacgacgacgacgtacgtacgttacgtcgtgtgtagtacggtaggtaggacggacggtacggtacgg

SEQ ID NO: 421627 - DNA, 554 bp, Homo sapiens
  misc_feature: GZ8MTXP02F1UBC.51.37.D04.1.454.CMB.2.raw
  modified_base (244)..(244): a, c, t, g, unknown or other
  modified_base (365)..(365): a, c, t, g, unknown or other
  modified_base (413)..(413): a, c, t, g, unknown or other
  modified_base (421)..(421): a, c, t, g, unknown or other
  modified_base (438)..(438): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcctcactctctgcacaggctctgaggcctcctatgagctgacacagccagcctcggtgtcagtcgtccccagggacagacggccaagactcccctgctctggagatgcattgaccaaaacgtntttgctttttggaccaacagaagccaggccaggcccctataataattatatataaagacagtgagaggccctgagggatcccgtgacgcgattctctggccctccagctcgaggacaacgngccagttagacgtattaggtggacgtaccgaggacaagaacgagagcngactatanagcaatcagcagacganagtagtactagtaggagtagttcggacggagggaacgaaacgggtcgaaccgtacgttacggcaacggccccaaaggcctcggcccccttacggcctaccgttctcgtttaccccc

SEQ ID NO: 421628 - DNA, 680 bp, Homo sapiens
  misc_feature: GZ8MTXP02JW7M8.51.37.D04.1.454.CMB.2.raw
  modified_base (262)..(262): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagtcttggtcaagccgtggagggtccctgagactctcctgtgcacgcctntggtattcaccttcagtcggctactcatgacgctggactccgcaggctaccgaggggaggctgcgaggtcgggtctccgactattagttagtgtaccgttaaagtcgggggaactaaacccgactagtttccgaacgtcctaacggtacctacgttagggaacggaacgggggtaccctacgtttacccgtacctacgttacccgttaccgaacggggaaaccctaaaccgggaccctaaaacggaaccctcgtaaaccgtgttacctacgttacggaaacctaaaagtcgaaacccgttagtaaacgttaaacggaacgtaacccggaaaaggaacccgtaacgggtcccgttaacggttaaccctttgtggtcgacggtaggtcgggttaaggggagtaccggaacggttaacggg

SEQ ID NO: 421629 - DNA, 800 bp, Homo sapiens
  misc_feature: GZ8MTXP02F5TFX.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcggtgggggaggtcttggtcaagccgtgggacgggtccctgagactctcctgtgcagcctctggattcaccttcagtgctactcatgagttggactccgcaggcctccggagggggaacgggctaggcgtagggtcgggtacctacactaattacgttaggtcgtactaaaggtgggggacaaacccacgtactttaccgacgcgaagtaccttacgtgggaaacggtacgggggcccttaacgtttccctacccgaacttcccgtaacccggaacggggaaacccaaacccggaacccgaaaacggtaaccttacccaacgtttacggttaacttaccgtacggtaaaacctaaaagtaccggtaaaaacgtacggtttaaacccgtaaaaaggaccggtaaaccggaaaacggttaaaaccggggaaaccccggttaaaccgggggttaccccggtttaacggggttttaaaccccgttttcccggttaagggggtttaaccgggaacccggggtttaaacgggggttttacgggggtaacggggggaaaacggttaaacggggggttaaacccggttttaaaacccgggggg

SEQ ID NO: 421630 - DNA, 781 bp, Homo sapiens
  misc_feature: GZ8MTXP02G1ZXQ.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagcgtgggtggaatcggtggggggagtcgttgggtacaaggcccgtggggacggggtcccctggacgaccttctcctggtcgccagcccttcgtggtacttccaccttcgagtggctacttcatgagctggactccgcaggcctacggaggggagggctgcgaggtgggtctccgaactattagttaggtgtaaccgttaaaggtcgggggaaacaaaccctaacttacgtttaccgtaacggacctaagggtaacccttccgttagggttaacgggaaaccggggtcccggttaaacttttcccgtacccctaacgtttccccgtaaacccgaacgggggaaacccaaaaccccggtacccgaaaaacggtaaccctttaccgaaactttagggtaacttacccgtggaaaaccctaaaagttacggaaaacctaacggttaacgtaaaacgaacgggaacccggaaaaggtaaacccggaccggggttacccggtagtttaaccccgttcgtttacgggtaaggcccgggtaaagggtttcggggtacgggggaaaggaacgggggttaaccgttaaaccgggggg

SEQ ID NO: 421631 - DNA, 675 bp, Homo sapiens
  misc_feature: GZ8MTXP02GPSEF.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagccgtggagggtccctgagactctcctgtgcagcctctggattccaccttcagtggctacttcatgagctggactccgcaggctccgaggggagggctgcaggtggtctccactatattagtgacttaagtggggaacaaaccatactttacaacgcaacgtactcgtaggaacggaaaggggcccgttaatttcccgacctaagttcccgtacccgaaacgggggaaccaaaacccgggacccaaaaggtaacccttacgaacgttacggttaacttcccgtaggaacctaaaaagttcggaaaacctaggtttaaaccgaaaagggaaccggacccggaaaaagtaccccggaaaccgggtacccggtttacgttaaccttccgttagggtccggacggtaaagggtttcggggagggggaaaggtaaccggggtacgttaaaccggggg

SEQ ID NO: 421632 - DNA, 674 bp, Homo sapiens
  misc_feature: GZ8MTXP02F0DAT.51.37.D04.1.454.CMB.2.raw
  modified_base (340)..(340): a, c, t, g, unknown or other
  modified_base (553)..(553): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttcctgttgctattatagaaggtgtccagtgtcaggtgcagcgtgggtggaatcggtggggggagtcgttgggtcaaggccgtggggacgggttccctaggacgtcctctccgtgtcgcacgtcctcgtggtacttcctaccttctaggtcggtccttacttcatggacgcgtggactcccgaccgnggccgtcggaagggggacgggcgtggcgagggtcgggtctaccacgtatagtttaggtcgaacgttaaggtcgggggaactaacccaatcgttaccgtacgacacgtactcgtgggtacgaacggggtccctaagtttccctacctacgtcccgtaccggaacggggaaccaaacccggaacaaacgtacctcgtaacgttgtactccggtanaaccaaagttacgaaactacgtaacgtaaacggacggacccggtaaaagacccgacggttaccgttcgttacttcggtagtcggaggtaggtcggggaggggaggtacggtacggtacggg

SEQ ID NO: 421633 - DNA, 571 bp, Homo sapiens
  misc_feature: GZ8MTXP02F6OR6.51.37.D04.1.454.CMB.2.raw
  modified_base (274)..(274): a, c, t, g, unknown or other
  modified_base (290)..(290): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggacgggtccctgagactctcctgtgcagcctgtggattcaccttnagtgctacttcatgancgtggactcccgccgaggcctccggaaggggaggggctggcgaggtcgggtctaccgactattagttaggtgacttaagtgggggaaacaaaccagtattcctaacgcagactcgtagaggaacgggcctattccgacctatccacgacggacaaccgaccaaagacctcactgtatcgtagactaaagtacgaacgtagtacaaaaggacgaccgaaagaccgtaccggcgttacgtactcgtagtcgaggtaggtcggtagggacgtacggacgtacgg

SEQ ID NO: 421634 - DNA, 857 bp, Homo sapiens
  misc_feature: GZ8MTXP02GWLUP.51.37.D04.1.454.CMB.2.raw
  modified_base (263)..(263): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcgttggtcaagccgtgggacggtccctgacgactctcctgtgcagcctntggattcaccttcagtcgctactcatgagcgtggactcccgcaggcctccggaggggaggggctgcgtaggtcgggtctaccgactattacgttaggtcgacgttaagtcgggggaaacaaaccccgtactaacgtttcccgaaacggccgtaaaacggtacccttccgttaaggggaaacggggtaaaccggggggtcccttaaacgttttcccccgtaacccctaacgtttacccccggtacccgggaaaacggggggtaaacccccaaaaacccgggggtaaccccccaaaaaagggttaaaccccctttccgaaaacccggttttgggtttaaaacccgttaccctttaaccggggaaaaccctaaaaaacggtttacgggaaaaacccgttaaaacggggtttaacccgaaaaacggggtaacccggaaaacccccggggaaaaaggtaaccccgggtaaaccgggggttaaccccgtttacggtttaaacccggtttccggttgggttaacggggaaccggttaacgggggttagggggttaacgggggaaaccggttaaagggggtaacccggtttaaacccggggg

SEQ ID NO: 421635 - DNA, 594 bp, Homo sapiens
  misc_feature: GZ8MTXP02JNMNL.51.37.D04.1.454.CMB.2.raw
  modified_base (267)..(267): a, c, t, g, unknown or other
  modified_base (279)..(279): a, c, t, g, unknown or other
  modified_base (289)..(289): a, c, t, g, unknown or other
  modified_base (420)..(420): a, c, t, g, unknown or other
  modified_base (547)..(547): a, c, t, g, unknown or other
tcagcgatcgtatacacgaccggtgctcgatttagtagcatactgttgagctctgggagaagagccccagtcccagaattcccaggagtttccattcggtgatcagcacttaacacagaggactcaccatggagtttgggctgagcttgggttttccttgttgctattatagaaggtgtccagtgtcaggtgcagctgggtaggaatcgtgggggagtcttggtcaagcctagggacgggtccctgacgactctcctgtgcagcctnggattcaccttnagtgctactnatgagctggactccggcaggctacggaggggacgggctgcaggtcggtactcactatacgttagcgtactaaagtggggacaacccgatacgttccacgcagtacctgtgaacgaacgggctattccactntccgaccgaagggacccaacggtaccaaagtaaacctcgaacgtagtactacgtacgtaacaaattaggaaacctagtaccaaaaggcgaaccggaaaagccgaccggtcgttaaacgtacttcggnggtacgaacggtaggtacgggtacggagtacggtacgtacgggtacg

SEQ ID NO: 421636 - DNA, 622 bp, Homo sapiens
  misc_feature: GZ8MTXP02FYR6Q.51.37.D04.1.454.CMB.2.raw
  modified_base (336)..(336): a, c, t, g, unknown or other
  modified_base (340)..(340): a, c, t, g, unknown or other
  modified_base (349)..(349): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagccgtgggacgggtccctgacgcctctcctgtgcagcctctggattcaccttcagtgctacttcatgagctggactccgcaggcctccggaggggagggctgcaggtggtcncganatattagtnacttaagtggggaacaaccgatattcgtacgcaagacctgtaggaaggaacggggcctaatttccgacctattccgaccgaaacggggaccaaaccgaccgaaaaggtaaccctctaacgttaggttaaactcgttaacgactaaaagtacgaaactagtaccgtaaaagaacggacccggaaagaccggaacccgggtcgttacgtttaaccgttcgttacggtggaccggtaggttacggggaggggaacggaacgggtacgttaacgggg

SEQ ID NO: 421637 - DNA, 558 bp, Homo sapiens
  misc_feature: GZ8MTXP02GMEQT.51.37.D04.1.454.CMB.2.raw
  modified_base (244)..(244): a, c, t, g, unknown or other
  modified_base (364)..(364): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcctcactctctgcacaggctctgaggcctcctatgagctgacacagccagcctcggtgtcagtcgtccccaggacagacggccaagactcccctgctctggagatgcattcgaccaaaacgtntttgtctttttaggaccaacagaagccaggccagcccctataataattatatataaagacagtgagagccctgagggactccctgacgcgattctctggcctccagctacgaggacaacncgccacgttgacgtatagtggagtccgaggacagaacgacgaggactgtaactagttactgtacaatcagacagacgacaggtagtactagtgtaagtgttacgggacggagggacaagggtcgtacccgtacttgggacacggccgaaacggcctaccggccccctacggtaccacttcctacgtttcccccc

SEQ ID NO: 421638 - DNA, 601 bp, Homo sapiens
  misc_feature: GZ8MTXP02FUYU8.51.37.D04.1.454.CMB.2.raw
  modified_base (259)..(259): a, c, t, g, unknown or other
  modified_base (368)..(368): a, c, t, g, unknown or other
  modified_base (479)..(479): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaaggtgtccagtgtcaggtgcagctggtggaatcgtgggggagcttggtcaagcctgggagggtccctgagactctcctgtgcagcctntggattcaccttcagtggctacttcatgagctggactccgccaggcctcgaggggagggctgcagtgggtctcacgatattacgtgactaaagtgggggacaaacccanacttccgtaacgcagtacctcgtggtagaaacgggggccctaatttccacctaagttccctcccggaagggaaccaaacggacccaaagtaaacctctaacgtcgtttaancgtagaacaaagtacgaaactaacgtacgtaaaacggacggaccgaagtaaccgacggtccgttacgtacgttcgtggtaacgacggacggtagggtagggtacggtacggtacggtaacgg

SEQ ID NO: 421639 - DNA, 660 bp, Homo sapiens
  misc_feature: GZ8MTXP02GDGJV.51.37.D04.1.454.CMB.2.raw
  modified_base (242)..(242): a, c, t, g, unknown or other
  modified_base (258)..(258): a, c, t, g, unknown or other
tcagcgatcgtatacacgaccggtgctcgatttagtagcatactgttgggtttgggggtgggtccaggaggcagaaatctgggtgtctcaccatggcctggatccctctacttctccccctcctcactctctgcacaggctctgaggcctcctatgagctgacacagccagcctcggtgtcagtgtccccaggacagacggccaagatcccctgctctggagatgcattgaccaaaacgttntttgtcttttagacanagagcagcacgcctataataatatataataagacagtagagacggcctacgaggactccgtgacgcgtattctcgtcgccctccagctacgacggaccaacgcgaccgtacggttacgacgtagttaggtacggacgtaccgaggacgaagaaacggacggacggtacgtacgtaacttaacgttactacgtaactaaacgtacgaacgacgaacggaaccgtacgtaaggttacggttaaacttaaggtaggtaacgttaggttacggggacgggtaacgggtaaccggtaagggtaccggtaaccggttacggtacggtaccgtaccggaacccggtaacggtcccgtacccggtaccccgtacggttaccctaccgtttcccgttacccgtttcccccg

SEQ ID NO: 421640 - DNA, 722 bp, Homo sapiens
  misc_feature: GZ8MTXP02HVEAI.51.37.D04.1.454.CMB.2.raw
  modified_base (294)..(294): a, c, t, g, unknown or other
  modified_base (451)..(451): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagtcttgggtcaaggccctgggacgggtccctgacgtactctcctgtgcagccctgtgacttcaccttcgagtgctacttnatgagctggactccgcaggtcctcgggaaggggacgggctggcgtaggtgggtctccgaactattattaggtcgacgttaaaggtcgggggaaacaaaccactactttaccgacgctaagccctgtaaggacggaaacggggtccctaattttcccnccaaacgtttccgacccgggaggggaaccctaaaacccggacccgtaaaagtaaacccttcgaaacctttagggtaaacgttccctaaggaaacctttaaaaggacggtaaaaacccgtggtaaaaccccgtaaaaggggaccgtaaaaccccgggaaaacggtaccccggtaaaccggggttcccctttaagttaccgtttacggtgttccgggaacggtagggtttacgggggacgggtaacggaacgggggtttaaccctaacggggg

SEQ ID NO: 421641 - DNA, 668 bp, Homo sapiens
  misc_feature: GZ8MTXP02JA4CS.51.37.D04.1.454.CMB.2.raw
  modified_base (191)..(191): a, c, t, g, unknown or other
  modified_base (275)..(275): a, c, t, g, unknown or other
  modified_base (352)..(352): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaagtgtccagtgtcaggtncagcgtggtggaatcgtgggggagcttggtcaagccgtgggacgggtccctgacgactctcctgtgcagcctctgattcacctnagtggctacttcatgagctggactccgcaggcctccgaggggacggctgcgtagtgggtctccgacgatattaggtnacgttaaagtggggaacaacctagtactctaacgcagtaactcgtaggttacgaacgggtaccgtaactttccctacccgtaattcccgttaacccggaaacgggggtaaaccccaaaaccccgggaaccccaaaaacggttaaaacccctaccgtaaactttacggtaaacttacccgtaaggaacctaaaagttacggaaactaacgtacgtaaaacgacgacgaaacggacgaccgggtacgtacgttacccttcgtcggtaaggaccggtaagggttccggtaggggaacggtacggtacggtaaaccgggg

SEQ ID NO: 421642 - DNA, 604 bp, Homo sapiens
  misc_feature: GZ8MTXP02I4A9E.51.37.D04.1.454.CMB.2.raw
  modified_base (251)..(251): a, c, t, g, unknown or other
  modified_base (258)..(258): a, c, t, g, unknown or other
  modified_base (285)..(285): a, c, t, g, unknown or other
  modified_base (573)..(573): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctgttggaatcgtgggggagcttggtcaagcctggaggtccctgagactctcctgtncagcctngattcaccttcagtcgctactcatganctggatccgcaggcctcgagggagggctgcgagtggtctcgacagtattagtgacttaagtgggggaacaaaccctatactttaccgacgactaagaccctgtaggacgggtaacggggccctaatttccgtccctaacgtccgtacccggaaagggaacccgaaaccggacccaaaaggaaacccttcctaaacgttcggtaaacttccgtagaaacctaaagtacgtaaaccgaagtaaccgtaagacggaccgaaaggccgaacggtccgttagtacttcgtggngtacgaggtacggaggacgacggtacgtacg

SEQ ID NO: 421643 - DNA, 719 bp, Homo sapiens
  misc_feature: GZ8MTXP02IQ156.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaggtgtccagtgtcaggtgcagctgggtaggaatcggtggggggagtcgtttggcaagccgtgggacgggtccctgacgacctctcctgtcgcacgccttcgtggtactttccaccttcaggttcggtaccttacttcaagttggacgtccgttgggacctccccggccgagggccctacccgggaagggggaacggggtctagggcgtagggtcgggtcctacgactattagttagtgtacttaagtcggggaactaaacccacgtactttaccgacgacaacgtaccttgagggaaacggaaacgggcccttaatttcccacccgtaacttcccgaacccggaaacggggaacccaaaaccggaccccaaaacggtaaacccttccaacctttaggtactccgtaaggaacctaaaagtaacgaaaccgtaaggttaaccgaaaaggaccggaacccggaaaacggacccgaaccgggttaccgttacgttacccgtttgtacggtggacggtacggtgggtaggacggtacggtaacgtacggg

SEQ ID NO: 421644 - DNA, 515 bp, Homo sapiens
  misc_feature: GZ8MTXP02GO3V1.51.37.D04.1.454.CMB.2.raw
  modified_base (290)..(290): a, c, t, g, unknown or other
  modified_base (356)..(356): a, c, t, g, unknown or other
  modified_base (400)..(400): a, c, t, g, unknown or other
  modified_base (449)..(449): a, c, t, g, unknown or other
  modified_base (454)..(454): a, c, t, g, unknown or other
  modified_base (461)..(461): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagccgtgggacgggtccctgagactctcctgtgcagcctctggattcaccttcagtgctactcatganctggatccgcaggctcgaggggagggctgcagtggtctcacatattagtgacttaaagtggggaanaaccactattcacgcaagactcgtaggagaagggcccatttccnccatcctaccgaagggaccaaacgccaaagtaactcacttgtaatctanacaanagaacanagaagacgacgacgacgacgacgtcgtactcgtgtgcgacgtgtgagagagacg

SEQ ID NO: 421645 - DNA, 649 bp, Homo sapiens
  misc_feature: GZ8MTXP02F2FU7.51.37.D04.1.454.CMB.2.raw
  modified_base (285)..(285): a, c, t, g, unknown or other
  modified_base (337)..(337): a, c, t, g, unknown or other
  modified_base (546)..(546): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaaggtgtccagtgtcaggtgcagcgtggtggaatcgtggggggagcttggtcaagccgtggacgggtccctgagactctcctgtgcagcctctgacttcaccttcagtgctactnatgagctggactcccgcaggcctccggaggggaggggctgcgaggtcggtcncgactatattagtgactaaggtcggggaacaacctagtacttccgtaagcaagtactcgttggtacggaaacgggccctaagttccctccctaaagtcccgtaccgaacgggaaccaaaccggaccaaacgtaaaccttcaactttacggtatcccgtaagaacctaaagtacgaaactaggttaccaaaagggaccgaaaccggaaanaaccggacccgggtaccgtttacggttaaacctttcggtaggttaaccggcgggttaaggttacgggggtagggaacggtaacgggtacgtttaaaccggggg

SEQ ID NO: 421646 - DNA, 567 bp, Homo sapiens
  misc_feature: GZ8MTXP02GEHCH.51.37.D04.1.454.CMB.2.raw
  modified_base (258)..(258): a, c, t, g, unknown or other
  modified_base (269)..(269): a, c, t, g, unknown or other
  modified_base (279)..(279): a, c, t, g, unknown or other
  modified_base (284)..(284): a, c, t, g, unknown or other
  modified_base (325)..(325): a, c, t, g, unknown or other
  modified_base (335)..(335): a, c, t, g, unknown or other
  modified_base (350)..(350): a, c, t, g, unknown or other
  modified_base (408)..(408): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaaggtgtccagtgtcaggtgcagctggtggaatcgtgggggagcttggtcaagcctgggaggtccctgagactctcctgtgcagcctntgatcaccttnagtgctactnatganctggactccgcaggctaccgaggggacggctgcagtggtcncactatatgnacttaagtggggaanaaccctatactttccaacggcaagtacctcgtaggaaggaaacgggtcctaattcccncctaagtcccgaccggaagggaccaaaccgccaaaagtacctcgactagtactccgtagactaaaagtcgaaacctagttacaaaaggacgaccgaaaagccgtaacgggtcctagttaactcgtgtcgacggagtacggtggggatacggactacggg

SEQ ID NO: 421647 - DNA, 740 bp, Homo sapiens
  misc_feature: GZ8MTXP02IWT08.51.37.D04.1.454.CMB.2.raw
  modified_base (289)..(289): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagcgtgggtggaatcggtggggggagtcgtttgggcaaggccgtggggacgggtccctgacgctctcctgtcgcagcctcgtggacttccaccttnagtgctacttcatgagtcgtaggactcccggaccgacgggtccgtaccggaagggggaacggggctacggacgtagggtcgggtcctaccaacgtattacgttagtcgtaacgttaaggtgggggaacaaaccgtaactactttaccgacgaccgtaaacgtaccgttacgaagggacgggtaaacccggggtccttacgtttaccctacccgaactttaccccggaaccgggaaacggggtaacccaaaccggggaaccctaaaaggaccctttaaccgactttacggttaaatcccgttaacggaaataaacgtaacgaaaccgtaaagtaccgtaaaacggacggaacccggaaaacgtaccggaacccggggtcgtttacgtaaccgtttcgtaggtcccggtaaggtaggttcggggaaggggacggaacgggttacgtaacgggg

SEQ ID NO: 421648 - DNA, 667 bp, Homo sapiens
  misc_feature: GZ8MTXP02F2W88.51.37.D04.1.454.CMB.2.raw
  modified_base (256)..(256): a, c, t, g, unknown or other
  modified_base (263)..(263): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgttgggttttccttgttgctattatagaaggtgtccagtgtcaggtgcagctggtggaatcgtgggggagcttgggtcaagcctgggacggtccccgagactctcctgtncagcctntggattcaccttcagtgcttacttcatgagctggactcccgcgacggtcctaccggagggggaacggggctgggacctaggggtggggttcctacgaaccctagttagtttagcgtacttaaaaggtcgggacgaaaccctaacgtactttaccgacgactacgaccttcgtaggtacggaaacggggccctaatttcccgtaccctaacttcccgtaaccggaacggggaaccccaaaccgtaacccgaaaaccgaacctttacccgaacgtttacgttaactcgtaacgaactaaagtacgaaactagtaacgaaacgacggaacgtaacgacgacccgggtacttacgttaccgttcgaggtcggaagtaggtggggtacgggagtacggacgtacgggcg

SEQ ID NO: 421649 - DNA, 562 bp, Homo sapiens
  misc_feature: GZ8MTXP02FV8YI.51.37.D04.1.454.CMB.2.raw
  modified_base (468)..(468): a, c, t, g, unknown or other
  modified_base (535)..(535): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagccgtgggacgggtccctgagactctcctgtgcagcctctggattcaccttcgagtggctacttcatgagctggactcccggccagggcctccggaggggaggggctggctaggtgggtcctccgacattattaggtgactaagtgggggaacaaccactattccacgcagtactcgtggtagaacgggcctatttccacctatacccgtaccgaacgggaaccaaccggacccaaagaacctnaacctggtaactctagaacaaatgaacagtacaagacgacgaagaccgcggtcgtcgtactcgtagngacgagtggtaggagacggacgtacgg

SEQ ID NO: 421650 - DNA, 700 bp, Homo sapiens
  misc_feature: GZ8MTXP02H0SKZ.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctgggtggaatcgtgggggagctttggtcaagccgtgggacgggtccctggacgtcttctcctgtcgcagcctctggacttccaccttcgagtggaccttacttcatgagcgtggactcccgacgaggcctaccggaggggacggggctggcgtaggtgggtcctacaactattagttaggtcgtacttaaaggtcgggggaaactaacctaacttacgttacctacggactaacgggaccttcgaacggtaacgggaacgggtacccgtaatttcccgacccttaactcccggtaaccggaacggggaaacccaaacccggtacccgaaaacggtaaacccgtcctaaccggttagttaactccgttacggaaaccttaaaagacggtaaaactaggtaaacccgtaaagggaccgaaccgggaacgaacccggtaccgggtacgttacgtaccgtttagcggtaacgacggtagggtcggtagggacgacggtacgtaacggg

SEQ ID NO: 421651 - DNA, 650 bp, Homo sapiens
  misc_feature: GZ8MTXP02HQU6X.51.37.D04.1.454.CMB.2.raw
  modified_base (187)..(187): a, c, t, g, unknown or other
  modified_base (298)..(298): a, c, t, g, unknown or other
  modified_base (306)..(306): a, c, t, g, unknown or other
  modified_base (314)..(314): a, c, t, g, unknown or other
tcagcgatcgtatacacgaccggtgctcgatttagtagcatactgttgagctctgggagaagagcccccagtcccagaattcccaggagtttccattcggtgatcagcactgaacacagaggactcaccatggtagtttgggctgagcgtggtttctgtgctattatagagtgtccagtgtcaggtncagcgtggtaggaatcggtgggggaggtctttgggacaaggtcccgtggggtacgggttcccctggacgtccttctccgtgtcgcacgcctctggattcacctccagtggntcttcatnagcgtganccgcacgcgtcgagggaagggcgtgcgtagtggtcgtccacatattagtgtacgtaagtggaagaactactacttactacggactacgacctcgagagacggacggtacttactcctactacctaccgacggaaccgaaaccgaccgaaaccgaactaccgtacccgttagtacgttacccgtaaacgtaaacgtaaacgtaacgtaacgtaacgtaacgtaacggaaccggaaccgaaccggtaaccggtaccggtaccgttacgttaccgttacgtacggtaacggtacggtacgggtacgggtaacggtaacgggtaacgggtaacggtacgg

SEQ ID NO: 421652 - DNA, 570 bp, Homo sapiens
  misc_feature: GZ8MTXP02IQ4IU.51.37.D04.1.454.CMB.2.raw
  modified_base (348)..(348): a, c, t, g, unknown or other
  modified_base (416)..(416): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggcaagcctgggacgggtccctgagactctcctgtgcagcctctggattcaccttcagtgctactcatgagctggactcccgccaggcctccgaggggagggctgcgaggtcggtctccacattattagngtacttaagtgggggaacaaacccactatttccacgacaagtaccttcgtaggtaggaacggggcctnttacctccaactccgtacccgagggaaccaaaccggaccaaagaacctcgaactgtaactctagaacaaatgaaacagtacaaaggcgaccgaaagaccgaacggcgttacgtacttcgtgtgcgtaggtcggtaggacggacggtacgtacgg

SEQ ID NO: 421653 - DNA, 746 bp, Homo sapiens
  misc_feature: GZ8MTXP02JCPA4.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagcgtggtaggaatcgtgggggatacgttggtacaagccgtgggacgggtccctgacgactctcctggtcgcacgcctcgtggtacttcctaccttcaggtcggaccttacttcagtgacgtcttaggactcccggaccgaggtcctaccggaagggggacggggtcgtggccgtagggtcggggtacctaccgtaactagttagtttaacggtcgtaaccgttaaagggtcgggggaaacctaaaccctaaccgttaactttaccgaaccggactaacggtacctaccggtagggtaaacgggaaacgggggtcccgttaaacgtttccctaccccgtaaagtttccccgtaaccgggaaaccgggggaaaccaaaacccggacccgttaaaaacggaacccttccgtaaaccttgggtaaaccttcgacgtaaacctaaagttacggaaaactacggtaacaaaacggacggaaacccgaaaggaaccgtaccggtacgttacgtaacttcgtaaggtgacgtacgtagggaggagtacggacgtaacggg

SEQ ID NO: 421654 - DNA, 857 bp, Homo sapiens
  misc_feature: GZ8MTXP02JFMXV.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagtcttgggttttccttgttgcttattatagaaggtgtccagtgtcaggtgcagctggtggaatcgtgggggagtcttggtcaagccgtggacggtccctgagactctctgtgcacgcctcgtggacttccaccttcaggtcgtactacgttcagtggacgctggactcccggaccgaggtcccgtaccggaaggggggaacggggtcctgggaccgtaggggttcggggttcctaacccgtaacctaagtttacgttaacggtcgtaaccggtttaaaggtacggggggaaactaaacccctacgttaccttaccgtaacgacgaacggtaacccttggtaagggaaacggggaaacggggtcccgtaacttttcccacccgtacgttacccgtaacccgggaaaggggtaacccccaaaaccgggaccccctaaaaaggtaacccctttaaccgtaaccgttaggtttaaacctacccggttaaacgaaaaccgttaaaaacggtaaccggtaaaaccgtaacgggttaaaaccgaaaacgggtaaacccgggtaaaaccggaaaaccgggtacccgggttaaacccggggttacccggtttaacggtttaaccccgtttcggtaggggttaaccggtaaccggggtttaaggggttacgggggtaaacgggtaaaacggggtaaccggggttaaaccggttaaaccggggg

SEQ ID NO: 421655 - DNA, 631 bp, Homo sapiens
  misc_feature: GZ8MTXP02JD12O.51.37.D04.1.454.CMB.2.raw
  modified_base (287)..(287): a, c, t, g, unknown or other
  modified_base (353)..(353): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccctgagactctcctgtgcagcctctgattcaccttcagtgctacttcatganctggatccgccaggctccgagggagggctgcaggtggtctcacatattagtgctaagtgggggaanaaccactattcctaacgcaagtactcgtaggaaggtaacgggcccgtaatttccctacctaacgtttcccacccgaaacggggaccaaacccggaacccaaaacggaaaccttccgaaccgttaggttaacttccgtagtaccaaaagttggaaaacctagttaaccgaaaaggaacggacccggaaaaggacccgaccgggtaccgttacgtaaccgtttcgtagggttcgacgggtaaggttacgggtgggaaacgggacggtacggttaacgggg

SEQ ID NO: 421656 - DNA, 885 bp, Homo sapiens
  misc_feature: GZ8MTXP02G5C5C.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcggtggggggagtctttgggtacaagccgtgggacgggtccctgagactctcctgtcgcacgcctcgtggtacttccaccttcgagtcggtacttactcagtgagtcgtggactcccgaccgaggcctaccggaagggggacgggctggacgtaggtcgggtacctaccgactagttaagttaggtacgtaacgttaaagggtacgggggaaacctaaacccgtaattaccgtttaccgtaaccgacgaaacggttacctccggttagggtaaacggggaaccgggggtacccttaacgttttacccctacccgtaacgtttccccggaacccgggaaacgggggtaaaaccccaaaacccgggaacccgtaaaaaaccgggtacccctttacgtaaacccgttttagggtaaacccttacccgggttaaaacgtaaaaccgtaaaaggtaacccgtaaaaccggttacggttaaaacccggtaaaaacgggaaaccccggtaaaacccggggaaaaccgggttaacccccggtaaaccgggggttaacccggttttaacggtttaaccccggttttcgggtaacggggtaaccgggttacggggggttaaacggggttacggggggtaaacgggggtaaaaccggggtaaaccgggggttaaaccggggtttaccgggg

SEQ ID NO: 421657 - DNA, 691 bp, Homo sapiens
  misc_feature: GZ8MTXP02JOB61.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagtcttggtacaagccgtgggacgggtccctggacgacctctcctgtgcagcctctggtacttctaccttgaggttcggacttaacttcaagtggacgtcgtggactccccggaccgagggtccgtaccggaagggggacggggcttggaccgtagggtcggggttcctaccgtaactagttaagtttacggtcgtaacgttaaagggtcgggggaaacctaaacctacgttacttaccgaacgcaacgtacccgttgtacggtaggaaacggggtccttaacgttcctaccgtacgttccctaccggaacgggaaccaaacccggaccgaaacgtacctacgtactacgttaacgtcctagaactaaagtacggaaactaacgtaacaaaggacgaccggaaacgtacgaaccggtccgttacgtacgttcgtaggtaacgcggtaacggtggaggggaacgacggtacggtaacgg

SEQ ID NO: 421658 - DNA, 706 bp, Homo sapiens
  misc_feature: GZ8MTXP02I4TVA.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagcgtggtggaatcggtgggggagtcttgggtacaagccgtgggacgggtccctaggacgactctccgtgtcgcagcctgtggacttcaccttcagtggtactactcatgagcgtggactccggaccacggcgtaccggaggggaagggctggaccgtaggtcggggtctacccgaactagttaagtttagtcgtacgttaaaggtcgggggaactaaacctacgtactttaccgaacgccgtaaggaaccttcgtaggtacgggaacggggtaccctattcctccgaacttccgaaccgacgggaaaccaaccgggaaccctaaaggtaacccttcgaaccgtttaggtaactccggttaacgaactaaagttaacggaacctaaggttacaaaacggacgaaccggaaacggacccgtaaacggggtcccgttacgttaaccggtttcgttacggaaccgggtacgtacggtacggggttaggggaacgtacggggttaaccggtacgggg

SEQ ID NO: 421659 - DNA, 707 bp, Homo sapiens
  misc_feature: GZ8MTXP02I70YT.51.37.D04.1.454.CMB.2.raw
  modified_base (295)..(295): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagccgtgggacgggtccctgacgactctcctgtcgcagcctctggattccaccttcagtggctacttcatgancgtggactcccgcaggctccgaggggacggggctgcgaggtgggtctccgactattattagtgacttaagtgggggaacaaacccagtacttaccgtacgcagacctcgtaggaacggaacggggcctaagttccacccgtacttccgtaccgaacggggaaccaaaccggacccgaaaacgaaccttaccaacgtttacggttaaccttacgtacgaacctaaaagttaacggaacctaagtaaaccgttaaaaggaaccggaacccggaaaacggacccggaaaacccggggttccccgtttaaagggtttaaccccctttcggttagggttcccgggtacggggtaaacgggtttacgggggtaacgggggtaaaggaaaccgggggtttaacggtttaaacccggggg

SEQ ID NO: 421660 - DNA, 617 bp, Homo sapiens
  misc_feature: GZ8MTXP02GAAMT.51.37.D04.1.454.CMB.2.raw
  modified_base (261)..(261): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagccgtgggacggtccccgagactctcctgtgcagcctntggacttcaccttcagtgctacttcatgagctggactccgcgacggctacggaggggagggctggacgtaggtgggtctacgactattattagtgctaagtgggacaaccatacttccgacgcagtacttacgtgtaggacggtccgtatttccaccactccgtaccgaagggacccaaccggaccaaacgaacctctaacgttacgttaactcgtacgaaacctaaagtacgaaaacgtagtaaccgtaaaaggcggaaaaccgaacggtaacgaccgggttacgttacgtaccgttagtggtacgcgggttaggcggggttaggggacggtacgggtaccgttaacggtaacgg

SEQ ID NO: 421661 - DNA, 545 bp, Homo sapiens
  misc_feature: GZ8MTXP02FENOO.51.37.D04.1.454.CMB.2.raw
  modified_base (176)..(176): a, c, t, g, unknown or other
  modified_base (259)..(259): a, c, t, g, unknown or other
  modified_base (281)..(281): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaaggtntccagtgtcaggtgcagctggtggaatcgtgggggagcttggtcaagcctgggaggtccctgagactctcctagtgcagcctntggatcacttcagtgctacttnatgagctggatccgcaggctcgagggagggctgcagtggtctccactatattggtgctaagtggggaacaaaccatatttcacgcaagactcgtagagaaacgggcctagttccacctagtctaccgaggggacaaacgcctaaagaacctcgaacttgtaactccgtagaccaaaagttcgaaacgagttccaaaagcgacccgtaaagaccgacgggaccttgtactcgttagcgacgagtggtgggaagacggactacggg

SEQ ID NO: 421662 - DNA, 529 bp, Homo sapiens
  misc_feature: GZ8MTXP02FGEU8.51.37.D04.1.454.CMB.2.raw
  modified_base (285)..(285): a, c, t, g, unknown or other
  modified_base (397)..(397): a, c, t, g, unknown or other
  modified_base (502)..(502): a, c, t, g, unknown or other
  modified_base (504)..(504): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggaggcttggtcaagcctgggagggtccctggagactctcctgtgcagcctctggatcaccttcagtgctacttnatgagctggatccgcaggctcgagggagggctgcaggtggtctcgacatattagtgactaagtggggaacaaccatattcacgcagactctggtaggaacggccgtattccncctatcctccgaaggggaccaaaccgcaaaagacctcacttgtactccgtagactaaagtgaaactagtacaaaagcgaccgaagacgacggccgtagtactcgngngcgagtggaggagacggacgtacgg

SEQ ID NO: 421663 - DNA, 746 bp, Homo sapiens
  misc_feature: GZ8MTXP02JL3IB.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgttgggttttccttgttgcttattatagaaggtgtccagtgtcaggtgcagcgtgggtggaatcggtggggggagtcgttggtacaaggccgtgggacgggtccctggacgtctctccgtggtcgcacggccctgtggtacttccaccttcaggtcgtcctacttcattgagcgtggactcccgccgaggcctaccggagggggacgggctggccgtgggtcggtctaccccgatatttagtaggtctacgttaaggtggggaaccaaacacgtacttccgaacgctagaccttgagggaacggaacgggcctaacttccgtacccattacccgacggaacggggaaccaaaccgaccgaaaagacccttcacgttacggtaacttcgaacgaaaccgttaaaagtaccggaaaactaaacgggtttcccaaaaacggggttaccggaaaaccccgggtaaaacgggaacccccggtaaaccgggggttccccggtttaaggtttaaccccgtttagtacgggggttccgggtaaaccggggtagggttaccggggggaacggggaaaggttacccgggggtaacgtttaaacccggggg

SEQ ID NO: 421664 - DNA, 704 bp, Homo sapiens
  misc_feature: GZ8MTXP02H1SBX.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggcaagcctgggacggtccctgacgactctcctgtgcacgcctcgtggattccaccttcaggtgcctacttcagtgagctggactcccgccaggcgtaccggaggggacggggtctggcgtaggtcgggtcctacactattagttagtgtacgttaaggtcgggggaaactaaacccgtactacgtttaccgaccggactaaacgtacttccggtggtaacggggaaacgggggtaccctaacttttcccgtacccgtacgttacccgtaacccgggaacggggaaacccaaaacccggacccaaaacggttaaacccttaccgtaacgtttacggtaaccgttaccacggtaaactaaaagtacggaaaaccgtagtaacgtaaaaggacccgtaacccggaaaacgggaccgtacccgggtacgtttcgtaaccgttcgtaggtcggcggtaaggtcggtaggggacggtacggtacggtacggg

SEQ ID NO: 421665 - DNA, 656 bp, Homo sapiens
  misc_feature: GZ8MTXP02JL34T.51.37.D04.1.454.CMB.2.raw
  modified_base (260)..(260): a, c, t, g, unknown or other
  modified_base (288)..(288): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctggagggtccctgagactctcctgtgcagcctntggattcacttcagtgctacttcatganctggactcccgccaggctccggaggggagggctgcaggtggtcacgacattattagtgactaagtggggaacaaaccgactacttcgtacgcagtactcgtaggtacggaacgggtcctactttcctaccactcccgtaccgacggggaacccaaaccgaacccgaaagtaaacccttcaacgttacggtaacttaccgtaggtaaccctaaaagttacggaaaccctaggttaaacccgaaaagggaccggaacccggaaaaggaacccggtacccgggtaccccggtttagttaacccgtttccgtaagggtcggtaacggtagggttacggggtagggggacggtaacggggtacgtaaccgggg

SEQ ID NO: 421666 - DNA, 772 bp, Homo sapiens
  misc_feature: GZ8MTXP02FZ2OZ.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggtagtttgggctgagtcgttgggttttccttgttgcttattatagaaggtgtccagtgtcaggtgcagcgtggtaggaatcggtgggggagtcgttggtacaacggccgtgggacggtccctagacgtacctctccgtgtcgcgacgtcctcgtaggtacttcctaccttgtacgtcggtaccttacttcagtgagtccgtggacctcccgaccgacggccgtacggaaggggacgggcgtgcgtaggtcggttctaccgtaactagttagttaggtcgtaacgttaacgggtacgggggaaacctaaacccgtaacgtaacctttaccgtaacgacgtaacgtaccgtttccggtaaggaaacgggggtaaccggtacccgttacgtttaccccaccttacgttaccccgtaaccggaaaccggggaaacccttaaacccgggaaaccaaacggtaaccctactacgttacggttaactacccggttaaagtaaactaaacgtaacggtaaacgtaacggtaaacgtaaaccggaaccgtaaccggaaaccgtaaccggtacccggttaacgttacgttaccgtggtacggtaacggtaggtacgggtacgggacgggaacggtaacggtacggtaacgg

SEQ ID NO: 421667 - DNA, 545 bp, Homo sapiens
  misc_feature: GZ8MTXP02IAT3P.51.37.D04.1.454.CMB.2.raw
  modified_base (225)..(225): a, c, t, g, unknown or other
  modified_base (244)..(244): a, c, t, g, unknown or other
  modified_base (371)..(371): a, c, t, g, unknown or other
  modified_base (444)..(444): a, c, t, g, unknown or other
  modified_base (456)..(456): a, c, t, g, unknown or other
tcagcgatcgtatacacgaccggtgctcgatttagtagcatactgttgggtttgggggtgggtccaggaggcagaactctgggtgtctcaccatggcctggatccctctacttcctccccctcctcactctctgcacaggctctgaggcctcctatgagctgacacagccagcctcggtgtcagtcgtccccaggacagacggccaagactcccctgctctgganatgcattgaccaaaacgtntttgtctttttaggtaccaacagaagccaggcacggcccctaataataattatataataaagacagtgagacgcctgagggatccctgagcgattctctggcctccagtctacgacgggaacaaacngcctaacgttgacgtagttagtggacgtccgagcagaagacgagctagatatactgtacaatcagcagacganagtcgtattagngagtagtcggaggacggaacgaggtcgacgtccgtaagtcacgaccaaaggctaccgccccgtacggtacacctcgtaccgttaccccc

SEQ ID NO: 421668 - DNA, 646 bp, Homo sapiens
  misc_feature: GZ8MTXP02F621B.51.37.D04.1.454.CMB.2.raw
  modified_base (374)..(374): a, c, t, g, unknown or other
  modified_base (450)..(450): a, c, t, g, unknown or other
  modified_base (561)..(561): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagccgtgggacgggtccctgagtactctcctgtgcacgcctcgtggtacttcctaccttcaggtcggaccttacttcaatggacgcgtaggactcccgcgaggcctaccggaggggagggctgcgtaggtcggtcacgactagttattaggngtaacttaaggtggggaacaaacctactacttccgaacggcaagtacctcgtaggaaggacgggtccctaattccncctattccgaccggaaacggggacccaaaccggacccaaaagtaccctacgtaaccgttagtactaccgtagaactaaagtagaacctaagtacgaaagacgaaccgaaanaccggtaccgggtacttaacggttaccttcggtaggtaacggtcggtaaggttgggacgggaggtaacggacggtttaaccgggg

SEQ ID NO: 421669 - DNA, 556 bp, Homo sapiens
  misc_feature: GZ8MTXP02JNGTA.51.37.D04.1.454.CMB.2.raw
  modified_base (217)..(217): a, c, t, g, unknown or other
  modified_base (332)..(332): a, c, t, g, unknown or other
  modified_base (339)..(339): a, c, t, g, unknown or other
  modified_base (344)..(344): a, c, t, g, unknown or other
  modified_base (353)..(353): a, c, t, g, unknown or other
  modified_base (368)..(368): a, c, t, g, unknown or other
  modified_base (421)..(421): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtaaagggggngcttggcaagccgtggacggtccctgagactctcctgtgcagcctcgtggattccaccttcgagtggcttacttcatgagcgtggactccgcaggcctcgaggggagggctgcgngtggtcnccganatattagtnacgtaagtggggaanaacccgtatacttcgtaacgcagtacctgtagaacggaacgggcctaattccncctatccaccgaggaccaacgccaaagactcatgtactcagaacaatcgaactacgtacgaaagacgaccgaagtaccgccggtctagtaccttcgaggtgacgtaggtcggtagggacgacggtacgtacgggg

SEQ ID NO: 421670 - DNA, 716 bp, Homo sapiens
  misc_feature: GZ8MTXP02FV0ND.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcggtgggggagcttggcaagcctgggacggtccctgacgctctccgtgtcgcacgcctcgtggtacttccaccttcgagtgtacttacttcatgatcgtaggactccggccaaggtccgtcccggaaggggtagggctgcgtaggtcgggtctaccgtactattaacgttagtacgaacttaaggtcgggggaactaaacccacttacttaccgtaacggactaacggtactacgtaggaacggaaaccgggtccgaacttttacccgcccttaacgttcccgtaaacccgaaacgggggtaaccaaaacccgggaccaaaacgtaacccttctaaccgttggttaaactccctaagtaaacccgtaaaacttaggtaaaaccacggtaaacgtaaaacggaaccgggaaaccgaaaacggttacccggaacccggggtaccttggtttaacccttgtagggtaaccgtaggaagggttccgggagggaacggaacggtacggtaacgggg

SEQ ID NO: 421671 - DNA, 637 bp, Homo sapiens
  misc_feature: GZ8MTXP02HZZ2O.51.37.D04.1.454.CMB.2.raw
  modified_base (604)..(604): a, c, t, g, unknown or other
tcagcgatcgtatacacgaccggtgctcgatttagtagcatactgttgagctctgggagaagagcccccagtcccagaattcccaggagtttccattcggtgatcagcactgaacacagaggactcaccatggagtttgggctgagcgtgggttttccttgtgctattatagaaggtgtccagtgtcaggtgcagctggtggaatcgtgggggagcgttggtcaagcctgggagggtccctgagctctcctgtgcagccctctggacttcaccttcagtgctacttcatgagctggactcccgcaggcctaccggaggggacggggctggccgtaggtcgggtctccgacgtatttattaggtgtacttaaaggtgggggaaacaaaccctacttacttaccgtaaccggactaacggtaccttcgtagggtacgggaaacggggtccctaagttttcccacccgtatcccgtaccgaacggggaacccaaaccggacccaaagaaacccttcgaacgttcgtaatcctagaactaaagtacggaaactagtaacgaaaggacgaaccgaaacggacctacggggacgttcgtaacttcgtagnggtacgaggttggagggacgtacggaccgtggg

SEQ ID NO: 421672 - DNA, 649 bp, Homo sapiens
  misc_feature: GZ8MTXP02GXIJ0.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaaggtgtccagtgtcaggtgcagctggtggaatcgtgggggagcttggtcaagccgtgggacgggtccctgacgactctcctgtgcagcctgtggattcaccttcagtcggctacttcggtgagctggactcccgccaggcctccggaaggggacggggctggctaggtcggtctcgactattattagtgactaagtgggacaaccacgtattccgaacgcaagtctacgtagaaacggaacggggtccctaatttccacccgattacccgacccggaacgggggaaccaacccggtaccaaaacgaaacctcgtaacgttggtacttaccgtaaagaactaaagtacgaaacgtagtaacgtaaaggaaccggaccgaaacggaccgtacgggttaccgttacgttaccttcggtagggtacggtaacggttaggtacggggtacggggaacgtacggtaaccgttacggggtaaccg

SEQ ID NO: 421673 - DNA, 561 bp, Homo sapiens
  misc_feature: GZ8MTXP02HZOQI.51.37.D04.1.454.CMB.2.raw
  modified_base (225)..(225): a, c, t, g, unknown or other
  modified_base (244)..(244): a, c, t, g, unknown or other
  modified_base (257)..(257): a, c, t, g, unknown or other
  modified_base (261)..(261): a, c, t, g, unknown or other
  modified_base (286)..(286): a, c, t, g, unknown or other
  modified_base (289)..(289): a, c, t, g, unknown or other
  modified_base (291)..(291): a, c, t, g, unknown or other
  modified_base (294)..(294): a, c, t, g, unknown or other
  modified_base (381)..(381): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcctcactctctgcacaggctctgaggcctcctatgagctgacacagccagcctcggtgtcagtcgtccccaggaccagacggccaagactcccctgctctgganatgcattgaccaaaagttnttgtctttgacanagancagcacgacctataatatatataanaananagngagacgcctgaggactcctgacgcgtacttctcgtcgccctccgagtcacgaggaccaacgcgccgtacgtacgtacgtagttaggnggacgtcgagacgaaggaacggacggacggtactacgtacttatacgtatacaatacgagacaagacgagtagtagtactagtggtagttagtcgggacggtaacggacgaggtacgaccgtacgtacgacgacgaccgagtccgtccgcccgttcgtacctaccgttccttccgtcccc

SEQ ID NO: 421674 - DNA, 929 bp, Homo sapiens
  misc_feature: GZ8MTXP02HPTWO.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcggtgggggagtctttgggtcaacggccgtgggacgggtccctagacgacctctcctgtgcagtccctcgtggtacttccaccttcgagtcggctacttcatgagcgtggactccgccgtaggcctaccggaaggggaacggggtctgggaccgtagggttcggggtacctacccgaacgttaagtttacgtttaacggtcggtaaccgtttaaagggacgggggtaaacctaaaacccctaaccgttaaccgttttacccgtaaacccggacgtaaaccgtaacccgttccggtaagggaaaccgggggtaaaccgggggacccgtttaaacttttcccccgtacccctaacgtttacccccgtaacccggggaaaaccggggtaaacccccaaaacccgggtacccctaaaaacggttaaaccccgtttaccgaaacccgtttacgggttaacttacccgggttaaacgtaaaaccggttaaaacgttaaaccggtaaaaccgttaacgggttaaaaccggtaaaaaccgggtaacccgggaaaaccccggtaaaacggggtacccccggttaaacccgggggttcccggttttaaccggtttaacccggttttaccgggttacggggtaaccgggttaaaccgggggttacgggggtttaccgggggaaacggggggttaaaaccggtaaccgggggtttaaaacccgggttaaccggggg

SEQ ID NO: 421675 - DNA, 616 bp, Homo sapiens
  misc_feature: GZ8MTXP02HGVWK.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggaggcttgggtcaagccgtgggagggtccctgagactctcctgtcgcagcctcgtggacttcacttcagtggtctacttcatgagctggactcccgccaggcctccggaggggacggggctggcgtaggtcggggtctacgactagttagttagtgacttaaagtgggggaacaaccactatttcacgacacggtactcgtaggaacggaaggggcccgtaattccctaccgaacttccgtaccgaacggggaaccaaaccgaccgaaacgaacttcgaccgttgtactcgtacgactaaaagtgaaaccgtagtaacgtaaacggacgaacccggaaagaccgaacgggtccgtacgttacgttcttgaagtcggaggtcggtaggacggacggtacgtacgg

SEQ ID NO: 421676 - DNA, 677 bp, Homo sapiens
  misc_feature: GZ8MTXP02JHNP0.51.37.D04.1.454.CMB.2.raw
  modified_base (212)..(212): a, c, t, g, unknown or other
  modified_base (221)..(221): a, c, t, g, unknown or other
  modified_base (244)..(244): a, c, t, g, unknown or other
tcagcgatcgtatacacgaccggtgctcgatttagtagcatactgttgggtttgggggtgggtccaggaggcagaactctgggtgtctcaccatggcctggatccctctacttcctccccctcctcactctctgcacaggctctgaggcctcctatgagctgacacagccagcctcggtgtcagtcgtcccaggacagacgccaagctcccngctctgganatgcattacgaacctaaaacgtntttgtcttttacggaaccaacgagaacgccacggccacggacccctaataactaattatataataaagacagtagagacgccctagaggtactcccgtgacgcgtattccgtacgtcggcctaccgacgctacgacggtaaccaacgacgccgtaacggtcgtaacgtagttacggtaggacgtaccgaggaccaaggaaacgacggtaagtctagtaacttaacgttacgtagtacgaaacttacgaacgaacgaacgaaccggtacgtaacggttagggttaacgttaggtacgggtacgttacggttacggggacggggtaacggtaaccggtaaggtaccgtaacccggttacgtaacggtacgaccgaccgtaacggtccgtacccgtaccccgtccggtaccttaccgtaccttcccgttacccccc

SEQ ID NO: 421677 - DNA, 655 bp, Homo sapiens
  misc_feature: GZ8MTXP02FOZUW.51.37.D04.1.454.CMB.2.raw
  modified_base (192)..(192): a, c, t, g, unknown or other
  modified_base (257)..(257): a, c, t, g, unknown or other
  modified_base (288)..(288): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtncagctggtggaatcgtgggggagcttgggtcaagccgtgggacgggtccctgagactctcctgtncagcctcgtgacttcacctcagtgcttactnatgagcgtggactccgcaggcctacggaaggggacgggctggcgaggttcggtcaccaactatattgtagacttaaggtcggggaacaaacctacgtactttaccgaacggctaagtacccgttgaaggaagggaacggggtcccttaactttcccaacctacttcccgaccgaaacggggaaccaaacccggacaaaacgtacctcgtaacttaggtactccgtagaaactaaagttacgaaaccttagaacgtaaaagggccgaaaccggtaaggaaccgacccggggttaccttcgttacgttcgtagggtcccggtaggtaggggtcggggtaaggggaacgggtaacggacgttaacggggg

SEQ ID NO: 421678 - DNA, 581 bp, Homo sapiens
  misc_feature: GZ8MTXP02F1CKG.51.37.D04.1.454.CMB.2.raw
  modified_base (342)..(342): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccctgagactctcctgtgcagcctcgtggattcacttcagtggctacttcatgagctggactccgcaggctccgagggacgggctgcagtggtctcactatattagtnacgttaagtggggaacaaaccgatattccaagccagtacctcgtaggaacgaacggggcctaattccgacctactcgtcccgaacgggaccaaacgacccaaaggaccctcacgtagtactcgtagactaaagtcaaactgtaacaagacgaccgaaagaccggaacggtccgttacgtaaccgttcgtaggtcggacgtacggttacggggagggaaacggacggtaaccgtaacggg

SEQ ID NO: 421679 - DNA, 680 bp, Homo sapiens
  misc_feature: GZ8MTXP02IYDO2.51.37.D04.1.454.CMB.2.raw
  modified_base (224)..(224): a, c, t, g, unknown or other
  modified_base (244)..(244): a, c, t, g, unknown or other
  modified_base (346)..(346): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcctcactctctgcacaggctctgaggcctcctatgagctgacacagccagcctcggtgtcagtcgtccccaggacagacggccaagactcccctgctctgganatgctattgaccaaaagttntttcgtctttttggtaaccaacagaacgccacggtccacggacccctaataacttaacttataactaataaagacagtgagacgccctagagggactcccgngacgcgtactttctccgtacgccccttaccgacgtcgtacggacggaccaacgcgaccctaggttacgacgtaattacggagggtactaacccgaggtaaccgaaggaacggacggaacggtctaggtaacttaacgttacgtacgtacaaacttcgaaacgcgaaacgaccgacgtaagtacgggttaacttaggtaggggtaaacgttacggttacggggacgggaacgggtaaccgtaaggggttaccggtaccggtacgttacgggaccgacgaacccggaacggtccgtaccgtcccccgtcggtacctccctcgtacccgttcccccg

SEQ ID NO: 421680 - DNA, 530 bp, Homo sapiens
  misc_feature: GZ8MTXP02IQSI0.51.37.D04.1.454.CMB.2.raw
  modified_base (260)..(260): a, c, t, g, unknown or other
  modified_base (316)..(316): a, c, t, g, unknown or other
  modified_base (320)..(320): a, c, t, g, unknown or other
  modified_base (328)..(328): a, c, t, g, unknown or other
  modified_base (337)..(337): a, c, t, g, unknown or other
  modified_base (342)..(342): a, c, t, g, unknown or other
  modified_base (347)..(347): a, c, t, g, unknown or other
  modified_base (351)..(351): a, c, t, g, unknown or other
  modified_base (364)..(364): a, c, t, g, unknown or other
  modified_base (377)..(377): a, c, t, g, unknown or other
  modified_base (394)..(394): a, c, t, g, unknown or other
  modified_base (398)..(398): a, c, t, g, unknown or other
  modified_base (406)..(406): a, c, t, g, unknown or other
  modified_base (494)..(494): a, c, t, g, unknown or other
tcagcgatcgtatacacgaccggtgctcgatttagtagcatactgttgagctctgggagaagagcccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggcaagcctggaggtccctgacgactctcctgtgcagcctntggattcaccttcagtgctactcatgagctggactccgcaggctcgaggggacggntgcnggtggtcncacatatgnctagnggganaccnattcacgcagctnagagaggctatcncatcacgagacacacanactnactgactntagacaaagtacgaaactacgtaactaacggaaccggacggtaaacggaccgtaaccggggtccgttacttaccttcgttgtaacggnggaggttcgggagggacggtaacggacgttaacggg

SEQ ID NO: 421681 - DNA, 610 bp, Homo sapiens
  misc_feature: GZ8MTXP02JFT6E.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagccgtgggacggtccctgagactctcctgtgcagcctcgtggattccaccttcagtggccttactcatgagctggactccgccaggcctccgaggggagggctgctaggtcggtctccactattagttagtgacgtaagtggggaacaaaccactattccgaacgcaagactcgtaggaaggtaacgggccctaatttcccacccattccccgtaccgaaacgggggaaccaaaccgggacctaaaacggtacccttcaacctttaggtaactccctaaggacctaaaagtcggaaaacctaggtaacaaggacgaccgtaaagaccgacgggtcttacgtaccttcgaggtgacgtaaggtggagggaacgacgggtactaacggg

SEQ ID NO: 421682 - DNA, 498 bp, Homo sapiens
  misc_feature: GZ8MTXP02HU3OO.51.37.D04.1.454.CMB.2.raw
  modified_base (263)..(263): a, c, t, g, unknown or other
  modified_base (342)..(342): a, c, t, g, unknown or other
  modified_base (354)..(354): a, c, t, g, unknown or other
  modified_base (375)..(375): a, c, t, g, unknown or other
  modified_base (391)..(391): a, c, t, g, unknown or other
  modified_base (397)..(397): a, c, t, g, unknown or other
  modified_base (415)..(415): a, c, t, g, unknown or other
  modified_base (422)..(422): a, c, t, g, unknown or other
  modified_base (424)..(424): a, c, t, g, unknown or other
  modified_base (430)..(430): a, c, t, g, unknown or other
  modified_base (432)..(432): a, c, t, g, unknown or other
  modified_base (434)..(434): a, c, t, g, unknown or other
  modified_base (436)..(436): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgttgggttttccttgttggctattatagaaggtgtccagtgtcaggtgcagctggtggaatcgtgggggagcttggcaagcctgggagggtccctgagactctcctgtgcagcctcnggattcaccttcagtgctacttcatgagctggactccgccaggcctccgagggagggctggcagtggctcacatatagnctaatggggaanaaccatacttcacgcagactntgtgaaggcctattcnccatcncgaggacagccaagactnactgtancngacaananananacaagacgacgacgacgacgacgtcgtactctgtgcgacgtggtaggacggacggacgtacg

SEQ ID NO: 421683 - DNA, 677 bp, Homo sapiens
  misc_feature: GZ8MTXP02JNX6N.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaggtgtccagtgtcaggtgcagcgtggtggaatcggtgggggagtcgttggtcaaggccgtgggacggtccctgacgactctccgtgtcgcacgcctcgtggtattccaccttcagtcggacttacttcatgagcgtggactccgccgaggccgtaccggaggggagggtctaggcgtaggtcgggtctaccgactattacgttagtgtacttaaggtcggggaactaaccgactacttcgtacgcacgtactcgtaggacggaacggtacccgtattcctacctacttcccgaaccgggaacgggaacccaaaccggaaccaaacggtaaacctccgttaacgttacggtaactttccgagaaacctaaagtaacgaaacgttacgtaacgtaaaacgacggaaccggtaaacgaccgtaccgggtaccgttacgttaccgtttccggagtcggtacggaagggttcgggaaagggggtacggtacggtaacccgtaacggggg

SEQ ID NO: 421684 - DNA, 516 bp, Homo sapiens
  misc_feature: GZ8MTXP02JF6J4.51.37.D04.1.454.CMB.2.raw
  modified_base (262)..(262): a, c, t, g, unknown or other
  modified_base (291)..(291): a, c, t, g, unknown or other
  modified_base (364)..(364): a, c, t, g, unknown or other
  modified_base (385)..(385): a, c, t, g, unknown or other
  modified_base (402)..(402): a, c, t, g, unknown or other
  modified_base (408)..(408): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttcctgttgctattatagaaggtgtccagtgtcaggtgcagctggtggaatcgtgggggagcttgggtcaagcctgggacgggtccctgagactctcctgtgcagcctntggattcaccttcagtggctactcatganctggactccgccaggctaccgaggggaggggctggcaggtggtctcgacattattagtgacttaagtgggganaaccatattccacgcagactntagagaacgggctatcnccatcncgaggacaacgccaagactcatgtatcagacaatcgacagtcaaagacacggaagaccgacggtccgtcgttaactctgtgcgaggtcggaggagacggtaacgtagg

SEQ ID NO: 421685 - DNA, 528 bp, Homo sapiens
  misc_feature: GZ8MTXP02JJ4JR.51.37.D04.1.454.CMB.2.raw
  modified_base (179)..(179): a, c, t, g, unknown or other
  modified_base (253)..(253): a, c, t, g, unknown or other
  modified_base (293)..(293): a, c, t, g, unknown or other
  modified_base (327)..(327): a, c, t, g, unknown or other
  modified_base (339)..(339): a, c, t, g, unknown or other
  modified_base (345)..(345): a, c, t, g, unknown or other
  modified_base (359)..(359): a, c, t, g, unknown or other
  modified_base (450)..(450): a, c, t, g, unknown or other
  modified_base (502)..(502): a, c, t, g, unknown or other
  modified_base (504)..(504): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagtcttgggttttccttgttgctattatagaaggtntccagtgtcaggtgcagctggtggaatcggtgggggagcttggcaagccgtgggacggtcccgagctctcctgngcagcctctggtattcaccttcagtggcttacttcatganctggactccgcaggctccgaggggaaggctgacngtggtctcaccntattgngtctaagtcggganaacctagattacacgacagactctgtaggaacgggccgtattcacctatcacgaagggacaacgtaccaaagaacctcgtaactgtactcngacaatagacagtacgtaagacgacgaacgacacgacgtcgttactctgtgngngtagtggagacgacgtacggacgg

SEQ ID NO: 421686 - DNA, 699 bp, Homo sapiens
  misc_feature: GZ8MTXP02JNUOJ.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagcgtggtggaatcgtgggggagtcgttggtcaagccgtgggacggtccctgagctctcctgtgcacgcctcgtggacttcctaccttcaggtcgaccttacttcatgagtctggactcccgcgaggcctacggaggggacggggctggcgtaggtcgggtcctaccactagttagttacgtgacgttaaagtcgggggaaactaacccactacgttaccgacgacgacgtaccgtcgtaaggaaacgggaacgggtcccttaactttccctacccgtaacgttcccgtaacccggaaacggggtaacccaaacccgggaaccctaaaagtaaccctccgtaacgttacggttactaccgtacgaaacctaaaagtacgaaaacgtacggtaacgaaaacggacggaacccgaaacggacccgtaccgggtacgttacgtaccgtttaccgtagggtccgtacggaacggtttggggaggtaacggtaacgggtacgttaacgggg

SEQ ID NO: 421687 - DNA, 593 bp, Homo sapiens
  misc_feature: GZ8MTXP02IXCK4.51.37.D04.1.454.CMB.2.raw
  modified_base (276)..(276): a, c, t, g, unknown or other
  modified_base (292)..(292): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggaggcttggtcaagccgtgggagggtccctgagactctcctgtgcagcctctggattcaccttnagtgctacttcatgancgtggactcccgccaggcctaccgaggggagggctgcgaggtggtctcacattattagtgacttaagtggggaacaaaccactacttcctaacgcaacgactcgtaggaacggaacgggcctaattcctaccctatcccgtaccgaacggggaaccaaaccggtaccgaaaacgaaccttacaccgttagtaacctcgtacgaactaaatacgaaactagtaccgaaagacgaccgaaagaccgacggcgttacgtacttcgtagtgacgtaggtcggtagggaacgacggaccgtaaggg

SEQ ID NO: 421688 - DNA, 683 bp, Homo sapiens
  misc_feature: GZ8MTXP02HUGIT.51.37.D04.1.454.CMB.2.raw
  modified_base (255)..(255): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagccgtgggacgggtccctgagctctcctgtncagcctctggattcaccttcagtgcttacttcatgagcgtggactcccgcaggcctaccggaggggaacggggctggccgtaggtcgggtctccgactattagttagtgtacttaagtggggaacaaacctactactttccgaacgcaagaccttcgtggtacggaacggggtccctaattttcccgaccctacttcccgtacccggaaacggggtaacccaaaacccggtacccaaaacggtaaacccttacgtaaccgttagtaacttccgtagaacctaaaagttcgaaaacgtacgttaaaccgaaaaggaacggaacccggaaacggtaacccgaccgggttacccgttacgttacctttcgaggtaacggtaccggtaggttacggggtacggggaacggtaacgggtaccggttaacgggg

SEQ ID NO: 421689 - DNA, 730 bp, Homo sapiens
  misc_feature: GZ8MTXP02FR95E.51.37.D04.1.454.CMB.2.raw
  modified_base (267)..(267): a, c, t, g, unknown or other
tcagcgatcgtatacacgaccggtgctcgatttagtagcatactgttgagctctgggagaagagccccagtcccagaattcccaggagtttccattcggtgatcagcactgaacacagagactcaccatggagtttgggctgagcttgggttttccttgttgctattatagaggtgtccagtgtcaggtgcagctggtggaatcggtgggggagcttggtcaagccgtgggacgggtccctgacgactctcgtgtgcagcctctggntcaccttcagtgctactcatgagtcgtggactcccgccgaggccgtaccggaaggggaacggggctggcgagggtcgggtcctaccgaactatagttagtcgaacttaaggtggggaacaacctactacttaccgacgcgtaatacgtcgtaaggaacggtaacggggtacctaacgtttccccacccgtaaacgttccccgaacccggaaaacgggggaacccaaaaccccgggaaacccaaaaacggtaaacccccgttactaaacccgttaacggttaccttaccgtaaagaaacccttaaaaggaacgtaaaaccgtacggttaaacgaaaacggaacccggaaaccggaaacgaccccggtaaaccggggtcccgtttacgttaaccccgttcgttaacggggtaacggtacgggtagggtacgggggtacggaaacggtaccgggtacggtaaccgg

SEQ ID NO: 421690 - DNA, 628 bp, Homo sapiens
  misc_feature: GZ8MTXP02FRUSK.51.37.D04.1.454.CMB.2.raw
  modified_base (379)..(379): a, c, t, g, unknown or other
  modified_base (455)..(455): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagccgtgggacggtccctgacgactctcctgtgcacgcctcgtggacttcaccttcagtcggtacctacttcatgagcgtggactcccgccagggcctaccggaagggggacggggctggcgtaggtcggggtcctaccgaactattagtttacggngaccttaaaggtcgggggaaacaacccgtaactacttaccacgtcagtacctgtaggtaggaacgggtctattccncctatccgaccgaaggacaaaccggaccaaagactcacgtgtactccgtagaactaaatcgaaactacgtacgaaaagaccggacgaaacgaccgaaaccgggtcgttacgttacttcgttacggaacggtacgtaggtacggggtaggggaaggaccgggtacgtaacgggg

SEQ ID NO: 421691 - DNA, 844 bp, Homo sapiens
  misc_feature: GZ8MTXP02JWAQ0.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcggtgggggagtcgttggtcaaggccgtgggacgggtccctgacgactctcctgtgcagcctgtggacttccaccttcagtggtctacttcatgatcgtggactcccgaccgaggtccgtaccggagggggaacggggtctggcgtagggtcgggtacctaccgaactattagttaggtgtaacgttaaaggtgggggaaacctaaacccgtaacttaacgtttccgaacggcgtaaacgtaccttaccggtaaggaaacggggtaaaccgggggtcccttaagtttacccctaccccgtaaacgttcccccggttaacccgggaaacgggggtaaaccccaaaaacccgggtacccgaaaaaaccgggttaaaccccgttcctaaacccgttacgggtttaaccttacccggtaaaggttaaaccccaaaaaggtttacggaaaacgttaaaccggtttaacgtaaaaaacggggaaccgggtaaaaccccgggtaaaacgggaaaccccggtaaccccgggggtacccggtttaaacggttttaccgtttccggttagggtaaccggggtcgggtaaaacggggttcgggggttaagggggaacggtaacgggggttaacccgggttaaaccggggg

SEQ ID NO: 421692 - DNA, 739 bp, Homo sapiens
  misc_feature: GZ8MTXP02I3N82.51.37.D04.1.454.CMB.2.raw
  modified_base (284)..(284): a, c, t, g, unknown or other
  modified_base (289)..(289): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggacggtccctgacgactctcctgtgcagcctctggattcaccttcagtgctactnatganctggactcccgccgaggctaccgaggggagggctggctaggtgggtcctcgactattattaggtcgacttaagtggggaacaaacccacgttacttaccgacggacaagtaccttacgtaggtacggaaacgggggtccctaagtttcccgtaccctaacgttccctaacccggaaacggggaaccaaaacccggaacccgtaaaacggtaaacccgttcgaaaccctttaggtaaccttcccgttaacggaaaccttaaaagttacgaaaacccgtaaggtttaaacccgtaaaacgggacccggaaacccggaaaacgggaaccccggtaaaacccggggttccggtttaccgttaaaacccgttttccgtaaggggtaaccggtaccggggtaaggtttacgggggtaagggggaaacggtacggggtaaaccggtttaaccggggg

SEQ ID NO: 421693 - DNA, 556 bp, Homo sapiens
  misc_feature: GZ8MTXP02GT7DK.51.37.D04.1.454.CMB.2.raw
  modified_base (259)..(259): a, c, t, g, unknown or other
  modified_base (437)..(437): a, c, t, g, unknown or other
  modified_base (443)..(443): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggcaagcctgggagggtccctgagactctcctgtgcagcctnggattcaccttcagtgctacttcatgagctggactccgcaggctcgaggggacgggctgacaggtggtctccgactattattagtgactaagtgggggaacaacccatacttcacggcagcctgagagtaacgggcctatcgcatcaccgaggacaaacgcaaagactgactgtaacncgtaanaacaaagtacgaaacgtacgtaacaaacggaacgaccgaaagtacccgacggtaccgttacgttaccttgtaggcgacggtaggtcgggacgggaaggtaacggtacgtacgg

SEQ ID NO: 421694 - DNA, 584 bp, Homo sapiens
  misc_feature: GZ8MTXP02JHJTI.51.37.D04.1.454.CMB.2.raw
  modified_base (294)..(294): a, c, t, g, unknown or other
  modified_base (367)..(367): a, c, t, g, unknown or other
  modified_base (385)..(385): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagctttggtcaagccgtgggagggtccctggagactctcctgtgcagcctgtggattccaccttcagtggctacttcatganctggactccgcaggctccgaggggaggctgcgaggtcggtctccacgtattatagtgacttaagtcggggaanaacccatacttctaacgntagacctgtagaggaacgggcctaattccaccgatcgacgacggacaaacgccaaagacctacacttgaacttcaagactaaaagtcgaaaaccagttaaccgaaaggacgaaccgaaacgacggaccggtacgttacgttacctcgtaggtccggacgtaaggggttcgggaggggacgtaggggtacgttaccgggg

SEQ ID NO: 421695 - DNA, 559 bp, Homo sapiens
  misc_feature: GZ8MTXP02FNHO6.51.37.D04.1.454.CMB.2.raw
  modified_base (350)..(350): a, c, t, g, unknown or other
  modified_base (370)..(370): a, c, t, g, unknown or other
  modified_base (378)..(378): a, c, t, g, unknown or other
  modified_base (457)..(457): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccctgagactctcctgtgcagcctctggattcaccttcagtggctacttcatgagctggactccgccaggcctccgaggggaacggggctgcaggtcgggtctccgacatattagngactaagtggggacaaccanattcacgnagactcgtaggggaacggccgtattcctaccattcctaccgaggggaacaaccgacgaaacgaacctcacttagtactntacgacaaatcggaaactagactaaagacgaccgaaagaccgaaccggtccgtacgtacttcgtgtagcgtagtcggtggggagacggtacgtacggtacgg

SEQ ID NO: 421696 - DNA, 644 bp, Homo sapiens
  misc_feature: GZ8MTXP02JES9F.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggacgggtccctggagactctcctgtgcagcctctggacttccaccttcagtgctacttcatgagcgtaggactcccgcaggcctccggaaggggacgggctgcgtaggtcgggtctaccgactagttacttagcgacttaagtgggggaaacaaacctacgtatttaccgaacggctacgaaccttcgtaggaaggaacggggacctattcccacctagtccctaacggacggaaccaaaccgaccaaaagtacctactacgtacgtactacgtagaactaaacgtacgaaacgtacgtaacgaaacggacgaaccgaaacgaacccggacgggtaccgttacgttaaccttcggtacggtaacggtacggtacgggttacgggaggggaacgtacgggtaaccggtaacgggg

SEQ ID NO: 421697 - DNA, 572 bp, Homo sapiens
  misc_feature: GZ8MTXP02ITL73.51.37.D04.1.454.CMB.2.raw
  modified_base (258)..(258): a, c, t, g, unknown or other
  modified_base (270)..(270): a, c, t, g, unknown or other
  modified_base (353)..(353): a, c, t, g, unknown or other
tcagcgatcgtatacacgaccggtgctcgatttagtagcatactgttgagctctgggagaagagcccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggaggtccctgagctctcctgtgcagcctnggattcaccttnagtgctactcagtgagctggactcccgccaggtccgtccgaaggggaggggctggcgaggtgggtcctccactattagttagngactaagtgggggaacaaccacgtatttccgacgctaagacctgtggtagaacggggcctattctccatcctaccgaggacaacgaccaaagacctcactgtactcgtagacaaagtacgaactagttacgaagaaccgaccggaaagccgaaaccggtcttacgtaccctttgtaggtcgacgtaggtgggtagggacggtacggtaaccgtaacggg

SEQ ID NO: 421698 - DNA, 611 bp, Homo sapiens
  misc_feature: GZ8MTXP02FGRFF.51.37.D04.1.454.CMB.2.raw
  modified_base (336)..(336): a, c, t, g, unknown or other
  modified_base (349)..(349): a, c, t, g, unknown or other
  modified_base (566)..(566): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaaggtgtccagtgtcaggtgcagctggtggaatcgtgggggagcttggtcaagccgtggagggtccctgagactctcctgtgcagcctctggatcaccttcagtggctacttcatgagctggactccgcaggcctaccggaggggacggggctgcgaggtcggtcnccactatattagngactaagtcggggaacaacctatattcacgcagactcgtaggaacggtaacgggctaagttctacccgtactaccgtccgacggaacgaaaccgaaccgaaacaacgtaccacgttacgtacgtaccttagactaaactacgtaaacgaacgtacgtaaacgtaacggaccggaaaaccgaacgaccggtaccggttccgttaaccgttcgttacgnggtacggacggtaggtagggtaacgggaacggtacggtaaaccgg

SEQ ID NO: 421699 - DNA, 644 bp, Homo sapiens
  misc_feature: GZ8MTXP02I6YP8.51.37.D04.1.454.CMB.2.raw
  modified_base (241)..(241): a, c, t, g, unknown or other
  modified_base (263)..(263): a, c, t, g, unknown or other
  modified_base (275)..(275): a, c, t, g, unknown or other
  modified_base (292)..(292): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagttgggctgagcttgggttttccttgttgctattatagaaggtgtccagtgtcaggtgcagctggtggaatcggtgggggagtcttggacaagccgtggacggtcccngacgctctcctgtcgcagcctntgcttcaccttnagtgcttacttcatganctggactcccgcaggcctcggaaggggacggctgcgaggtcggtcctccaactattagttagtgtaaccgttaaggtcggggaaacaacctagttacttccgaaacgctaagtacctgttaggacggaagggcctaattccaccgtatccgacgaacggaacctaaaccggccaaaagtacctctaacggtcttaaactcgtaacgaactaaacgtaacgaaacctaagggtacctaaaagggaccgaaccggaaaacgtacccgaacggggttaccctttagtaaccctttggaggtaaccggtaacggtaggtacggggtagggaaccgtaagggtaaccgtttacgggg

SEQ ID NO: 421700 - DNA, 635 bp, Homo sapiens
  misc_feature: GZ8MTXP02F3KR4.51.37.D04.1.454.CMB.2.raw
  modified_base (170)..(170): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattanagaaggtgtccagtgtcaggtgcagctggtggaatcggtgggggagtcttgggtcaagccgtgggacgggtccccgagacctctcctgtgcagccctgtggattccaccttcagtggctacttcatgacgtctggactccgccaggcctccggaggggaacgggctgcaggtgggtcctcaccgtatagttagtgactaaagtggggactaaccactactttaccacgtctaaaggactcgttagggtaggaaaccgggggtccctaactttcccaccctaacgtaccctaccggaacggggaaacccaaccggacccgtaaacgaaactacctacgttacggttaactcgtacacgtaaaattacgaaacgtagtaactaaacggacgaccggaaaaggaccgtaaccggcgttacgtccttagcggtagcggtagtaggtagggacgtaggacgtacgggtag

SEQ ID NO: 421701 - DNA, 858 bp, Homo sapiens
  misc_feature: GZ8MTXP02HFLIR.51.37.D04.1.454.CMB.2.raw
  modified_base (293)..(293): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcggtggggggagtcttgggtacaaggccgtgggacggggttcccctggacgtactctcctggtgcagcctcgtggacttcctaccttnaggtcgtcctacttcatggagcgtcggactcccgccgaggcctccggaagggggtagggcctggacgtaggtcgggtctaccgacgtattagtaggtcgtacgttaaggtcgggggaaactaaccctacgttaacttacccgaacggctaaacgtacgttacgtacggggttaagggaacccgggttacccgtaacgttttccccacccgaacgtttccccggaacccggtaagggggaaaccccaaaacccgggtacccgaaaaaccggtaacccttacggaaacctttacgggttaaaccttccggtaaacggtaaactaaaacgtttacggggaaaaacctttcgggggtttaaaacctaaaacgggggaaaacccgaaacccggggtaaaaggtaccccccggggtaaaaccggggtttccccgtttaaaacggttttacccggggtttaacccggttttaggggcccgggggttaaacggttacggggggtttacgggggtttaaaacgggggtaagggggaaaacccgggggtttaaaacccggggtttaaaccggggg

SEQ ID NO: 421702 - DNA, 650 bp, Homo sapiens
  misc_feature: GZ8MTXP02F1522.51.37.D04.1.454.CMB.2.raw
  modified_base (257)..(257): a, c, t, g, unknown or other
  modified_base (437)..(437): a, c, t, g, unknown or other
  modified_base (493)..(493): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttcctgttgctattatagaaggtgtccagtgtcaggtgcagctggtggaatcgtgggggagtcttgggtcaagccgtgggacgggtccctgacgctctcctgtncagcctcgtggacttcaccttcagtgctactcatgagctggactccgccgaggcctccggaggggagggctgcgtaggtggtccacgaactattagttagtgactaaggtggggaaacaacccactattacctacggcaacgtaacttcgtaggaaggtaacggggcccttaattccccncctacgttacccgtaccggaaacggggacccaaaaccggacccaaaaggtaacccncgtaccttaggtactccgtagacctaaaagtacgaaactacgtaacgtaaaacggacgaccggaaacggacccgaaccgggggttaccttaggtaccctttggtaggtggacggtagttcgggggtagggaacggtaacgggacccgtttaacgggg

SEQ ID NO: 421703 - DNA, 730 bp, Homo sapiens
  misc_feature: GZ8MTXP02HXFDY.51.37.D04.1.454.CMB.2.raw
tcagcgatcgtatacacgaccggtgctcgatttagtagcatactgttgagctctgggagaagagcccccagtcccagaattcccaggagtttccattcggtgatcagcactgaacacagaggactcaccatggagtttgggctgagctgggttttccttgttgctatatagaaggtgtccagtgtcaggtgcagctggtgaatcgtgggggagcttggcaagccgtgggagggtccctgagactctccgtgtgcagccctcgtgacttcaccttcagtggctacttcatgagtcgtggactcccggacacggcctccggaaggggaaacggggctggacgtagggtcgggtctacccgaatattataaggtgtacgtaaagtgggggaaacaaacctaactacgtttccaaccgctaaacgaacttccgtaggtagggaaaccgggggtcctaacttccttaccgaacttcccgtaacccgggaaggggaaacccaaaccggaaccctaaaaggaaacctttccaaacttaggtacttacgtacaaacctaaaagtagaaaacccgtagttaaaccgaaaaacgggcggaaaacccggaaagaacccgggtaaacccgggtcccgtttaacggtaaacccgttttttccgaaggggtttcgggttagggtaacggtttacgggggtaacgggggtaaacggaaacgggttaaaacccgggttaacggggg

SEQ ID NO: 421704 - DNA, 514 bp, Homo sapiens
  misc_feature: GZ8MTXP02FVE1K.51.37.D04.1.454.CMB.2.raw
  modified_base (334)..(334): a, c, t, g, unknown or other
  modified_base (347)..(347): a, c, t, g, unknown or other
  modified_base (376)..(376): a, c, t, g, unknown or other
  modified_base (405)..(405): a, c, t, g, unknown or other
  modified_base (432)..(432): a, c, t, g, unknown or other
  modified_base (445)..(445): a, c, t, g, unknown or other
  modified_base (447)..(447): a, c, t, g, unknown or other
  modified_base (449)..(449): a, c, t, g, unknown or other
  modified_base (451)..(451): a, c, t, g, unknown or other
  modified_base (453)..(453): a, c, t, g, unknown or other
  modified_base (455)..(455): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtggtttctgtgctattatagaggtgtccagtgtcaggtgcagctgggtggaatcgtgggggagcttgggtcaagcctgggacggtccctgagctctcctgtgcagcctcgtgattcaccttcagtggctactcatgagctggactccgccaggcctaccggaggggacgggctggcgaggtcggtcncactatattagtnactaagtggggacaaaccatattcaacgnaacgacttcgagaaggaacggctattccnccatcacgaggacaaacgcaaagactnactgtatcagaananananananagacgacgacgacgacgacgtacgtactctgtgcgtaggtaggaggaggacgacgtacg

SEQ ID NO: 421705 - DNA, 632 bp, Homo sapiens
  misc_feature: GZ8MTXP02GGW6K.51.37.D04.1.454.CMB.2.raw
  modified_base (260)..(260): a, c, t, g, unknown or other
  modified_base (269)..(269): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttcctgtgctattatagaggtgtccagtgtcaggtgcagctggtggaatcgtgggggagcttggtcaaggcctgggacggtccctgagtactctcctgtgcagcctngatcacttnagtgctactcagtgagtctggactccgaccaggtctaccggaaggggacggctggaccgtaggttcgggtactacccgtacgtattaacgtttcggacgtacttaaaggtgggggaaaaccaaccctaatactttaccgacggactaagaccttacgaggaacggaaccgggtcgttaagttcccaccctagtcccgtaccgaaggggaccctaaacggacctaaagaacctcacgtagtatccaggaacaaaagtgaacctagtaacgtaacgaacaccgtaaacgacgaccggtaccgttacgtacttcggtggtaacggtcggagggtttcggacgggaagaaccggtacgtaaccgggg

SEQ ID NO: 421706 - DNA, 642 bp, Homo sapiens
  misc_feature: GZ8MTXP02FKB7C.51.37.D04.1.454.CMB.2.raw
  modified_base (432)..(432): a, c, t, g, unknown or other
  modified_base (608)..(608): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaaggtgtccagtgtcaggtgcagctggtggaatcgtgggggagcttggtcaagcctgggagggtccctgagactctcctgtgcagcctctggattcaccttcagtggcttacttcatggagctggatcccgccaggcctccgaaggggacgggctaggcaggtgggtctacccgactagtatttagtgacgttaaagtgggggaacaaacccagtactttcacgcagtactcgtaggtaggaaacgggtcccgtaattcccncctaactcccgtaccggaacggggaacccaaaaccggccaaaagaaccctacgtaacccgttagttaactccgtacgaaacctaaaagtagaaaaccgtaggttaccaaaaagggtaccgaacccgggaaaagacccgaacgggtcccgttagttaacccttcgtaggtaaccggnggtaggtggggtagggacggacggtacgtacggg

SEQ ID NO: 421707 - DNA, 573 bp, Homo sapiens
  misc_feature: GZ8MTXP02I9300.51.37.D04.1.454.CMB.2.raw
  modified_base (257)..(257): a, c, t, g, unknown or other
  modified_base (365)..(365): a, c, t, g, unknown or other
  modified_base (543)..(543): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggcaagcctgggaggtccctgagctctcctgtgcagcctntggattcaccttcagtcgctacttcatgagctggactccgccaggcctaccggaggggacggggctggcgaggtcgggtctaccgactattagttagtgtacttaagngggggaacaaccctactattacctacgcacgactcgtaggaggaacgggcctacttcgtaccactccgtaccgagggaaccaaacgaccaaagacctacacttagtatctagacaaagtcgaactagtacgaaagacgaccgaaagaccgacggtcgttacgtacgttctggtaacgngtacggtggtacggaggacggacgtacggg

SEQ ID NO: 421708 - DNA, 640 bp, Homo sapiens
  misc_feature: GZ8MTXP02GP7NG.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaaggtgtccagtgtcaggtgcagctggtggaatcgtgggggagcttggtcaagcctggaggtccctgagactctctgtgcacgcctcgtggtacttcaccttcaggtgacttacttcatgagcgtggactcccgacgaggcctaccggaaggggacggggctggcgaggtcggtctaccgactattagttagcgtaacgtaaggtgggggaactaaacccgtactactttaccgacgacacgtaaccttcgtaggaacggaaacggggtccctatttccctacctaagttcccgtaccggaaacggggaaccaaacccggaccaaaacggtaacctcctaacgttggtactacgtacgaactaaagtacgaaacctagtacgtaaaggaccgacgaaacgaccggtacggacgttacgttaccttcgtagtcggacggtaggttcgggagggaacgacggtacgtacggg

SEQ ID NO: 421709 - DNA, 622 bp, Homo sapiens
  misc_feature: GZ8MTXP02HNS1V.51.37.D04.1.454.CMB.2.raw
  modified_base (261)..(261): a, c, t, g, unknown or other
  modified_base (292)..(292): a, c, t, g, unknown or other
  modified_base (365)..(365): a, c, t, g, unknown or other
  modified_base (591)..(591): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagtcttggtcaagccgtgggagggtcctgagctctcctgtgcagcctcnggtacttcaccttcagtggctacttcatgancgtggactccgccgaggcctaccggaggggaacggggtctggcgtaggtcgggtctcacgtattagttaagtntactaaggtggggaaacaaaccaactacttaccgtacgacgtacgactcgtaggacggaaaggggccctattccgtaccagttacccgacgaacgggaccaaaccggacccaaacgtacctactacgttacgtataccgtagaacctaaaatcgtaaacaggttaaacgtaacggaacggaacccgaaaagacgaacccgggtcgttacgtaaccttcgtagtcgngtacggttggagggtagacggtacgtacggg

SEQ ID NO: 421710 - DNA, 706 bp, Homo sapiens
  misc_feature: GZ8MTXP02ISDLO.51.37.D04.1.454.CMB.2.raw
  modified_base (252)..(252): a, c, t, g, unknown or other
  modified_base (255)..(255): a, c, t, g, unknown or other
  modified_base (260)..(260): a, c, t, g, unknown or other
  modified_base (271)..(271): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtacagctggtggatcgtgggggagcttggtcaagccgtgggacgggtccctgagctctctgngcngcctntgatcacttcngtgctacttcatgagtctggactcccgcgaggcctaccggaggggacggggctggacgtaggtcggtctacgaacctattattaggtcgtacttaaaggtagggacgtaaacccacgttaactttccgtacgacgaacgtactcgtaggaacggtaacggggtaccctactttacccgaccctacgttcccgtaacccggaacggggaaacccaaaccgaacccgtaaaacggtaccctaactaaccgtttacgttaactccgttaacggaaacctaaagttaacggaaaactacggttaaacgaaacgggaaccggaacccggaaaacggtacccggaccgggttaccgttacggtttaccgttcggttggtacggtcgggtagggttacggggtaggggaacgtaacggggtaacccgttacggggtaaccgg

SEQ ID NO: 421711 - DNA, 755 bp, Homo sapiens
  misc_feature: GZ8MTXP02GTJOA.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctgggtggaatcgtgggggagcgttggtcaagccgtgggacgggtccctgacgacctctcctgtgcagcctgtggtacttccaccttcgagtcggcttacttcagtgagcgtggactcccgccgaggcctaccggaggggaacggggctggcgtagggtcgggtccaccgactattacgttagtcgtacgttaaaggtcgggggaaacaaaccctacgttactttaccgaacggacaacggtaaccttcgtaagggaaacgggtaaacgggggtacccgttaacgtttaccctaccctaacgttacccgtaacccggaacggggaaaaccccaaaacccggaaccccgaaaacggtaacccttaccgtaaccgtttaggttaaaccttacccgtaagggaaacctaaaacgttacggaaaaccgttaggtaaaccgtaaaacgggaaccggaaccggaaaacggacccggtaaacccgggtccggttacgtaaccgtttcgtagggtcggtaccggtaggtacggggttaggggaaacggtacgggtaacggttaacgggg

SEQ ID NO: 421712 - DNA, 571 bp, Homo sapiens
  misc_feature: GZ8MTXP02HP1UF.51.37.D04.1.454.CMB.2.raw
  modified_base (192)..(192): a, c, t, g, unknown or other
  modified_base (263)..(263): a, c, t, g, unknown or other
  modified_base (277)..(277): a, c, t, g, unknown or other
  modified_base (355)..(355): a, c, t, g, unknown or other
  modified_base (456)..(456): a, c, t, g, unknown or other
  modified_base (477)..(477): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtncagctggtggaatcgtgggggagcttggtcaagcctgggacgggtccctgagactctcctgtgcagccctntggacttcaccttnagtgacttactcatgagctggactccgccaggctaccgaaggggagggctggcgaggtggtctcgaactatagttagngactaaagtggggaaacaaacactattcaacgcagtacctgaggaagaacggggcccaatttccaccaattccaccgagggaaccaaacgccaaagacctnactgaatcgtagaactaaaanagaacgagtaacgtaagaacgacgaacgaacgacggtaccgtacgtacgttcgtgtcgtacggacggtacggtaggacggacggtacggtacgg

SEQ ID NO: 421713 - DNA, 806 bp, Homo sapiens
  misc_feature: GZ8MTXP02JZ1ZN.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagtcgttgggttttccttgttgctattatagaaggtgtccagtgtcaggtgcagcgtggtaggaagtcgggtgggggaggtcgttggtacaaggccgtgggacggtccctgacgtctctcctgtcgcacgtcctctggtacttcctaccttcgagtgtctacttcatgacgcgtcggacgtcccgaccgacggccgtaccgggaagggggacggggtctcggcggtacgggtcgggttacctaccgtaacgttagttaagttacggtacgtaaccgttaaaggggttacgggggaaaccctaaacccgtaaaccgttcgtttaacccggtaacccggacgtaaaccgttacccgttaccggaaggggaaaccggggtaacccggggttacccttaactttccccgtaccctacgttaccccgtacccgggaaacgggaaaccctaaacccgaacgaaaacccgttaactaccgttaacttaacggttacctacgtaacggtaaaactaaaacgggtactaaaacgtacggttaaaccgaaaaggacccgggaaacccgtaacgggaccccgggttaaccggtaccggtttacgttaccgttggttaacgggcgggtaacggtagggtaggggtcggtaaacgggacggtacgggttaaccggg

SEQ ID NO: 421714 - DNA, 571 bp, Homo sapiens
  misc_feature: GZ8MTXP02GXJVJ.51.37.D04.1.454.CMB.2.raw
  modified_base (343)..(343): a, c, t, g, unknown or other
  modified_base (356)..(356): a, c, t, g, unknown or other
tcagcgatcgtatacacgaccggtgctcgatttagtagcatactgttgagctctgggagaagagccccagtcccagaattcccaggagtttccattaggtgatcagcactgaacacagaggactcaccatggagtttgggctgagctgggttttccttgttgctattatagaaggtgtccagtgtcaggtgcagctggtggaatcgtgggggagcttggtcaagcctgggacgggtccctaagctctcctgtgcagcctctggacttcaccttcagtggctactcatgagctggactccgcaggctccgaggggagggctgcaggtggtctcacgatattagngactaagtggganaaaccactattctacgcagacctctagaaggaacgggccgtaattccctaccacttcctaccggaaacgggaaccaaaccggaccaaaagtaacctaccgaactgtactccgtagaactaaacgtagaaactagtactaaaggacgaccgaaacgacacggtccgtactaccgttgtcgtagcgtagtcggtacggagacggtacgtacggtacg

SEQ ID NO: 421715 - DNA, 690 bp, Homo sapiens
  misc_feature: GZ8MTXP02IXQWL.51.37.D04.1.454.CMB.2.raw
  modified_base (251)..(251): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcctcactctctgcacaggctctgaggcctcctatgagctgacacagccagcctcggtgtcagtcgtccccaggacaggacggccaagactcccctgctcgtggagatgctagttcgaacctaaaacgttnttttgttcgtttttacggtaacctaaacgagaacgccgacggaccacggacccctaattaaacttaaattatataataaagacagtgagacgcctagaggactcccgtagacgcgtattcctcgtcgcccctaccgcgtctacgacggaacaacgcgacgtacgtacgagttacgttggtaggtacgacggagacgaaggaacgaggacgacgtacgtaacttacgttacagtactaaagtcgaacgacgtacgaacgtaacggtacggttagttacgttaagggtaggtaaacggttcggtaccggggaaggggtaaccggtaacgggtaacgggtaccggttaacccggtaggttaccggtacgtaaccgaccggttaacgccgttaccccgcccggtttacgaccgttaccttacccggttacccgtttacccccg

SEQ ID NO: 421716 - DNA, 715 bp, Homo sapiens
  misc_feature: GZ8MTXP02ILE4T.51.37.D04.1.454.CMB.2.raw
  modified_base (192)..(192): a, c, t, g, unknown or other
  modified_base (264)..(264): a, c, t, g, unknown or other
  modified_base (277)..(277): a, c, t, g, unknown or other
  modified_base (287)..(287): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtncagctggtggaatcgtgggggagtcgttggtcaagccgtgggacggtccctgagactctcctgtgcagcctnggacttcaccttnagtgctactnatgagcgtgactcccgcaggctccgaggggagggcctgccgtaggtcggtctacccaacgtagttagtttaacggtgtaacttaaaggtcgggggaaacaaacccgtactagtttaccgtacggactacggtaacttcgtacggaagggaaacgggccgtaatttacccgtccaacgttaccgtacccggaaggggaaacccaaacccgggaacctaaacggtaaacccttacacgttagttaaacctccgttaagaacctaaaagttcgaaaaccgtacggtttaaccgaaaaacggtccgaaaacccggtaaaaggaacccgtaacccggggttacccgttacggtttaaaccctttggttaccggtaaggaccggttagggttacgggtaacgggggtagtaacgggttaacgttaaaccggggg

SEQ ID NO: 421717 - DNA, 622 bp, Homo sapiens
  misc_feature: GZ8MTXP02I36I2.51.37.D04.1.454.CMB.2.raw
  modified_base (313)..(313): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctggagcttgggttttccttgttgcttattatagaaggtgtccagtgtcaggtgcagcgtggtggaatcgtgggggagtcttggtcaaggccgtgggacgggtccctgagactctcctgtgcagcctgtgattcaccttcgagtcgctacttcatgagtcgtggactccgacnggccgtccggaaggggacggggctggcgaggtggtctaccgactatacgttagtgactaaagtggggaaacaaccagtacttctaacgcaacgtactcgtgtacggaacgggcctattcgtccattcccacgacgggaaccaaccgaccaaacggtacctacacgttacgtacttcggacacgtaaacgtacaaaccgtagtaacgaaacgaacgggaacaaaacgggaccgaaccgggtccgtttacgttaccgttcgagttcggacggtaggttcggggagggtacggaacggttacgtaaccgggg

SEQ ID NO: 421718 - DNA, 699 bp, Homo sapiens
  misc_feature: GZ8MTXP02GZVR1.51.37.D04.1.454.CMB.2.raw
  modified_base (652)..(652): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttgggtcaagccgtgggacgggtccctgagctctcctgtgcagtcctctggattccaccttcagtcgctacttcatgagcgtggactccccgccaggtcctaccggaggggtaacggggttcacgaggtggggtacctcaccctatagttagtagaccgttaaagtggggacgaaaccaacgtaacttccgttaacgacgtaaacgtaccgttaccgttagggttacggaaacggggtacccggtaactttacccgttaccctaaaccgttccgttacccccgaacgggggaaaccaaacccgaaacccgaaacgaaaccgttacctacgttacgttaagtacctagaaccgtaaaactagaaaaccgtaagtagtaaacgaacggaacgaaccggaacgaccgggtaccgtcgttaacgttaccgtgttaccgggnggtacgggtacgggtacgggaacgggtacggtaacggtacggtacgg

SEQ ID NO: 421719 - DNA, 576 bp, Homo sapiens
  misc_feature: GZ8MTXP02I4BUG.51.37.D04.1.454.CMB.2.raw
  modified_base (257)..(257): a, c, t, g, unknown or other
  modified_base (285)..(285): a, c, t, g, unknown or other
  modified_base (359)..(359): a, c, t, g, unknown or other
  modified_base (413)..(413): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggcaagcctggaggtccctgagctctcctgtgcagcctnggattcaccttcagtgctacttcatganctggactcccgccaggcctaccggaggggaggggctggcgtaggtcgggtcctcactatattagtgacgtaagngggggaacaaccatattcacggcagtactcgtaggaaggaacgggcctattccnccatccgtacgagggaccaaaccggaccaaagaacctcgtacgtgttactccgtgaactaaagtacgaactagtacgaaagacgaccgaaagtccgacggtccgttacgttacctcgtaggtcgcggtaggtacggtaggggaacgtacggtacgttacgggg

SEQ ID NO: 421720 - DNA, 757 bp, Homo sapiens
  misc_feature: GZ8MTXP02IZ5G6.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagcgtggtggaatcggtgggggagtcgttggtacaaggccgtgggacgggtccctggacgtactctcctggtcgcacgccttcgtaggtacttcctaccttcgaggtcggtccttacttcaagtgacgtcgtggacctcccggaccgacggtccgtacccggaagggggacggggcttacggccgtagggttcgggtacctaccgtaacgtagtttaagttaggtcgtaaccgttaaaggtcgggggaaacctaaacctaacgttacgtttaccgaacgaccgtaacgtaccttcgtaacggaaacgggtaaccgggtaccctttacgttacccgtccctaagttaccccgtaacccggaaacgggaaacccgaaaccgaacccgtaaaacgaacccttacgtaaccttagttaaccctacgtacgaactaaaggtaaccgaaacgttacgtaacgaaaacggaccggaaccggaaacgaacccggacgggttacccgtagttaaccctttgggcggtaacggacggtaggtacggggaggggaacggtacggtaacggtacgg

SEQ ID NO: 421721 - DNA, 559 bp, Homo sapiens
  misc_feature: GZ8MTXP02ICA9O.51.37.D04.1.454.CMB.2.raw
  modified_base (372)..(372): a, c, t, g, unknown or other
  modified_base (377)..(377): a, c, t, g, unknown or other
  modified_base (386)..(386): a, c, t, g, unknown or other
  modified_base (393)..(393): a, c, t, g, unknown or other
  modified_base (407)..(407): a, c, t, g, unknown or other
  modified_base (413)..(413): a, c, t, g, unknown or other
  modified_base (442)..(442): a, c, t, g, unknown or other
  modified_base (454)..(454): a, c, t, g, unknown or other
  modified_base (510)..(510): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctgggtggaatcgtgggggagcttggtcaagcctgggacgggtccctgagactctcctgtcgcagcctctggattcaccttcagtggctacttcatgagcgtggactcccgccaggcctcgaggggaacggggctggcgaggtcggtctaccactattataggtgacttaagtggganaaccntattcacgnagctcgngagacggcattccncatccncgaggacacgtacaacgactcactgtacnctagacaagtanaaccagttacaaagcgaacccgaaggaccgtccggggtacttacggtacctttcgnggtggaccggtagggtcggtagggggacgtaacggtaccggtaacgggg

SEQ ID NO: 421722 - DNA, 617 bp, Homo sapiens
  misc_feature: GZ8MTXP02JV5B2.51.37.D04.1.454.CMB.2.raw
  modified_base (266)..(266): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggacgggtccctgagactctcctgtgcagcctcgtggnttccaccttcaggtggctacgttcatggagctggactcccgccgaggcctacccggagggggacggggctggcgtaggtcggggtctaccgacctattaattaggtgacttaagtcggggaacaaaccactagttacctacgcaagtacctcgtaggaagggaacggggccgtaattcccgaccctattcccgaccgaagggaacccaaacggtacccaaagaacctctaaccgtgtaactctaggaactaaaagcgaaacgtagtaacgaaggacggaaccgaacgtacgaccgtccgtagttacctgtcgtaagcggtagtaggtacgggacgaggtaccgtaacgggg

SEQ ID NO: 421723 - DNA, 603 bp, Homo sapiens
  misc_feature: GZ8MTXP02GP5JZ.51.37.D04.1.454.CMB.2.raw
  modified_base (260)..(260): a, c, t, g, unknown or other
  modified_base (345)..(345): a, c, t, g, unknown or other
  modified_base (359)..(359): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagcctnggattcaccttcagtcggctacttcatgagctggactcccgccgaggcctaccggaggggaacggggctggccgtaggtgggtcnccactatagttagngacttaagtggggaacaaccatattcacgcaagactcgtagaaggaacgggcctaatttccaccatccgtaccgaaggggaaccaaaccggacccaaaagtaacctcaaccgttagtataccgtagaactaaaagtacgaaactagtacgaaaagacgaacccggaaagaccgacgggtccgttacgttacttcgtacggtggtcggaaggttcgggagggaggaacgggtaccgttaacgggg

SEQ ID NO: 421724 - DNA, 665 bp, Homo sapiens
  misc_feature: GZ8MTXP02FKZ23.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagctctcctggtgcagcctctggtacttcaccttcagtgctacttcatgagctggactccgcaggcctccgaggggacggggctgcgaggtggtctccgactatattagtcgactaaagtgggggaaacaaccgtaactacgtttacctaacggcctaaagaaccttcgtacggaaaggtaacgggggcccgtactttaccctaccacttcccgaccggaaacgggaccaaaccggaccaaaacggtaccctaacgtacctagtaactacctaaactaaactcggaaaactagggtaactaaaagggacgtaacccggaaaacgtaccggaaacccgggtcccgttaacgttaccgttaccgtgggttacggaacgtaaggtcgggtaacgggggaggtaacggggtaccgtaacggggtaccgg

SEQ ID NO: 421725 - DNA, 788 bp, Homo sapiens
  misc_feature: GZ8MTXP02JXYRW.51.37.D04.1.454.CMB.2.raw
  modified_base (263)..(263): a, c, t, g, unknown or other
  modified_base (269)..(269): a, c, t, g, unknown or other
  modified_base (299)..(299): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagcgtggtggaatcggtgggggagcttggtcaagccgtgggacgggtccctgacgtactctcctgtcgcncgcctntgtacttccactcgagtgctacttcatgancgtggactcccgaccgaggccgtaccggaggggacggggctggcgtacggttcggggtcctacctactagttaagttaggtgtaaccgttaaaggacggggtaacaaaccctaacgttacttaccgtaccgacgtaaacgtccgttcgtaggtacgggaaccgggtcccttaacgtttccctacccgtacgttacccgtacccgggaacgggaaacccaaacggtaaaccccgtaaaacggtaaccccttcgaaccttttaacggtacctttacgaaacgttaactaaaaacgtaccggaaaacgttacggttaaaactaaaacccggaaccgggaaaacccgaaaacgggtaaccccggtaaacccggggttccggttaaccgtttacccgtttaagggtcgggttaacccggaagggtttacgggggttacgggggttaaacgggggaaacggggttaaaccggggtaaccggtttaaacccggggg

SEQ ID NO: 421726 - DNA, 518 bp, Homo sapiens
  misc_feature: GZ8MTXP02GJJI2.51.37.D04.1.454.CMB.2.raw
  modified_base (263)..(263): a, c, t, g, unknown or other
  modified_base (275)..(275): a, c, t, g, unknown or other
  modified_base (290)..(290): a, c, t, g, unknown or other
  modified_base (335)..(335): a, c, t, g, unknown or other
  modified_base (380)..(380): a, c, t, g, unknown or other
  modified_base (428)..(428): a, c, t, g, unknown or other
  modified_base (432)..(432): a, c, t, g, unknown or other
  modified_base (452)..(452): a, c, t, g, unknown or other
  modified_base (496)..(496): a, c, t, g, unknown or other
tcagcgatcgtatacacgaccggtgctcgatttagtagcatactgttgagctctggggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggagggtccctgagactctcctgtgcagcctgnggattcaccttnagtgctactcatganctggactccgcaggcaccgaggggaggctgcgaggtggtcaccanattatagtcgactaagtcggggaacaaccatattcacgcagactnagagacgggcctattccaccatccacgacggacaaccgacaaagactnactntatcagtacaaagtcgaaanagtacaagacgaccgaaagccgacggcgtagtacctgtgaacgngaggtggaggagcgacgtacgg

SEQ ID NO: 421727 - DNA, 691 bp, Homo sapiens
  misc_feature: GZ8MTXP02HA5BS.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctgggtggaatcggtgggggaggtcgtttgggtacaagccgtgggacgggtccctgagactctctgtgcagcctctggattcaccttcagtcggtactacttcagtgagccgtggactccccgccgaggcctaccggaagggggggacgggctgcgtaggtcgggtcactacgtattagtagtgactaaagtcgggggaaacaaaacgtactacgttctaacgcaacgtactcgtaaaggaacggtaaaccggggcttaacttcccgtaccgtaacttccgtaacccggaaacgggaaacccttaaaaccggacctaaaaaacggtaaccttcccgaaactttggtacttacccggaagaaacctaaaagaacgtaaccgtaagtaaacgaaacggaacgaaaccgtaaacggaccggtaccggttaccgttacgttacgttcgtacggtcggacggttaggtacgggtaacggacggtaaccggtaacggtacgg

SEQ ID NO: 421728 - DNA, 657 bp, Homo sapiens
  misc_feature: GZ8MTXP02IBH4F.51.37.D04.1.454.CMB.2.raw
  modified_base (191)..(191): a, c, t, g, unknown or other
  modified_base (257)..(257): a, c, t, g, unknown or other
  modified_base (267)..(267): a, c, t, g, unknown or other
  modified_base (296)..(296): a, c, t, g, unknown or other
  modified_base (311)..(311): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtncagctggtgaatcgtgggggagcttggtcaagcctgggacgggtccctgacgacgtctccctggtncgagcctcgnggacttcaccttcagtcggtcttaccttnagtgacgtcgtgacncccgaccgcggccgtacggaggggacggctggcgtaggtcggtcaccgtatattattagtataagacggacactatacttacacgactacactcgtagacggtacggcttactcctactacgtacgtaccgaacggtacaaccgtaaacaacgtacctactacgtacgttactacgtaacgaaactaaacgtaacgtaaacgtaacgtaacgtaaaacggaaaccggtaaaccggaaaccggtaaccggtaaccggtaccggttaccgttaccgtttacgttacggtacggtaacggtacggtacgggtacggggtaacgggtacgggtaccggtaacgggtacgg

SEQ ID NO: 421729 - DNA, 678 bp, Homo sapiens
  misc_feature: GZ8MTXP02FY68W.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtcagtgtcaggtgcagcgtgggtggaatcggtgggggagtcgttggcaagccgtgggacgggtccctgacgctctccgtgtgcagtcctcgtggacttcctaccttcgagttcggtacttacgttcagtgagtcgtaggactcccggaccgacggccgtacccggaagggggacgggcctcggacgtagggtcggtctaccgactagttattaggtgtacgtaaggtgggaaccaacctaacgtacttccgtaacgctaacgtaccttacggagaaacggggaacgggtccctaactttacccgcgtaacttacccgaccggaaacgggacccaaaacccgacctaaaaggtacccctcgtaacttaggtacttcccgagaaacctaaaagtacgaaacgtaagtaacgaaaggacccgaacgtaaacgaccggtaacgtcgttacgtaactcgaggccgtaggtggttagggacgggaagtaccgggtaacgttacggg

SEQ ID NO: 421730 - DNA, 752 bp, Homo sapiens
  misc_feature: GZ8MTXP02JPPIV.51.37.D04.1.454.CMB.2.raw
  modified_base (264)..(264): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagcgtggtggaatcggtggggggagcgttggtcaaggccgttgggacgggtccctgacgactctcctgtgcngcctcgtggacttccaccttcaggtggccttactcagtgagctggactcccgccgaggccgtccggaggggacgggctggcgaggtggtctccactattagttagtcgaacgttaaggtcggggaaacaaaccctacgtacttaccgtacgacacgtaccttcgtggtaacgggaacgggtcccgtaagtttccctacccgtacttaccccgtacccggaaacggggaacccaaaacccgggtacccaaaaacggtaaccccttaccgtaacgtttacgggtaaacttaccgttaacggaaaaccctaaaagttaccggaaaacccgttaggttaacccgaaaaaggaccggaaaacccgggtaaaacggtaacccggggaaacccgggttccgggtttaacgttacccgttttcggttcggaaggggtacccggtagggtttcggggaagggggtaaccggtacgggggtaaaccgtttaacggggg

SEQ ID NO: 421731 - DNA, 604 bp, Homo sapiens
  misc_feature: GZ8MTXP02IYCZJ.51.37.D04.1.454.CMB.2.raw
  modified_base (242)..(242): a, c, t, g, unknown or other
  modified_base (367)..(367): a, c, t, g, unknown or other
  modified_base (422)..(422): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcctcactctctgcacaggctctgaggcctcctatgagctgacacagccagcctcggtgtcagtgtccccaggacagacggccaagactcccctgctctggagatgcattgaccaaaacgtntttgtcttttttggtaaccaaacagaagccaggccaggcccctaataataattatataataaagacagtgagaggccctcagggactccctgagcgattctctggcctccagctcagggacaacngccacgttgacgtattaggtggagtccgaggcaagaagacgagctgactattacngtcaatcagcagacgacagtaggtacttagtggtaagttagttcggggacgggtaggggaaccgtaaggggttacgaacccggttaccgtaaacggggttccaacgggaccccgtaaagggccgttcccggtccccccgttacggggtccctaacccgtttccgttaccgggtttccccccg

SEQ ID NO: 421732 - DNA, 682 bp, Homo sapiens
  misc_feature: GZ8MTXP02F6H5J.51.37.D04.1.454.CMB.2.raw
  modified_base (362)..(362): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttggctgagcttgggttttccttgttgctattatagaaggtgtccagtgtcaggtgcagctggtggaatcgtgggggagtcgttggtcaagccgtgggacggtccctgacgtactctcctgtgcagcctcgtggacttcaccttcagtggctacttcatgagctggactccgccaggcctccggaggggacgggctgcgaggtggtcctacgactagtatttacggngtactaagtcggggaactaaaccacgttattccgtaacgcgtagtaacctcgtaggaaaggaacggggtcctaactttcccgacccaaccgtacccccgaaagggaacccaaccgtaacccgaaaactacctaccctatacggttactactacggtaaacaaaagttacggaaaacctgttaaacgaaaacggacgtaaacccgggaaaacaccgttacgttaaccggtccggtttaacgttacccgtttacgtggttaacggccgggttaaagggtcgggggtaacgggaaaggtacgggtaaccggtttaaccggggg

SEQ ID NO: 421733 - DNA, 782 bp, Homo sapiens
  misc_feature: GZ8MTXP02HKC1J.51.37.D04.1.454.CMB.2.raw
  modified_base (192)..(192): a, c, t, g, unknown or other
  modified_base (273)..(273): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtncagctggtggaatcgtgggggagtcttggtcaagccgtgggacgggttccctggacgacttctcctgtgcgacgtcctcgnggtacttccaccttcgaggtggtcttacttcagtggagcttggactccccgcgacggtcctaccggaaggggtaacgggctcggacgtaggtcggggttacctaccccgaacttaagtttacgttaaggtcggtaaaccgttaaagggtcgggggtaaaaccaaacccgtaacttaaccgtttaccgtaacccgacgtaacgaacctttcgaaggggaaacgtaaaccgggggacccttaactttcccgtacccgtaaacctttccccgtaaccggtaacggggaaaacccaaacccggtaaacccgaaaacggtaacccttaaccgtaacgtttacggttaacctacgttaacggaaacctaaaagtaacgaaaccgtaagtaacgtaaaacgggaccgaaccggaaaacggtacccgacccgggttaccgttacgttaaccttccggttaggtaaccgtaggttacgggttggaacggggtaacggacgggttaacgttaaccgggg

SEQ ID NO: 421734 - DNA, 749 bp, Homo sapiens
  misc_feature: GZ8MTXP02IGXXA.51.37.D04.1.454.CMB.2.raw
  modified_base (299)..(299): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcacatggagtttgggctgagtcttgggttttccttgttgctattatagaaggtgtccagtgtcaggtgcagctggtggaatcgtgggggagcgttggacaagccgtgggacgggtccctggacgtactctccgtgtcgcagtccttgtggacttcaccttcagtcggcttacttnacgttggactcgttcggactccccggaccgacgggtcctaccgggaaggggtaacggggcttaggaccgagggtttcgggtacttaccccgaacgtaatttagtttacggaggttaaccgttaagggacgggggaaactaaacccgtacgtttaactttacccgtaccggactaaacgggtacttccggtaggttacggaaacgggggtcccttaaacttccgttacccacgttaccgtacccgaaagggaacccaaaccggaaccccaaaggtaacctacgtaaccgtttagaccgttacgacgtaaacctaaagtacgtaaaacgtcgtttaaagaaacggaacgaccggtaaacgaccgtaccgggaccgtttgtaaaccgtttccgtgggtaacgtcggtagggttacgggtacgggaaacggtacggtaaccggtttaacggggg

SEQ ID NO: 421735 - DNA, 907 bp, Homo sapiens
  misc_feature: GZ8MTXP02F0LS0.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttggctgagcttgggttttccttgttgctattatagaggtgtccagtgtcaggtgcagcgtggtaggaatcggtgggggagtcgttgggtacaacggccgtgggacgggtccctaggacgtacctcgtccgtagtcgcacgtcccttcgtggtacttcctaccttcgaggttcggtaccttaccgttcaagtcggaacgtcgttacggtaccgtccccggacccgtacggggtccccgttaacccggggaaagggggggtaaacgggggtccctttaggggacccggtaggggtttccgggggttacctaccccgtaaaccttaagttttaacgtttaagggttacggttaaccgttaaaagggtacgggggtaaaccctaaaccccaacgttaacgtttcccggtaaacgaccgttaaacggttaacccttagggttaaacggggaaacggggtaaacccgggggtaccccttactttttaccccggacccttaacgttaccccggtaacccgggaaaacgggggtaaacccaaaaccggggttaaacctaaaacggaaaccccgttacctaaccggttttaaggtaaccttaacccgtaagaaaaccttaaagtaaaccggaacttaaacggttaacgaaaacggggaaaaccctaaccgggtaaaacgaaccccggggtaccggttccgggtttaactacccggtttagttgggaaccggtaggggtacggttagggggaagggtaacggtacggtaacggtaacgggg

SEQ ID NO: 421736 - DNA, 690 bp, Homo sapiens
  misc_feature: GZ8MTXP02F3XD6.51.37.D04.1.454.CMB.2.raw
  modified_base (261)..(261): a, c, t, g, unknown or other
  modified_base (274)..(274): a, c, t, g, unknown or other
  modified_base (290)..(290): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttgggtcaagcctgggacgggtccctgagctctcctgtgcagcctntggattcaccttnagtcgctactcatgancgtggactcccgccgaggcctaccggaggggacggggctggcgaggtcgggtctccgaactattattacggtgaccgttaaaggcgggggaaacaaaccccctataacttttacctaaccggactaacggtaacctcggttacggggtaacggaaacgggggtcccttaacgtttccctacctaaacgtcccgtaaccccgaaagggggtaaaccccaaaccggaacccaaaagtacccaccgtaacgttagtaacttaccgtagaactaaaaacgtacgaaaacgacgtaaccgtaaaaggaccggaaccggaaaacgaccgaaaccggggtccttacgttaaccttccgtaggttggcggtacggtacgggtaggggtaaggacggtaacggtaacgg

SEQ ID NO: 421737 - DNA, 583 bp, Homo sapiens
  misc_feature: GZ8MTXP02FNSVI.51.37.D04.1.454.CMB.2.raw
  modified_base (294)..(294): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagcgtggtggaatcgtgggggagcttggtcaagcctgggacgggtccctgacgactctcctgtgcagcctctggattccaccttcgagtgcttactcatgancgtggactcccgccaggcctacggaggggagggctgcgaggtggtctcactatattagtgactaagtggggaacaaccatagttcctacgacagtacctcgtaggtaggaaacggggccctaatttccacctatcccgacgacgggaaccaacggacccaaagacctctactgtactcgagtaacaaaattcgaaacagtacgtaaaagacggtacgaaagaccgcgggtaccttcgtaccttcgtaggtgtcggtaggtcggggtaggaaggacggacgttaacgggg

SEQ ID NO: 421738 - DNA, 710 bp, Homo sapiens
  misc_feature: GZ8MTXP02I4WRP.51.37.D04.1.454.CMB.2.raw
  modified_base (293)..(293): a, c, t, g, unknown or other
  modified_base (356)..(356): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcggtgggggagcgttggtacaaggccgtgggacgggtcccctaggacgtactcttccgtggtcgcacgtcctgtggacttccaccttnaggtcgccttacttcatggagtcgtaggactcccgcaggtccgtaccggagggggacgggtcnggacgtacgggtcggtacctacaactagtttacgttagtcgacttaaggtcggggaaactaaccctactacgttcgaacgcgaacggtaccctggtaagagggtaaaccgggtcccttaattccctaccacgtttacccgacccgggaaagggaacccaaaccggacccgaaaacggtacctacgtaacgttcggttaaacctgtaaccgaaataaacgtaacgaacgtaagttaacgaaaaggaccgacggtaaaacggcccggtaacggtccgtttacgttaacccgttggtaacgggttcgacgggttagggtacggggttaggggaaccaacgggggttacggtaacggg

SEQ ID NO: 421739 - DNA, 586 bp, Homo sapiens
  misc_feature: GZ8MTXP02JYCQL.51.37.D04.1.454.CMB.2.raw
  modified_base (261)..(261): a, c, t, g, unknown or other
  modified_base (291)..(291): a, c, t, g, unknown or other
  modified_base (349)..(349): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagccgtgggagggtccctgagactctcctgtgcagcctntggattcaccttcagtggctacttcatganctggatccgcaggctccgaggggagggctgcgtaggtcgggtctccactatacttagngacttaagtcggggaagtaaccacgtattcgtacgacaaggacctgtaggaacggtaacggggcccgtaatttcccaccacttcccgaccgacggggaaaccaaaccggtacccaaaggaacctcaccttggtaacctctagacctaaaagtcgaaacctagtaacaagacgaacccgagaccgacggcgttaactccttcgagtcgagagtggtagggacgacggtacctaacggg

SEQ ID NO: 421740 - DNA, 819 bp, Homo sapiens
  misc_feature: GZ8MTXP02IMDOZ.51.37.D04.1.454.CMB.2.raw
  modified_base (192)..(192): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtncagcgtggtaggaatcggtgggggagtcgttggtcaagccgtgggacgggtccctgacgtctctcctgtcgcacgcccttcgtggtactttcctacctttcgaacggttcggtacctttaacctttcaagtttcggaacggtccggttacgggaccgttccccggaccccgtaacggggtccccgtaccccgggaaaggggggtaacgggggtccttacggggaccgttaggggtcggggttacctacccgaacgttaagtttacgtttaggtcgtaaccgttaaagggttcgggggaaactaaaccctaacttaacgtttacccgtaccgactaacggtacctcgtaggtacggggaaccgggtccttactttcctccgtaacttcccgaacggaccgggaaccaaccggaaccaaagtaaccctacgtacttaggtactcgtaacgaactaaagtacggaaaactacggttaaacaaaacgggaccggaaacccgggaaaacgtacccgggtaaaccgggttacccgtttacggtttaaaccctttcggtagggtaaccgggtaacggttacgggggttacggggttaagggggaacggtaacggggttaaccggttaaccgggg

SEQ ID NO: 421741 - DNA, 658 bp, Homo sapiens
  misc_feature: GZ8MTXP02G8GV9.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagcgtggtggaatcggtggggggagtcgtttggtcaaggtccgtgggacgggtccctggacgtacctctccgtgtcgcacgcctctggacttccaccttcaggtcggtctacttcagtgagctggactcccgcgaggcctcggaaggggagggctggctaggtcgggtcacgtactatagtagtgactaaggtggggaactaacctactagtttccacggctacgtactcgtaggtaggaacgggaccgtattccgtaccacgtttttccaccggtacggaaccgaaccgaaccaaacgaacctactacgttacgtactacgtacgaactaaacgtaacgaacgtaacgttacgaaacggtaaacggaaaccggaaacggaccggtaaccggtaccggtacgttaccgttacgtacggtcggtacggtaggtacgggtagggacggtacgggtacgttaacggggg

SEQ ID NO: 421742 - DNA, 741 bp, Homo sapiens
  misc_feature: GZ8MTXP02IF8AK.51.37.D04.1.454.CMB.2.raw
  modified_base (264)..(264): a, c, t, g, unknown or other
  modified_base (270)..(270): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcacatggagtttgggctgagtcttgggttttccttgttgctattatagaaggtgtccagtgtcaggtgcagctgggtaggaatcggtgggggagtcgttggtacaagccgtgggacgggtccctggagcttctctgtgcncgcctntgacttctaccttgagtcgtcttactcagtgacgtcgtgactcccgacaggtccgtaccggaaggggacgggtctggccgtaggtcgggtactaccgaactagtagtttaggtgtaacgtaaggtcgggggaaactaaaccctacttacttaccgtaaccggacctaaacgggtaaccctttggaaggtacgggtaaacgggtcctaactttccaccgtacttaccgaccggaaacgggaacccaaaccggtaccaaaacgaccttaccgaattacggtaattaccacgaaaactaaacgtaacgaaaccgtagttaaaccgtaaaacggaccgtaaaccggtaaaaccggaacccgtaccggggttacccgtttaacgtttaacccgtttggacgggtaaccggttcgggtaaaacgggttcgggggaaacggggtaacggtaaaccggggtttaccgtaaaaccggggg

SEQ ID NO: 421743 - DNA, 766 bp, Homo sapiens
  misc_feature: GZ8MTXP02HVE94.51.37.D04.1.454.CMB.2.raw
  modified_base (307)..(307): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagtcttgggttttccttgttgctattatagaaggtgtccagtgtcaggtgcagctggtggaatcggtgggggaggtcgtttggtcgaagccgtgggacgggtcccgtgacgactcctcctgtcgcacgcctcgtggacttcaccttcagtggtcttaacctttntagtgcgtcgtcggaccgtcccgaccgacggtccgtaccggggaagggggacgggtcgtcggacggttaggtcggtacctaccgtacgtaacgtttagttaggtagtaacggttaacggtacgggaaactaaacgtaccttacgttaccgaccgtacgtaacgtaccgtacggaaagggtaacggggtaaccgggtacccttacgtttcccgaccgtaaccgttacccgaaccgggaaaccggaaacccgaaaccgtaaacccgaaacgttaaccttccgtaacgttagtaaccttacgaagtaaacgtaaacgtaacgtaaacgtacgtaaacgaaaacggtacccggaaaccggaacggaacccggtcgggttaaccgttacggttacgttcggtacggtaacggtcggttaaggggttcggggaacgggtaacgggtaaacgggttaccggtacgg

SEQ ID NO: 421744 - DNA, 735 bp, Homo sapiens
  misc_feature: GZ8MTXP02JGX3Z.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagccgtgggacgggtccctgacgactctcctgtgcagcctctggacttcacttcagtcgctactcatgagcgtggactccgccgaggcctaccggaaggggacggggctggacgtaggtcggggtacctcctaacgtaatttacgttaggtcgtaaccgttaaaggtgggggaaaccaaaccctacgtaacctttccgtaacggacctacgtaaccgttcgtaacggaaacgggaacggggtccctaagtttcccaccctaagttcccgtacccggaaacggggaaaccctaaacccggaacctaaaacggtaacccttaccgaaacgtttcggttaaactcctaacggtaaactaaaacgttaacgaaacgttaaacggttacgtaaaacggaccggaaccggaaaacggaccccgtacgggttacccgtttacgttaacccgtttccgtgggttaacggacggtaagggttcggggtaaggggaacggtaacgggtaacgttaaccgggg

SEQ ID NO: 421745 - DNA, 707 bp, Homo sapiens
  misc_feature: GZ8MTXP02IXG6Q.51.37.D04.1.454.CMB.2.raw
  modified_base (254)..(254): a, c, t, g, unknown or other
  modified_base (257)..(257): a, c, t, g, unknown or other
  modified_base (292)..(292): a, c, t, g, unknown or other
  modified_base (368)..(368): a, c, t, g, unknown or other
  modified_base (378)..(378): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggcaagccgtgggacgggtccctgagcctctcctgngcngcctgtgattcaccttcagtcgtctacttcatgancgtggactcccggccaggccgtaccggaaggggacggggtctggcgtaggtcgggtcctaccactattagttagtnaacgttaagnggggaacaaaccctactacgttccgaacgcaacgtactcgtaggaacgacggggccttacgttccaccctagttcccgacccggaacgggaaccaaacccggaaccctaaacgtaaaccttccgtaaaccgttagttaacccttacgtacgaaaccgttaaagtaacgtaaacccgtaagtaacgtaaaacggaaaccggtaccggaaaacggaccgtaaacccggggtccgtttacgttaacccgttttggtcggttaaggtaccgggttaagggttacggggtaagggggaaccggttaaacggggttaacccggtttaaacggggg

SEQ ID NO: 421746 - DNA, 795 bp, Homo sapiens
  misc_feature: GZ8MTXP02H5ZEW.51.37.D04.1.454.CMB.2.raw
tcagcgatcgtatacacgaccggtgctcgatttagtagcatactgttgagctctggggagaagagcccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggacaagccgtgggacgggtccctgacgactctcctgtcgcacgcctcgtggacttccacctttcagtcggacttacttcagtggagcgttggactccccggacgaggcctacccggaagggggaacgggggtctacgggccgtagggttcggggtctaccccctaaagtagtttaacgtttaaggtacggtaccgtttaaaagggtggggggaaaccaaaacccctaccgttaactttacctaacccggactaacgggtaccttcggttagggttacggggaaacgggtcccgtactttcccgaccgtaacttcccggaacccgaaacgggggaaaacctaaccccgggaaacccaaaaccggtaaacccttacgtaacccgttaggttaaccgtaccgttaaggaaacctaaaagtacgtaaaacccgtagtttaaaaccgtaaaacggcggaaaccccgggaaaagtaacccggacccgggttacccgtttacgtaacgttttccggaggttaacgtaccgggtaaggggttcgggttagggggaacggtacgggttaaacccgtacggggg

SEQ ID NO: 421747 - DNA, 694 bp, Homo sapiens
  misc_feature: GZ8MTXP02IO2MO.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaaggccgtgggacggtccctgacgactctcctggtcgcacggccttcgtggtattcctaccttacaggtcggtcctaacttcaagtgacgcgtggtactcccgaccgacggcctcccggaaggggaacgggtccgttagccgtagggtcggggttactacccgtaactagttagtttaggcgtaccgttaaagtacgggggacctaaaacccacgttaactttccgaacggacctagtaaccgtacgttacgggaaacggtaacgggggacccttatttcccacctacgttcccgtaaccgacggggaaccaaccggaccgaaaacgtacccactacgttagtaactcctagaactaaatacgaaacgtaccgtaagtaacggaacgacccggaaagacccggacggtaccgttacgttacctcggtacgcgtacggaggtcggtaggggacggtacggacgtttaacgggg

SEQ ID NO: 421748 - DNA, 570 bp, Homo sapiens
  misc_feature: GZ8MTXP02JOAYM.51.37.D04.1.454.CMB.2.raw
  modified_base (371)..(371): a, c, t, g, unknown or other
  modified_base (399)..(399): a, c, t, g, unknown or other
  modified_base (423)..(423): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagtcgttggtcaaggccgtgggacgggtccctgacgtactctccgtgtgcacgcctgtggattcaccttcaggtgcttactcatgagcgtggactcccgccgaggtccgtaccggaggggacggggctggcgtaggtcggtctacgactatagttagngactaagtgggaacactactatcgacgnacgtactgagaggacggctactcnccatccgacgaggaccaaccgacaaagtactcatagtactacgagaactaaatcggaaactagtacgaaaacgcgaacgaacgaccggtacggtcgttacgtacttcgtgaagcggtaaggtcggaggacggacggtacgtaacggg

SEQ ID NO: 421749 - DNA, 688 bp, Homo sapiens
  misc_feature: GZ8MTXP02GV845.51.37.D04.1.454.CMB.2.raw
  modified_base (577)..(577): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaggtgtccagtgtcaggtgcagcgtggtggaatcgtgggggagcttggtcaagccgtgggacgggtccctgagtacctctcctgcgcacgccttgtggtacttccaccttgaggtcggtccttacttcagtggacgtcgttacggactccccggacccgagggtcccgtaccgggaagggggaacggggtctcgggcgtagggtcggggttcctaaccgaactagtttagttacggtcgtacgttaaaggtacgggggaaccaaaaccctacgtactttaccgtaacgctaacgtactcgtaaggaagggaccggggtcccttattacctccacgttcccgaccggaacgggaacccaaaccgaaccgaaacgtaacctcgactttagtactctaacaactaaanacgaaccaggttacaaacggacgaccgaaggaacccgcggtaccgtttagttaccttgtacggtcgacggtaggttacggggagggacggtaacgggtacgttaaccgggg

SEQ ID NO: 421750 - DNA, 861 bp, Homo sapiens
  misc_feature: GZ8MTXP02G33DN.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagcgtggtggaatcggtgggggagtcttggtcaaggccgtgggacgggtccctaggacgtacctctccgtgtcgcacgtcctcgtggtacttcctaccttcgaggtcggccttacgtctagtggacgcgttacggaccttcccggaccgacgggtaccgtaccgggaagggggtaacggggtctcgggacgtagggtcggggtacctacccgaactagtttaacgtttacggtacgtaaccgttaaagggtcgggggaaaacctaaaccccgtaagttaacctttacccgaaaccggtaccgtaaaccgggttaccgttacggttacgggttaaacggggaaaccgggggttcccgttaactttaccccgtaaccccgtaacgtttaccccggtaaaccccggtaaaacgggggtaaacccctaaaacccgggaaacccctaaaaacgggttaaaccccttaccgtaaacgtttaacggttaacctaccgttaacggaaacctaaaataccgggtaaaacttaacggttaacgaaaacggaaccgggaacccggtaaaacgggcccgtaaacggggttcccgttaacggttaccgtttcggtaacgtcggtacggtaaacggggttcggggaacggggtaaggtaaccgggtaacggtttaaccgggg

SEQ ID NO: 421751 - DNA, 679 bp, Homo sapiens
  misc_feature: GZ8MTXP02JKXNN.51.37.D04.1.454.CMB.2.raw
  modified_base (267)..(267): a, c, t, g, unknown or other
  modified_base (328)..(328): a, c, t, g, unknown or other
  modified_base (343)..(343): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagtcttggtcaagccgtgggacgggtccctggagacctctcctgtcgcagcctnggattcaccttcagtgctactcatgagctggactccgcaggcctaccggaggggagggtcnggcgtaggtgggtcncactatacgttagtgactaaggtgggacgaaacctcgtatttaccgtacgcgtaagtacctgtagaacgggaacggggcccttaaattccgaccctacgttacccgtaccgggaacgggaaaccaaacccgggacctaaaaggtacccctacgaaccgttaggttaacctacgttacgaaaaccgtaaagttacggaaaccgtaaagggttaaccaaaacggaaccggtaacccggaaaggaacccggacccggggttccgttacgttaccttcggtaggtcggaacggttacggttacggggaaggggaggtaacgggaacggtttaacccgggg

SEQ ID NO: 421752 - DNA, 782 bp, Homo sapiens
  misc_feature: GZ8MTXP02HKMIE.51.37.D04.1.454.CMB.2.raw
  modified_base (350)..(350): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcggtgggggagcgttggtcaagccgtgggacgggtccctgacgctctcctgtcgcagcctctggattcaccttcagtcggctacttcagtgacgcgtggactcccgcaggcctccgaaggggacggggctgcgtaggtcggtacnccactattagttacgtgtaacgttaagtcgggggaacaaaacccacttaacgttaccgtaacgccgtaaacgtaccttcgtaggttaacgggaaaccggggcccgttaaactttcccgtacccttacgttccccgttaaacccggaacgggggaaaaccctaaacccggtaaaccccgaaaacgggtaaaccccgttacaacccgtttaggttaacttccgttaacgaaaccgtaaaagttacgaaaccggtaaacgtaccgtaaaacgggaaccggaaacccggggaaacgtaacccggaaaccgggggttacccgtttacggtttaaacccgtttcggtaacgggttaacggtaacccggggttaacggggttacgggggttaacgggggaaacgggtaaaccggggttaacgggtttaaaacccggggg

SEQ ID NO: 421753 - DNA, 758 bp, Homo sapiens
  misc_feature: GZ8MTXP02ISI3D.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtaggaatcggtgggggagtcgttggtcaagccgtgggacggtccctgacgtctctccgtgtcgcacgccctcgtggacttccaccttcgagtcggtaccttacttcatggatcgtggactcccgccagggcctaccggaagggggacgggctcggcgtaggtcgggtacctccgaactagttacttaggtcgtaacgttaaggtcgggggaaaactaaacccgtactacgtttaccgaacgacgtaacggtaccttcggtaggaaacggggtacggggtacccttaagtttccctaccgtacgtttacccgaaccgggaccggggaaaaccaaacccggaaacccgtaaaacgtaaccttaccctaaagttcggtaaacttcccgtaagtaaacccgtaaaagtaccggtaaaaccgtaacgtttaaacgaaaaccgggacggaaacccggtaaacggacccgtaaaccgggtccgttacgttaccttcggtaggtaacgggttacggaagggggtttcggaagggggtacggtaacgggtttaaccccggtaacgggg

SEQ ID NO: 421754 - DNA, 656 bp, Homo sapiens
  misc_feature: GZ8MTXP02JQUOQ.51.37.D04.1.454.CMB.2.raw
  modified_base (616)..(616): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctgggtggaatcgtgggggagcttgggtcaagccgtgggacggtccctgacgactctcctgtcgcagcctgtggtacttccaccttcgaggtcggtcctacttcatgagtctggactccgccaggcctcgaaggggacgggctaggcgtaggtcggtctacccgatagttaagttacgtgtaccttaagtcgggggaaacaaacctacgtaacttcgtaaccgacaacgtactcgtaggaaacggaacggggtacctaatttcccgtaccactttccgaaccgtaacggggaaacctaaaccggacccaaaacggtacctctaaacgttcgtaaacgttcctaaggaactaaagtacggaaactacgtaacgaaacggacgaccggtaaacgaccgtacggggtaccttacgtacgttacgnggtgacgttaggtcgggaggacggtacggtaactacgggg

SEQ ID NO: 421755 - DNA, 589 bp, Homo sapiens
  misc_feature: GZ8MTXP02G3NPS.51.37.D04.1.454.CMB.2.raw
  modified_base (260)..(260): a, c, t, g, unknown or other
  modified_base (268)..(268): a, c, t, g, unknown or other
  modified_base (289)..(289): a, c, t, g, unknown or other
  modified_base (347)..(347): a, c, t, g, unknown or other
  modified_base (363)..(363): a, c, t, g, unknown or other
  modified_base (557)..(557): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggaggtccctgagactctcctgtgcagccctntggattcnccttcagtgctacttcatganctggactccgccaggctccggaggggagggctgcaggtcggtctcacgtatagttagngactaagtgggggaanaacctaactagttcctaacgctacgacctacgttggagaacggggcctaacgttcctacccgacttccgaccgacggggaaccaacccggacccaaaagtacctacacttacggtactacctacgaactaaatacggtaaaccagtacgtaaacgaggaccccgaaagaccgacggtccgtagtactcgtaggngacgaggtcggtaggacggtacggtacggtag

SEQ ID NO: 421756 - DNA, 795 bp, Homo sapiens
  misc_feature: GZ8MTXP02IVKDS.51.37.D04.1.454.CMB.2.raw
  modified_base (285)..(285): a, c, t, g, unknown or other
  modified_base (300)..(300): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgcttattatagaaggtgtccagtgtcaggtgcagctggtggaatcggtgggggagcgttggtcgaacggccgtgggacgggtccctgacgactctctgtcgcagcctcgtggacttcaccttnagtgctacttcatgncgtggactcccgacgacggcctacggaaggggacggggcttggcgtagggttcgggtcctaccgtactaagttacgtttaggacgtacgtaaagggtcgggggaaactaaacccctaaacgttactttacccgtaaccggctaaaccgggttacccttacgttacgggtacggggtaaacgggggtaccccgttaactttcccgtacccccgtagttaccccgttacccgggaaaacgggggtaaccccaaaaccgggttacccccaaaaaggtaaccccttaccggacctttagtaacttaccgtaggaaacctaaagtaaccggaaaccttaaggtaactaaaacggggtaaccggtaaccccggtaaaacggaccccggttaaccgggtacccggtttaggtttaaacccgttcgggtttacgggtaaggacccggggtttaagttacggggggtaggggtaacgggtaaaccggggtacgttaaccggggg

SEQ ID NO: 421757 - DNA, 759 bp, Homo sapiens
  misc_feature: GZ8MTXP02I8XCE.51.37.D04.1.454.CMB.2.raw
  modified_base (343)..(343): a, c, t, g, unknown or other
  modified_base (365)..(365): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcacatggagtttgggctgagcttgggttttccttgttgctattatagaaggtgtccagtgtcaggtgcagctgggtggaatcggtgggggagtcgttggcaagccgtgggacggtccctgagctctcctggtcgcagcctgtggcttcaccttcagtgctactcatgagctggactccgcgacggctccggaggggagggtctgacgtaggtcgggtcncactatataggtcaacgttagngggggaacaaaccctagtactttaccgacgacgtacgtaccgttcgaggaacggaccgggggtacctaacggtttcctaccctaacgttacccgtaaccgggaaaccgggaaacccgaaaccggaaaccccgaaaacggtaaccccttacggaaaccctttacgggttaacgtaccttaacgggaaacctaaaacgttaacggaaaacgtaaacggttaaaaccgtaaacggtaaaaccggacccggaaaaccggtaaacccgggtacccggggtaacccggggttactttaaccggtttccggtaacccggggttaacgggacgggtttaacgggtacgggggtttaacgggggaaaacggtaccgggggttaaaccgggttaaacccggggg

SEQ ID NO: 421758 - DNA, 719 bp, Homo sapiens
  misc_feature: GZ8MTXP02INYWT.51.37.D04.1.454.CMB.2.raw
  modified_base (264)..(264): a, c, t, g, unknown or other
  modified_base (276)..(276): a, c, t, g, unknown or other
  modified_base (355)..(355): a, c, t, g, unknown or other
  modified_base (373)..(373): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcggtgggggagtcttggtcaaggcctgggacggtccctgagctctcctgtgcagcctcngattccaccttnagtgctacttcatgagctggactccgcgaggcctaccggaggggagggtctggcgtaggtggtctcaactattattagntacgttaagtcggggaanaaacccgactactttaccgacgactacggtaccttcgtaggtacgggaaaccggggtccttaacttttcccgacccgttagttaccccgtaacccgggaaacggggaacccaaaaacccggtacccgaaaaggtaacccctttacaaccgtttaggttaccttaccgtaggaaaccttaaaagttaccggaaaactacgggttaaacgtaaaacgaccggaaaccgtaaacggtaaaacccgccgggggttaccccgtttagggtttacccctttcggttgggaaccggtcggttagggtttacgggggtaggggaacggtaacgggtaaaccggtttaccggggg

SEQ ID NO: 421759 - DNA, 694 bp, Homo sapiens
  misc_feature: GZ8MTXP02GBF97.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcggtgggggagtcttggtcaagccgtgggacgggtccctgacgtactctccgtgtcgcacgcctcgtggtattccaccttagagtggtccttacgttcagtcgagcgtggactcccggaccaggcctaccggaggggaacgggctggcaggtcgggtctaccactattagtagtgacgtaagtggggaaaccaacctacgtacttaccgacggcaaacgtctacggttcgacgggtacggggtacctactttacccgcccgtaagtcccctaaccggaacgggaacccaaaccggtacccaaaggtaacccttcgaaccttaggtacttacgacgaaacctaaagtaccggaaactacggtactaaaacggcggaaccgaaacggacccggtaaccgggtccgttacggttaaccttccggtcggtaaaggccgggttaaaggtcgggggttaacgggaagggttaaccgggacgtttaaacccggggg

SEQ ID NO: 421760 - DNA, 630 bp, Homo sapiens
  misc_feature: GZ8MTXP02I4K7E.51.37.D04.1.454.CMB.2.raw
  modified_base (296)..(296): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagcgtggtggaatcggtgggggagtcttggtcaagccgtgggacggtccctgacgtactctcctgtcgcagcctgtggacttcacttcagtgctactcatgancgtggactccgcaggctaccggaggggacggggctcggcgtaggtcgggtcctacccgaacgtatttagttacggtgtaccgttaaagtgggggaaaccaaacccgtacttacgttaccgtaacgcgaacgtacttaccgtaggaacgggaacggggtccctaatttccctaccgactttccgacccgaaggggaccaaaccggttaccaaaggtacctcacgtacgttaactcgagtaccaaagtagaacctaggtacaaggacgacgaaagccgaacggtccgtagtaccttgtaggcgacggtagttcgggaggacgacggtacgtacggg

SEQ ID NO: 421761 - DNA, 627 bp, Homo sapiens
  misc_feature: GZ8MTXP02HZHHP.51.37.D04.1.454.CMB.2.raw
  modified_base (265)..(265): a, c, t, g, unknown or other
  modified_base (301)..(301): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctgggtaggaatcgtgggggagtctttgggtcaagtccgtagggacgggtccctgacgtactctcctgtncagcctcgtggattcacttcagtcgctactcatganctgactccgcaggctaccggaggggaggctggcgtaggtggtctcgaactattagttagtgtacgttaaagtcggggaaacaaacctacgtactttaccgacgctacgtactcgttaggacgaacggggtcctatttccacctagtcaccgaggaaccaaacgccaaagacctcaacttgaactcgtagaactaaagacgaacctaagtacgtaaaaggcgaaccgggtaaaagaccgtaaacggggtcctttacgtaacccgttttcgagggtccgtacggtaggggtttaggacggggacggtaacggttaccggtaaccgggg

SEQ ID NO: 421762 - DNA, 622 bp, Homo sapiens
  misc_feature: GZ8MTXP02FXLKV.51.37.D04.1.454.CMB.2.raw
  modified_base (258)..(258): a, c, t, g, unknown or other
  modified_base (269)..(269): a, c, t, g, unknown or other
  modified_base (284)..(284): a, c, t, g, unknown or other
  modified_base (335)..(335): a, c, t, g, unknown or other
  modified_base (486)..(486): a, c, t, g, unknown or other
  modified_base (501)..(501): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaagtgtccagtgtcaggtgcagctggtggaatcgtgggggagtcttggtcaagcctggacgggtccctgagctctcctgtgcagcctntgatcaccttnagtgctactcatgancgtgactccgacctaggctccggaaggggacgggctggactaggtcggtcnccgaactagttattacggtgacttaaagggtcggggaacaaacccaactacttttccaacggtacaagtaacctcggtagaacgggaaacgggcttaacttctacccaattcccgacgacggggaacctaaaccgacccaaaagttacccnccgtatcggttaacnccgtagaacctaaagtacgaaactagttacaaggaccgaaccggaaagaccgacggtcccgttagttaacctgtagtaacgacggtaggttacggagggggataacgggtaccgtaacggg

SEQ ID NO: 421763 - DNA, 697 bp, Homo sapiens
  misc_feature: GZ8MTXP02JWUBN.51.37.D04.1.454.CMB.2.raw
  modified_base (190)..(190): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaaggtgtccagtgtcaggtncagctggtggaatcgtgggggagcttggtcaaggcctgggacgggtccctgagactctcctgtcgcagcctcgtggacttcgaccttcaggtcgacttacttcagtggactcgttaggacctccggaccgaggtcctacccgggaaggggacggggtctaggacgtgggtcggtacctaccgtactagttacgtttaggacgtacttaaaggtcggggaaacctaacctaacgttacttaccgacggtacaaaacgttccgtaggtaaggaacggggtaaccgggtccgttaaactttcccgaacctaccgtaccgtaacccggaaagggaacccaaaacggttccccaaaaggtccctacacggttagtttaaccacgttaagaacgtaacgtaacgtaacgtaacgtaacgtaacgaacggaacgaacgacgtaccggtacggtacgttacgttacgtcggtaacggtacggtacggtaggtaggtacggtacggtacggtacgg

SEQ ID NO: 421764 - DNA, 550 bp, Homo sapiens
  misc_feature: GZ8MTXP02I7OL8.51.37.D04.1.454.CMB.2.raw
  modified_base (327)..(327): a, c, t, g, unknown or other
  modified_base (350)..(350): a, c, t, g, unknown or other
  modified_base (364)..(364): a, c, t, g, unknown or other
  modified_base (383)..(383): a, c, t, g, unknown or other
  modified_base (401)..(401): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagtcttggtcaagccgtgggacgggtccctgacgactctcctgtgcagcctctgcttcaccttcagtggcttacttcatgagctggactccgcaggctcgaggggaggggctgnaggtggtctccgacatattagtnactaagtggggaanaccatatctacgcagactnagagagggcctatccacntccacgaggaccaaacgccaaagacctcacttgtactctagaactaaagtcgaactagtactaaaggacgaccgaaagaccgtacgggacgttacgttacttcgtcgtaaggacgtaggtcgggtagggaaggacgaccgttaacgggg

SEQ ID NO: 421765 - DNA, 734 bp, Homo sapiens
  misc_feature: GZ8MTXP02INPVY.51.37.D04.1.454.CMB.2.raw
  modified_base (261)..(261): a, c, t, g, unknown or other
  modified_base (279)..(279): a, c, t, g, unknown or other
tcagcgatcgtatacacgaccggtgctcgatttagtagcatactgttgagctctgggagaagagcccccagtcccagaattcccaggagtttccattcggtgatcagcactgaacacagaggactcaccatggagtttgggctgagcgttgggttttccttgttgctattatagaaggtgtccagtgtcaggtgcagctgggtggaatcgtgggggagtcttggcaagccgtgggacggtccctgagactctcctgtcgcngcctgtggattcaccttnagtgctactcatgagctggactcccgccgaggtccgtccggaaggggacggggtctcggcgtaggtcggggttcctaccgaacctagtttaagtttaggtacgtaaccgttaaaggtacgggggtaaactaaacccgtaaccttaacgtttaccccgtaacggacctaaacggtaccttcggtaacgggaacgggtaaacggggcccgttaaactttccctaccctacgttcccgtacccggaaacggggaaaccaaacccggaacccgtaaaacgtaaacccttaccgtaaccttaggttaacctcgttaacggaactaaagtaacgaaacgtaacgtacgtaaaacggaacgaaaccggaaacgaaacccggtaaccgggtccgttacgtttaaccgtttcggtaggtcggacggtagggttacgggtaggggaaggtacggtaacgttaggg

SEQ ID NO: 421766 - DNA, 660 bp, Homo sapiens
  misc_feature: GZ8MTXP02ISPQ9.51.37.D04.1.454.CMB.2.raw
  modified_base (283)..(283): a, c, t, g, unknown or other
  modified_base (293)..(293): a, c, t, g, unknown or other
  modified_base (344)..(344): a, c, t, g, unknown or other
  modified_base (487)..(487): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatctgggggagcttggtcaagcctggaggtccctgagactctccgtgtgcagcctctggattcacttcagtcgactacttnatgagctggntccgccaggcaccgaggggacgggctgcgtagtgggtctcacgatattagngactaagtgggggaacaaccactagtttccaacgctaagacttcgtaggaggaaacggggccctaagttcctaccctacttaccgtacccgagggggaaacccaaacggccccaaaaggtaacccttctaacctggttaaccncgttacgaactaaaacggttgaaaacctggttaaaccgtaaaggaaccggaccggaaaacgtacccggaaaccggggtaccccgtttgggttaaaccctttcggaggttaacggtaccggggtaaggttccgggttaagggggaacgtaacggggttaacccggtaaacgggg

SEQ ID NO: 421767 - DNA, 640 bp, Homo sapiens
  misc_feature: GZ8MTXP02GPBCS.51.37.D04.1.454.CMB.2.raw
  modified_base (275)..(275): a, c, t, g, unknown or other
  modified_base (323)..(323): a, c, t, g, unknown or other
  modified_base (357)..(357): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagcgtggtggaagtcgtgggggaggcgttgggtacaaggccgtgggacgggtccctgacgacctctccgtgtgcacgcctcgnggtcttctaccttcaggtcgcttacttcatgagcgtggactcccgcgnggccgtaccgaggggagggctgcgtaggtggtcnccacattattagagtacgtaagtcggggaacaacctacgtacgtttccgaacgacgtaacgtacctcgtaggaacgtaacggggcctaacgtttccacctattacccgacgacgggaaccaaccgaccaaacgtctacacgttgtactcgtacgaacaagtaacaagtagtacgaaacggacgacccgaaaggcccgaaccgggtacgttacgttaacccgttgtacggtcgggtaacgtagggttacggggaggaacgggtaacggtaccggttaaacgggg

SEQ ID NO: 421768 - DNA, 709 bp, Homo sapiens
  misc_feature: GZ8MTXP02FH0FP.51.37.D04.1.454.CMB.2.raw
tcagcgatcgtatacacgaccggtgctcgatttagtagcatactgttgagctctgggagaagagccccagtccccagaattcccaggagtttccattcggtgatcagcactgaacacagaggactcaccatggagtttgggctgagcttgggttttccttgttgctattatagaaggtgtccagtgtcaggtgcagctggtggaatcgtggggggagtcttgggtacaaagtccgtagggacgggttccctggaacgtacctctccgtgtcgcacgcctcgtcggtattcctaccttcaggtgtacctacttcagtgagcgtaggactccgaccgaggtcctaccggaaggggacggggctggcgaggtcggtctacccgaactatagttaggtcgacgttaaggtcgggggaaacaaaccctaactacttaccctaacggactaagtaccgtacgttaggtacgggtaaacgggcccgttaactttccgaccctagttacccgtaccgaaacggggaaccaaaaccggaccaaagtaccctcgtaaccgttagtaacttcgaagaactaaaagtacgaaaacgtaacgttaacgaaaacggaccggaaccggaaaacgtaccggaccggggttaccttacggttaccttcggttagtcggacggtaggtacgggtagggggaaggtacgggtaacggttaaaccgggg

SEQ ID NO: 421769 - DNA, 813 bp, Homo sapiens
  misc_feature: GZ8MTXP02JNNHE.51.37.D04.1.454.CMB.2.raw
  modified_base (288)..(288): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagccgtgggacggtccctgagctctccgtgtgcagcctctggattcacttcagtgctactcatganctggactcccgacgaggccgtaccggaaggggaacggggcttaggcctaggttcggggtctccgactattagttagtcgacgttaagtcgggggaaacaacccgtactacgtttacaccggactaacgtacccgttgttaggttacgggaaaaccgggggtcccttaaacgtttcccgtccccgtaattttacccccgaacccgggaaaccgggggtaaacccaaaaaccccgggtacccccgaaaaacgggttaaaccccctttaccgaaacccttttacggttaaaaccttcccggttaaaggtaaaccccaaaaagtttaccggggaaaaacccctaaaggggtttaacccgtaaaaagggtaaccggaaaccccgggttaaaacggtaaaccccgggaaccccgggggtttcccgtttaccgggtttaaacccgtttttaccggccgggtttaaagggcccggtaaaggggttcggggtaagggggttaccggaaaagggggtaccgtttaaacccggggg

SEQ ID NO: 421770 - DNA, 729 bp, Homo sapiens
  misc_feature: GZ8MTXP02FKN3U.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggacgggtccctgagactctcctgtgcagtcctgtggacttcaccttcagtgcttacttcatgagcgtggactcccgcaggccgtccgaagggggacggggctggacgtaggtcgggtctccgacgtatattaggtgaccgttaaagtcggggaacaaacccattactttccgaaaggcctaaaggtaccttcgtaggaaacggtaaacggggtcccttaaatttcccgacctaaattccccgtaacccgaaagggggaacccaaaaccggacccgtaaaaggaacccttaccgaacctttaggtaacttcccgtagaaacaaaacgttaggaaaccctaagtttaccgaaaacggacgaaacccccggtaaaaggtacccggaaaccccggggttacctttcgggtttaaaccccctttcgttaaagggggtaacggtacgggttaggggttacgggggtacgggtaaaacgggtaaccggggtaaccggttaaacgggg

SEQ ID NO: 421771 - DNA, 618 bp, Homo sapiens
  misc_feature: GZ8MTXP02J0G2F.51.37.D04.1.454.CMB.2.raw
  modified_base (275)..(275): a, c, t, g, unknown or other
  modified_base (292)..(292): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagccgtgggacgggtccctgagactctcctgtgcagcctctggattcaccttnagtcgctacttcatganctggactccgcaggcctaccggaggggaacggggcctaggccgaggtcggtcctaccgacattacgttagtgaccgttaaggcgggggaaacaaacccgtactacgttccgtaacgcaacgtaccttcgtaggttacgggaaacggggtccctagttcctacccactcccgtaccgacgggaaccaaccgaccaaagaactctaactgtaactcaggtaacaaagtcaaactaggtaacaacggacgaccgaaacgaccgaccggttccgtacgtacttccgtaggtcgacggtagttggggacgggagaacgggttacgtacggg

SEQ ID NO: 421772 - DNA, 653 bp, Homo sapiens
  misc_feature: GZ8MTXP02FQNOW.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggagggtccctgagtctctctgtgcagtcctgtgtacttcaccttcagtcggcttacttcagtgagtcgtggactcccgcgtaggccgtaccggaaggggacgggtcctggccgaggttcgggtactcccgaactagttacgtttaaggtctaaccgttaaaggtgggggaaaccaaaccctagtactttacccgaacggacaacggtaccttcgtacggtagggaaaccggggtcctaactttccaccctaagtacccgtacgaacggggaaccaaacccggacctaaaacgacctcgaacttagtactaccgtagaaacgtaaagtacgaaagtacgtacgtaaaggaccggaccgaaacgaccgaccggtacgttcgttaacctgtaggtcgcgtaaggtcgtaggtacgaggacgtaacg

SEQ ID NO: 421773 - DNA, 749 bp, Homo sapiens
  misc_feature: GZ8MTXP02H9T7I.51.37.D04.1.454.CMB.2.raw
  modified_base (191)..(191): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcacatggagtttgggctgagcttgggttttccttgttgctattatagaaggtgtccagtgtcaggtncagctgggtggaatcgtgggggagcttggtccaagcctgggagggtccctgagactctcctgcgcacggtcctcgtggactttccacctttcgagtggcttacttcagtgagtcttggactccgacgacggtccgtccggaaggggaacggggtcctacggaccgtagggtcggggtcctaccgaacgtagttaagttacggtgaacgtaagttcgggggaaactaaaccctaacgttaatttccgtaacggactaacgaaccttcgtaggtaacgggaaaccgggtacccgtacgtttaccctaccgtacttacccgtaccggaaacgggaacctaaaacccgggccctaaaaacggaaccgttaccgtaacctggttaaacttccgtaaagacctaaaaggtacgtaaaacgtacgtttaaaacccgaaaggtaaaccggtaacggaaacggaaccgtaaccggggtacccgttaaggttaaccttttccggagggtaacggttccggaagggttcggggaagggggttaaccgaaacggggtacccgtaacgggg

SEQ ID NO: 421774 - DNA, 575 bp, Homo sapiens
  misc_feature: GZ8MTXP02FIJN0.51.37.D04.1.454.CMB.2.raw
  modified_base (344)..(344): a, c, t, g, unknown or other
  modified_base (424)..(424): a, c, t, g, unknown or other
  modified_base (535)..(535): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttcctgttgctattatagaaggtgtccagtgtcaggtgcagctggtggaatcgtgggggagcttgggtcaagcctgggagggtccctgagactctcctgtgcagcctctggacttcaccttcagtgctacttcatgagctggactccgccaggcctccgaggggaggggctggcaggtgggtctcactatnttagtgacttaagtgggggaaacaaacccactatttcctaacggcaagacctgtaggaaggaacggggcctaatttcccncctactcccgtaccggaacgggacaaaccgccaaagacctcactgtaatctagactaaagtgaaactgtactaaggacgaccgaagaccgtacgggcctaggtaccttcgngtcgcggtaggtggtacggggagtaacgggacgtaacggg

SEQ ID NO: 421775 - DNA, 719 bp, Homo sapiens
  misc_feature: GZ8MTXP02JZ2VS.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagccgtgggacgggttcccctggacgtactctccgtgtcgcacgtccctgtggacttccaccttcagtcggcttacgttcatggagcgtggactcccgcgaggtcctaccggaaggggacggggctggaccgtaggtcgggtctacccgacgtattaacgttaggtgtacgttaaggtcgggggaaacaaacccctacttacgtttacccgtacgaaccgagtaacccttcgaaggtaacgggaacggggacccttactttaccctaccgtaacgttacccgtaaccggaaacggggaaacccaaacccgggacccaaaacggtaaccccttacgtaaccgttaggttaaacttcgtacgaacctaaaagttacgaaacgttacgtaacgaaaacggacgaaacccgaaaggacccgacgggtaccgttacgttacccttgtcggtgtaccgggtaacggttcggggaagggaccgtacgggtaacgttaccgggg

SEQ ID NO: 421776 - DNA, 572 bp, Homo sapiens
  misc_feature: GZ8MTXP02GL1QJ.51.37.D04.1.454.CMB.2.raw
  modified_base (224)..(224): a, c, t, g, unknown or other
  modified_base (246)..(246): a, c, t, g, unknown or other
  modified_base (263)..(263): a, c, t, g, unknown or other
  modified_base (267)..(267): a, c, t, g, unknown or other
  modified_base (400)..(400): a, c, t, g, unknown or other
  modified_base (412)..(412): a, c, t, g, unknown or other
  modified_base (430)..(430): a, c, t, g, unknown or other
tcagcgatcgtatacacgaccggtgctcgatttagtagcatactgttgggtttgggggtgggtccaggaggcagaactctgggtgtctcaccatggcctggatccctctacttcctccccctcctcactctctgcacaggctctgaggcctcctatgagctgacacagccagcctcggtgtcagtcgtccccaggacagacggccaagctcccctgctctgganatgctattcgaacctaaaagtntttgtcttttagacaanagancgagcacgaccctataataattataataataaagacagtagagacgcctacgaggactccgagaggctattctcgtcggccctaccgacgctacggacggaaccacgcgaccgtacgttagacgtagttaggngggacgtaccgngaacgaagaagacgagtnagtactagtcagtacaaatcgaagcaacgacgacgtagtacgtattagaggtagtacggttagggacggtaacgggaacgtaggtcgacgtaccgtagcacgccgaagccgtacgccccgtatcgtacctcttaccgtcccc

SEQ ID NO: 421777 - DNA, 636 bp, Homo sapiens
  misc_feature: GZ8MTXP02J0KZX.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagcctgggacgggtccctgagactctcctgtcgcagcctcgtggtattccaccttcgagtcggcttacttcatgagcgtggactcccgccgaggcctccggaggggacggggctggccgtaggtcgggtctccgactattacgttagtgaccttaagtggggaacaacccatacttccgtacgcacgtaccttcgtaggaacggaacggggtcctatttcccgaccacgttcccgaccggaacgggaaccaaacccggaccaaacgtaacctactaaccgttgtactcgtacgtaaccaaaagtcggaaactagtaaaccgaaagaccggaaccgaaacggaccgaaccggtccgttacgttacttcgtggtaacgcggtaggtggggtacggaaggtacgggacgtacgggg

SEQ ID NO: 421778 - DNA, 758 bp, Homo sapiens
  misc_feature: GZ8MTXP02FH9R6.51.37.D04.1.454.CMB.2.raw
  modified_base (296)..(296): a, c, t, g, unknown or other
  modified_base (354)..(354): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcacatggagtttgggctgagcttgggttttccttgttgctattatagaaggtgtccagtgtcaggtgcagctggtggaatcggtggggggagtcgttggtcaaggccgtggggacgggtccctggacgtactctcctgtgcagcctcgtgattccaccttcagtgactactnatgagcgtggactccgccaggcctcggaaggggacgggctggcgtaggtcgggttccnccacgtatacgtttaggacgtacgttaaaggtgggggaaacctaaacctacttaacgttaccgttaacgacaacggtaccttacggtaacgggaaacggggtaaccgggtcccgttacttttacccgacccttaacgtccccggttaacccgaaaacgggggaaccaaaacccgggaccctaaaaggtaccctacgtaacgttaggttaacttccgtaagaaactaaaacgggttcaaaccgtaaggttaaccgtaaaacgggaccgaaaaccgggttaaaccggtaaacccggaccggggttacccggtttacgggtttaaccttcggtttagggcgggtaccggttagggggttcgggggtaagggggaacggtaacggggttaaccgggtttaaaccgggg

SEQ ID NO: 421779 - DNA, 685 bp, Homo sapiens
  misc_feature: GZ8MTXP02HG7SO.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagctctcctgtgcagcctctggattcaccttcagtggctactcatgagctggatccgccaggctccgaggggagggctgcaggtgggtctccgacatattagtgacgtaagtgggggaacaaaccacgtattccgtacgctaagtaccttcgtaggtaggaacggggtcccgtatttcctacccaattcccgtaccgaacggggaaccaaaccggaccctaaaaggaaccttacctaacgttacggttaaactcccgttaaggaaccgaaaattacggaaaacctaaggttaaccgtaaaacgggaaacggtaccccggaaaaggtaacccggaaaccggggtacccggtttacgttaacccgttttccgtacgggttggaaccgggtaacggggttacgggggttagggggaagggtaacggggtaaccggtttaaaccggggg

SEQ ID NO: 421780 - DNA, 685 bp, Homo sapiens
  misc_feature: GZ8MTXP02GG8SK.51.37.D04.1.454.CMB.2.raw
  modified_base (260)..(260): a, c, t, g, unknown or other
  modified_base (273)..(273): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctgggagggtccctgagactctcctgtgcagcctntggattcaccttnagtgctactcatgagctggactccgcaggctccgaggggagggctgcgaggtggtctcacgtatattagtgactaagtggggaacaaccactattccgtacgcagactcgtaggacgaacggggcccgtaatttcccgtaccctaacttcccgtacccggaaacgggggaaccccaaaaccggacccccgaaaacggtaacccttaccgtaacccgttagggtaacctacccgttaggaaaccctaaaagttacggaaacctaaggtaaccgtaaaacgggaaccggaaacccggaaacggaacccggaacccggggttaccggttccggttaaacctttccgtacgggtcggtaccggtaggggttagggtacgggggaagggtaacggggtaaacccggtttaacggggg

SEQ ID NO: 421781 - DNA, 684 bp, Homo sapiens
  misc_feature: GZ8MTXP02JQQ5U.51.37.D04.1.454.CMB.2.raw
  modified_base (293)..(293): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaaggcctgggacgggtccctgagactctcctgtcgcagcctctggacttcaccttcagtgctacttcatganctggactcccgccaggtcctccgagggggacgggctggctaggtgggtctaccactattattaggcgtacttaagtgggggaacaaaccgactacttccgtaacgcaaggtaccttacgaggaaacgggaacggggtcccgtaattccctacccgaactttacccgacccggaaacggggaaaccgaaacccgacccgtaaaacgtaaaccttccgaaaccgttggtaaactccgtaggaaaccctaaaagtacggaaacctagttaacccgtaaaagggacgacccgaaaacggacccggtaacccgggtcgttacgttaccgttaccgtggttaacggaccggtaggtttacggggaggggaacggtaacggggtacctaaaccggggg

SEQ ID NO: 421782 - DNA, 666 bp, Homo sapiens
  misc_feature: GZ8MTXP02I42EK.51.37.D04.1.454.CMB.2.raw
  modified_base (269)..(269): a, c, t, g, unknown or other
  modified_base (373)..(373): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctgggtggaatcgtgggggagcttggtcaaggccgtgggacgggtccctggacgtactctcctgtgcagcctcnggacttcaccttcaggtcggcttacttcatgagctgggactccgccaggcctccggaaggggaacggggctgccgagggtgggtctaccgactatagttaggtnacgttaagtgggggaactaaacctatacttcgtaacgacaagtacctgtggtagggaaacgggtccgtaacttctacccattacccgtccgaaacggggaaccaaaccggcccgaaaagtaaaccctccgtaaacttcggttaactccgttaacggaacctaaaataggtaaaaccaaggttaacaaaacggaaccgggaaccgaaacggaaccgacccgggtaccgttacggttaaccgtttcgtaggcggacggtagttggggaaggggaacgtagggaaccgttacgggg

SEQ ID NO: 421783 - DNA, 744 bp, Homo sapiens
  misc_feature: GZ8MTXP02GK7R9.51.37.D04.1.454.CMB.2.raw
  modified_base (546)..(546): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagtcgttgggttttccttgttgcttattatagaaggtgtccagtgtcaggtgcagcgtggtaggaatcggtggggggagtcgttggtacgaagccgtagggtacgggtccctgacgtcctctccgtgtgcacgtctcgtgtacttcctaccgttcgaggtcgtacttacttcagtggacgtcgtaggtaccgtcccggaccgacgggtccgtaaccgggaacgggggtacggggtaccgttggaccgttacggggttcggggttcctaccgtaaacgttagtttaacggtttaggtacggttaacgttaacggggtacggggtaaaccgaaaccctaacttacgttaccgtacgacgtaacgtaccgtaggtaagggaacggaaccgggtccttacttacccncctacgttacccacgggaaaccggaaccaacccgggaacctaaaggaacccttctaacggttattaccaccgtagaaacctaagaaacgtaacgtagtaacaaacgaccggtaaacgaacggtaccgacggtccgttaacgtcgttacgaggaaccgtaggtacgggtaggtacgggacgttaccggagttaaccggg

SEQ ID NO: 421784 - DNA, 701 bp, Homo sapiens
  misc_feature: GZ8MTXP02I1RCT.51.37.D04.1.454.CMB.2.raw
  modified_base (262)..(262): a, c, t, g, unknown or other
  modified_base (274)..(274): a, c, t, g, unknown or other
  modified_base (290)..(290): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagcttggtcaagccgtgggagggtccctgagactctcctgtgcagcctntgattcaccttnagtgctacttcatganctggactccgccaggcctccggaggggagggctgctaggtcggtctccaacgtattaattaggtgacctttaaagcgggggaaacaaaaccccacgtaactttacccgtaacggacctaaagggtaaccctttcggtaggaaagggaaacgggggtcccctaaagtttcccgtacccctaaattccccgtaacccggaaagggggaacccttaaaacccgggacccccaaaaagggtaaaccctttcaaaccgttaggttaaacctccgtagaaactaaaaggtacgaaacgtaacgtaacgtaaaacggacgtaaccggaaacgtacccggaacgggttccgttacgttaccgttcgtaggtcggtacggtagggtcgggtacggggacgtaacgggttacggtaacggg

SEQ ID NO: 421785 - DNA, 697 bp, Homo sapiens
  misc_feature: GZ8MTXP02GIFOB.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaaggccgtgggacgggtccctggacgacctctccgtgtcgcagtcctgtgtacttcaccttcagtgcttactcatgagcgtggactccgccgaggcctacggaggggacgggctggcgtaggtcggtctactacattagttagtcgtacgttaaagtcggggaaacaaccaacgtacttaccgtacgactacgtactcgtaggaaacgggaacggggtaccttactttacccgaccctaaacgttcccgttaacccgggaaacggggtaaacccaaaacccgggacccaaaaaggtaaaccccttcaaacccgtttaggtaactaccgtacggaaactaaaagtacgtaaaaccgtaacgtaaacgaaaacggacggaaacccgaaacgtaccggaaccggggtacctttacgtaaccttcggttaggcgtacggtaagggttcgggaggggtaacgacggggtaacgtaccgggg

SEQ ID NO: 421786 - DNA, 571 bp, Homo sapiens
  misc_feature: GZ8MTXP02IFWJR.51.37.D04.1.454.CMB.2.raw
  modified_base (198)..(198): a, c, t, g, unknown or other
  modified_base (260)..(260): a, c, t, g, unknown or other
  modified_base (271)..(271): a, c, t, g, unknown or other
  modified_base (287)..(287): a, c, t, g, unknown or other
  modified_base (315)..(315): a, c, t, g, unknown or other
  modified_base (318)..(318): a, c, t, g, unknown or other
  modified_base (325)..(325): a, c, t, g, unknown or other
  modified_base (443)..(443): a, c, t, g, unknown or other
  modified_base (450)..(450): a, c, t, g, unknown or other
  modified_base (528)..(528): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgtgctattatagaagtgtccagtgtcaggtgcaggctggnggaatcgtgggggagctttggcaagccgtgggacggtccctgagcttctctgtgcagcctgngattcaccttnagtcgctactcatgancgtgactccgcaggctcgagggaggtcngcngtcggcncgatatagtagcgatacgtggggaacaaccagtattccaacgactcgtactgtcggtaggaacgggtccagtttccacctaattcccgacgaaggaccaaacgaccgtaaaagacttnaacgttntactcctagactaaatacgaaactacggtacaaaacggcgaacggaacgacgtaaccggggtccttagttaccgtttnacgggtgcggtaagttcgggagggtagacggttaacgaccggg

SEQ ID NO: 421787 - DNA, 555 bp, Homo sapiens
  misc_feature: GZ8MTXP02IEQX6.51.37.D04.1.454.CMB.2.raw
  modified_base (193)..(193): a, c, t, g, unknown or other
  modified_base (245)..(245): a, c, t, g, unknown or other
  modified_base (255)..(255): a, c, t, g, unknown or other
  modified_base (454)..(454): a, c, t, g, unknown or other
  modified_base (469)..(469): a, c, t, g, unknown or other
  modified_base (484)..(484): a, c, t, g, unknown or other
  modified_base (520)..(520): a, c, t, g, unknown or other
  modified_base (528)..(528): a, c, t, g, unknown or other
tcagcgatcgtatacacgaccggtgctcgattttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtncagctggtggaatcgtgggggagcttggtcaagcctgggacgggtccctganactctctgtncagcctgtgattcactcagtgctactcatgagctggactcccgcaggctacgaggggaagggctggcaggtcggtactcgaactattagtagtgactaagtggggaaacaaacacgtaatttccgaacgatacgacttcgagtaggaacggctaagtttccactatccgacgagggaccaaacggtcaaaagtacctanaccttagtactcganaacgaaattcgaaanagttacaagacgacgaaggacacggctagtaccttnggtaacgngtagtacggaggacgacggtacgtacg

SEQ ID NO: 421788 - DNA, 603 bp, Homo sapiens
  misc_feature: GZ8MTXP02HQA3A.51.37.D04.1.454.CMB.2.raw
  modified_base (264)..(264): a, c, t, g, unknown or other
  modified_base (379)..(379): a, c, t, g, unknown or other
  modified_base (387)..(387): a, c, t, g, unknown or other
  modified_base (481)..(481): a, c, t, g, unknown or other
  modified_base (569)..(569): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagcgtggtggaagtcgtggggggagcgttggtcaagccgtgggacgggtccctgagactctccgtgtcgcncgccctgtggacttccgaccttcgagtcggcttacttcattgagtcgtggactcccgcgtggcctaccggaggggaacgggctggcgtaggtcgggtctcccatattattaggtnacgttaanggggaactaacactaacttcgacgcaagtcctgtggtacggaacggccgtattccgtaccatcccacggagggaaccacgaccaaagtaacctnacgttatattccgagttacaaagacgaagtacgtacgtaacgaacgaacgaacgaaccgaccggtcgtccgttacgttccgtgtgggnggtacggtaggtagggacggacggtacggtacgg

SEQ ID NO: 421789 - DNA, 839 bp, Homo sapiens
  misc_feature: GZ8MTXP02IQAS5.51.37.D04.1.454.CMB.2.raw
  modified_base (192)..(192): a, c, t, g, unknown or other
  modified_base (672)..(672): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtncagctggtggaatcggtgggggagtcgttggtcaaggtccgtgggacgggtccctgacgaccttctccgtgtcgcacgtccctcgtaggtacttaccctacctttcgaaggttcggtacccttaacctttaccgaagtttagggaacgtccggtttacggggtaaacccgttccccccggggaccccgtacgggggtaccccttacccccgggggaaaaggggggggtaaacgggggtcccttcggggaccggtaacggggttcggggttcctaacccgtaacctaagtttaagtttagggtcgtaaccggttaaggttacggggggaaaccaaaacccgtaactaacgtttcccgtaacggaccgtaacggtaccttcgttacggggtagggaaaccgggggtccctaacgttcccgacctacgtttcccgaaccggaacggggaaaccccaaacggtaacccgaaacggtaaaccctntaccgttagttaaacctccgttagaaactaaaggtaacgtaacgtaagtacgtaaaaggaaccgtacggaaacgacccgggtaaaccggtcgtttaccgttacttccggtcggtaacggacggttaggtacgggggtacggacgggtaacggtacggtttaaccggg

SEQ ID NO: 421790 - DNA, 666 bp, Homo sapiens
  misc_feature: GZ8MTXP02JHV6V.51.37.D04.1.454.CMB.2.raw
  modified_base (397)..(397): a, c, t, g, unknown or other
  modified_base (647)..(647): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttggggtttttccttgttgcttattatagaaggtgtccagtgtcaggtgcagcgtggtaggaagtcggtgggggagtcgttggtcaagccgtgggacgggtccctgacgctctcctgtcgcagcctctggacttccaccttcaggtgtactacttcagtgagcgtggactcccgccgaggccgtccgaaggggaacggggctcgggcagggtcgggtccaccgacgtagttagttagtcggactttaaggngggggtaacaaaccctatacgttaccacgtacaaggtacctcggtaacgagggaaacggggccttactttcctacccgtactaccgtaccggaacggaaccgtaaaccgaccgaaacggtaaccctacgtacctagttacctacgaacgtacgaaacttaacgaacgtaacgggttaacaaacggacgaaccggaaagttaccggaaccgggtacgttccgtacgttcgtaggcggtagtcggttagggnggagacggtacgtaacggg

SEQ ID NO: 421791 - DNA, 621 bp, Homo sapiens
  misc_feature: GZ8MTXP02I15SJ.51.37.D04.1.454.CMB.2.raw
  modified_base (165)..(165): a, c, t, g, unknown or other
  modified_base (226)..(226): a, c, t, g, unknown or other
  modified_base (247)..(247): a, c, t, g, unknown or other
  modified_base (372)..(372): a, c, t, g, unknown or other
  modified_base (429)..(429): a, c, t, g, unknown or other
tcagcgatcgtatacacgaccggtgctcgatttagtagcatactgttgggtttgggggtgggtccaggaggcagaaatctgggtgtctcaccatggcctggatccctctacttctccccctcctcactctctgcacaggctctgaggcctcctatgagctgacanagccagcctcggtgtcagtcgtccccaggacaggacggccaaagactcccctgctctgganatgcattcgaacctaaaagtntttcgtctttttacggtaaccaacagaacgccgacggaccgacggacccctaataaactaattaataataataaaagacagtagagacggccctagaacggctacccgtagacgcgtattcacgngtccctacgagtctacgaggaaaccacgagtccaaggttcaacgatttaggacgtanaccgagacgaagaagacgaggactagaaactattactacgtacaaatcaagacgacgtacgaagagtagtacgttaagtagagtacgtacggacggaggaaccgtaagggtgaaccgttacgaacggtacgaaccgaccgaaacggcccgttaccgaccccgtacggtcccacgttacctcgtttacccccg

SEQ ID NO: 421792 - DNA, 674 bp, Homo sapiens
  misc_feature: GZ8MTXP02I0Y5D.51.37.D04.1.454.CMB.2.raw
  modified_base (272)..(272): a, c, t, g, unknown or other
  modified_base (279)..(279): a, c, t, g, unknown or other
  modified_base (518)..(518): a, c, t, g, unknown or other
  modified_base (543)..(543): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgttgggttttccttgttgctattatagaaggtgtccagtgtcaggtgcagcgtgggtggaagtcgggtggggggaggtcgttggtacaacggccgtgggacgggtccctgacgctctcctgtcgcncgcctgngtacttccaccttcgaggtcgtccttactcagtgacgtcgtggacctcccggccgacggccgtacggaacgggggagggtctcggcgtagggtcggtctacctaacgtattagttacgtgtacgttaaggcgggaaacaaccactacgttacacgacacgtacctggaaggacgggaacggtcctattccgtaccactcccgacggaacggtaccaaaccggtaccaaaagtacccttntaacgtcggttaacacccggtaaanaactaaagtaacgtaactaacgtaacgaaacgaaccggtaaccggaaacgtacccggtaccggttccgttacgtccgttcggtcgtaaggtcggtagggtcgggacgggtaacgaccgggttacggtacgg

SEQ ID NO: 421793 - DNA, 684 bp, Homo sapiens
  misc_feature: GZ8MTXP02H7E6G.51.37.D04.1.454.CMB.2.raw
  modified_base (248)..(248): a, c, t, g, unknown or other
  modified_base (270)..(270): a, c, t, g, unknown or other
  modified_base (274)..(274): a, c, t, g, unknown or other
  modified_base (308)..(308): a, c, t, g, unknown or other
tcagcgatcgtatacacgaccggtgctcgatttagtagcatactgttgagctctggggagaagagccccagtcccagaattcccaggagttttccattcggtgatcagcactgaacacagaggactcaccatggagtttgggctgagcttgggttttccttgttgctattatagaaggtgtccagtgtcaggtgcagctgggtggaatcggtggggggagtcgttggtcaagccgtgggacggtcccngacgactctcctgtgcagcctntggnttcacttcagtggacttactcagtgagcgtgacnccgcgacggcgtaccggaggggacggggctggacgtggtcggtactcccaatagttaagttagtcgtacttaagtcggggaactaaaccacgtattaccgtacgacacgtaccgttgacggagggaaccgggtctaactttcctaccgacttcccgaaccggaacgggaaccaaaacccgaccgaaaacggtaactaccgaacgttcgttaaacctacggttaacaaataaaacgttaacggaaaccaaacgttaaccgaaaacggaaccgggaccggtaaaacggaacccgtaaccgggtacccgtttggttaacctttgcggtaaggacggtagggtacggggtaggggaacggtaggaaacccgtttacgggg

SEQ ID NO: 421794 - DNA, 598 bp, Homo sapiens
  misc_feature: GZ8MTXP02I9VGN.51.37.D04.1.454.CMB.2.raw
  modified_base (268)..(268): a, c, t, g, unknown or other
  modified_base (272)..(272): a, c, t, g, unknown or other
  modified_base (493)..(493): a, c, t, g, unknown or other
  modified_base (569)..(569): a, c, t, g, unknown or other
  modified_base (579)..(579): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcggtgggggagtcttggtcaaggccgtgggacgggtccctgacgtactctcctgtgcagcctntggnttccacttcagtgcttactcatgagctggactcccgccaggcctaccggaaggggacggggctggccgtaggtcgggtcacccactattagttacgtgtaccgtaaagtgggggaaaccaaacccgtactaatttaccgtaacgccaagtactccgtaggaaggaacgggctacttccacctatccgtaccgaacgggaccaaaccggaccaaacgtaacncgtaactgtactcctagactaaatacgaactagtacgaagacgacgaaagaccgacggtccgtagtacctgtgcgnggtagtgggnggtagacggaacgtacggg

SEQ ID NO: 421795 - DNA, 622 bp, Homo sapiens
  misc_feature: GZ8MTXP02HF1LP.51.37.D04.1.454.CMB.2.raw
  modified_base (365)..(365): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaagtgtccagtgtcaggtgcagcgtggtggaatcggtgggggagtcgttggtcgaagccgtagggacgggtccccgagtactctcctgtgcagcctgtggacttccgaccttcgaggtcggcttacttcatgagctggactccgcgaaggctccggaaggggaacgggctgcaggtggctcacgtatagtagngtactaagagggacaaccatagttcctaacgcaagtacctgtaggaggaacgggcctaattccacgacttcgaccgaaggggacccaaacggaccaaaaggactactaacgtacgtactacgacgaaccgtaaaatacgaaacgtagttaacgaaaagaacgtaaccgaaaaggaccgaaccggtccgttagttaccgttccgtgtacgggaacgtaggttaggaggggaaaccgtagggaaccgtttaagggacgg

SEQ ID NO: 421796 - DNA, 751 bp, Homo sapiens
  misc_feature: GZ8MTXP02GJSQL.51.37.D04.1.454.CMB.2.raw
  modified_base (304)..(304): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagtcgttgggttttccttgttgtctattatagaaggtgtccagtgtcaggtgcagcgtggtggaatcggtgggggagtcgttggacaagccgtggacggtccctgacgactctcctgtcgctagcctgtgtacttcacctttcaggtcgtcctaccgttanagtgacgcgtcgaccgtccgacgacggtcgtacgggaaggggtacggtctacgacgtaggtcggtactacgacttagttacgtacgtacgtaacgtagggtacggaacctaaaccgtacttaccgttaccacggtacgtaaccgtacgttacggttaacgggtaaccgggtaaccgggtaccgttacccgttacccgtaaccgttacgttaccccggaaaccgaccggtaaacccgaaacccgtaaaccgtaaaccggtaaccttaccgtaacgtttacgtaaacgtacccgtaagtaaacgtaaacgtacgtaaaccgttacgtaaaaccgtaacggaaaccggtaacccgtaacggtacccggaaacggtttaccgttacgttacgtcggtagtaacgggtggtaacggtacggggtaaggacggttaccggaaccggtttacgg

SEQ ID NO: 421797 - DNA, 756 bp, Homo sapiens
  misc_feature: GZ8MTXP02JOVM3.51.37.D04.1.454.CMB.2.raw
  modified_base (215)..(215): a, c, t, g, unknown or other
  modified_base (224)..(224): a, c, t, g, unknown or other
  modified_base (244)..(244): a, c, t, g, unknown or other
  modified_base (285)..(285): a, c, t, g, unknown or other
  modified_base (289)..(289): a, c, t, g, unknown or other
  modified_base (294)..(294): a, c, t, g, unknown or other
  modified_base (304)..(304): a, c, t, g, unknown or other
tcagcgatcgtatacacgaccggtgctcgatttagtagcatactgttgggtttgggggtgggtccaggaggcagaactctgggtgtctcaccatggcctggatccctctacttctccccctcctcactctctgcacaggctctgaggcctcctatgagctgacacagccagcctcggtgtcagtcgtccccgaggacagacggccaagctccccngctctgganatgacattgacccaaaagtntttgcttttagaacaacagacgcagcagccctataatatanatanaaganagtgagcgcngaggctccgtgagtcgtattccgtcgtgccctaccgagtcctacgaggaaccaacgcgacctaaggtacgacgtaagttaggacggtagtacccgaggacgtaaaggaaagaccgggtaagtactacggtaaacgtttacttaaccgtacgtaaaccttaagtacgaacgaacgtaaccggaccggtaaccgtttaaggtacccgggttttaaaacggttacgtaacgggggttaaagttacccggggtttacgggggaaccggggtaaaaccgggggaaacccgggttaaacgggtaaacccggttaccccgggttaacgggtttaaaccgggggtacctaaacccgggggtaccccgaaaacggggttccccgttaaacccccggtcccccccggtttaacgggttccctaacccggtttacccccgtttcccgggtttaaccccccccg

SEQ ID NO: 421798 - DNA, 593 bp, Homo sapiens
  misc_feature: GZ8MTXP02FO1QP.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaaggtgtccagtgtcaggtgcagctggtggaatcgtgggggagcttggtcaagccgtgggacgggtccctgacgactctcctgtgcagcctctggacttcaccttcagtgctacttcatgagctggactcccgccaggcctccggaaggggaggggcctggacgtaggtcgggtctaccgactatagttagtgacttaagtcggggaacaaccagtacttcgtaacgcaagactgtagagaagggcctatcctccaatccaccgaacgggacaaaccgccgaaaacgtactcagtagtatcagtacaaagtcgaaactagtacgaaaacgacggaccgaaagaccgtaacggggtccttacggtactttcgtaggttccgaggtaacgtcggggttacgggaaggtacggaccggtttacggg

SEQ ID NO: 421799 - DNA, 584 bp, Homo sapiens
  misc_feature: GZ8MTXP02FSSOP.51.37.D04.1.454.CMB.2.raw
  modified_base (260)..(260): a, c, t, g, unknown or other
  modified_base (268)..(268): a, c, t, g, unknown or other
  modified_base (280)..(280): a, c, t, g, unknown or other
  modified_base (289)..(289): a, c, t, g, unknown or other
  modified_base (318)..(318): a, c, t, g, unknown or other
  modified_base (336)..(336): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatctgggggagcttggtcaagcctggagggtccctgagactctcctgtgcagcccttngatcactnagtgctactcangagctgacnccgcagctcgagggaggctgcagtggtcncacatatagtgactaagngggaacaaacctaactattccgtaacgcagactctgtagaacggaccgtacttactacctactactaccgacggaacgaaaccgaaccgaaacgaaactactacgtacgtacgtacgtacgaacaaactaacgaaactaacgtaacgtaaacgaaacgacgaaacgaaaccgaaccggtaccggtacgttaacgttacgttacgtcggtacgtacggtacggtagggaacggaacggtaacgtaacgg

SEQ ID NO: 421800 - DNA, 730 bp, Homo sapiens
  misc_feature: GZ8MTXP02FIF92.51.37.D04.1.454.CMB.2.raw
  modified_base (273)..(273): a, c, t, g, unknown or other
  modified_base (288)..(288): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttcctgttgctattatagaaggtgtccagtgtcaggtgcagctggtggaatcgtgggggagtcttggtcaagcctgggacgggtccctgagactctcctgtgcagcctctggatcaccttnagtgctactcatganctggactccgcaggcctcgaggggacgggctgcgaggtcggtctcactatagttagtgactaagtgggaacgaacccagtattccgtaacgctaagtacctcgtaggaaacggtaacggggccctaatttcccgaccctaacttccccgtaccggaaacgggggaaacccaaaccggaaccccgaaaacggtaaccttaccctaacgtttacgtaacgttaccttacgggaaacctaaaaaggttacgaaaaccgtacggtttaaaaccgtaaaacgggaaccgggtaaaccccggaaaacggtaaaccccggaacccgggggttaccccggtttaacgtttaaacccccggttggtttacgggaacgggtaccgggttaaacgggggttcgggggtaaacgggggaaacgggtaacgggggtaccggtttaaaaccggggg

SEQ ID NO: 421801 - DNA, 686 bp, Homo sapiens
  misc_feature: GZ8MTXP02JRU6V.51.37.D04.1.454.CMB.2.raw
  modified_base (652)..(652): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctgggtaggaatcggtgggggagtcgttggtacaaggccgtgggacggtccctgacgacctctcctgtcgcacgcctgtggtacttccgtaccttcgagtcggacttacttcatgacgcgtggactcccgccgaggccgtaccgggaggggaacgggtcgtcggcgtaggtcgggtctaccgtactaagtttattaggtacgtacttaaagggtcggggaaaccaaaccgtactacttaccgtacggactaacgtacctcgttaggaacggaaacggggtcctacttaccgtcctaacgtccgtaccggaaacggaaccctaaacccggacaaacggtacctactacgttataactcgaacaactaaacgtacgaacgtacgttacgaaaggaccgaaaccggaacgaaccggtccgggtacgtttaccgtacgttccgtaggtggacgggttaggnggggttagggaacggtacgggtacgtaaccgggg

SEQ ID NO: 421802 - DNA, 555 bp, Homo sapiens
  misc_feature: GZ8MTXP02H3CBB.51.37.D04.1.454.CMB.2.raw
  modified_base (284)..(284): a, c, t, g, unknown or other
  modified_base (345)..(345): a, c, t, g, unknown or other
  modified_base (519)..(519): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagccgtgggacgggtccctgagctctcctgtgcagcctctggattcacttcagtcgctactnatgagctggactccgcaggctaccgaggggacggctgacgaggtggtctcactatattagntactaagtggggaacaacactattccaacgcaagctcaggacgaaggccgtatttccgaccataccgtaccgagggaacacgtaccaaagtaacctcgaaacttgtactctagaactaaatacgaacgagttacaaaagcgaaccgtaagaccgtacggcttacgtactttcgngtcgacgtaggtcggtaggaggacggtacgtacggg

SEQ ID NO: 421803 - DNA, 804 bp, Homo sapiens
  misc_feature: GZ8MTXP02JZA4L.51.37.D04.1.454.CMB.2.raw
  modified_base (169)..(169): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattanagaaggtgtccagtgtcaggtgcagctggtaggaatcgtgggggagcgttggtcaagccgtgggagggtccctgacgactctccgtgtcgcgagccctcgtaggtacttaccaccctttcgaaggttcggtaccttaaccgtttcgtagttggaacgtcgttgggaacctccccggaccgtaaggggccccgttacccgggaagggggtaacggggcttacggacgtacggggttcggggttacctaccccgtaactacgtttaagtttacggtacgtaaccgttaaagggtcgggggtaaaaccaacccttaaaccgtagtttacccgtaaaccgggaccctaaagggtaccccgtttcggttaaagggaaacgggggtaaaacccgggggttacccgtaactttttacccccgaccccgtaaacgtttcccccggttaaacccgggaaacccgggggtaaaacccctaaaacccgaccccgtaaaaaggtaaccccttacgttaacccgtttagtaaaccttccgagtaaacccgtaaagttaccgaaacgtacgttaaccgaaaggaccgaaaccggaagacgtaaccgtcgtacgtacctgcgtgcgtagtcggaggagtacggcgtaagg

SEQ ID NO: 421804 - DNA, 829 bp, Homo sapiens
  misc_feature: GZ8MTXP02J0DEF.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgttgggttttccttgttgctattatagaaggtgtccagtgtcgaggtgcagcgtggtggaatcggtgggggaggcttggtacaagccgtgggacgggtccctgacgactctccgtgtcgcacgtcctgtggtacttcctaccttgaggtcggtccttacttcatggacgtcgtacggacgtcccgccgaggtcccgtacggaagggggacgggtcgtggacgtaggtcggtaccttacccacgttattagtttaggtcgtaacgttaagggtcgggaaacgaaaccctattaccgttaccgtaaacggtaccgtaacgtacccttacggtaacgggaaacgggggtaacccggggtacccgtttaacctttcccgtaacccgttacgtttaccccggaaaccgggaaccgggggtaaaacccaaaccccggggtaaacccgtaaaagggtaaacccgttaccgtaacggtttaccggtttaacgtttacccgaaagggttaaaaccaaaaggttaaccggaaacgttaaaccggtaaacggtaaaacggaacccggtaaacccgggaaagtaaacccggtaaccggttacggggtacccgtttaccgtttacgtttacggtcggtacgggttacggtacgggggtttacgggagggggtaacggaccgggtttaaacccgggg

SEQ ID NO: 421805 - DNA, 846 bp, Homo sapiens
  misc_feature: GZ8MTXP02GHX8E.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcggtgggggagtcgttggtcaagccgtgggacgggttccctggacgtacctctccgtgtcgcacggcctcgtggtacttcctaccgttcgaggttcggtaccttaccgttcacgtggacgtcgttacgggaccttccccggacccgacgggtcccgttaccccgggaaaggggggtaacggggtcctcggacggtacgggttcggggtacctacccgaaacgtagtttacgttagggtacgtaaccgttaaagggtcgggggaaacctaaacccgtacgtactttacccgaacgacgtacgtaaccgttcggtaaaggacgggtaaaccgggggtacccttaacgtttccctacccgtaacgtttccccgaaccgggaaacgggtaaacccaaacccggaacccgtaaaacggtaaacccttacgaaccgtttacgggttaactaccggttaacggaaacctaaacggttaaacgaaaccgttacggtaaaacgtaaaacgggaaccggttaaacccggaaacggaacccggtaccggggtaccgtttacggttaaccctttgggttacgggtaaccgggtacggtaaggggttcggggtaagggggtaaccggtacgggggaaccgtttaaacccggggg

SEQ ID NO: 421806 - DNA, 655 bp, Homo sapiens
  misc_feature: GZ8MTXP02JB9SX.51.37.D04.1.454.CMB.2.raw
  modified_base (185)..(185): a, c, t, g, unknown or other
  modified_base (263)..(263): a, c, t, g, unknown or other
  modified_base (291)..(291): a, c, t, g, unknown or other
  modified_base (298)..(298): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgtggtttcctgtgctatatagagtgtccagtgtcaggtncagctggtggaatcgtgggggagcgttggtcaagcctagggacgggtcctggacgactctccgtgtcgcaggtccctntggattccacttcgagtcgcttaccttnagtgacncgtgactccgacgaggccgtacggaggggtacggctagcgtaggtcggtcaccgaattagtagttagtcgtaagtaacgggtcgggaaaccaaactacgtacgtaccgtacgacacgtactcgaaggaacggacggtcctaacgtacgtaccacgttaccgtaacggaaacggtaaccaaaccgaaccgtaaacgtaacctacgtacgttacgtacttacgtaacgaaactaaagtacgaaacgtacgtaacgaacggaaccgaccgtaacgaccgtaaccggttaccgtacgttacgttcggtaggtaacggtacggtaacggtacgggacggaacggtaacgggtacggtaacgg

SEQ ID NO: 421807 - DNA, 773 bp, Homo sapiens
  misc_feature: GZ8MTXP02JJHCF.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtaggaatcggtgggggagtcttggtcaagccgtgggacgggtccctgacgactctcctgtgcagcctctggtattccaccttcgagtcggcttacgttcatgagtctggactcccgccgaggccgtaccggaagggggtaacggggctggccgtagggttcgggtcctcccgaactagtttaagttagtcgtaaccttaaaggttcgggggaaacctaaaaccctacgttaacgtttacccgtaaccggctaaaggtacccttcgttaaggttacgggaaaccgggggtcccttaaacgtttcccttacccgaacgtttaccccgtaccggaaaccgggggaaacccaaaacccggggttaccccaaaaggtaaaccccttcctaaccgtttaggttaaaccttccgttagaaccctaaaagttccggaaaacctagtaacgtaaaacggacgaacccgggaaaagaccccggttaacgggacccgtttacggtaacctttccggtggttaaggaccgggttaaaggtttcgggggtacggggaaaggtacccggggtaagtttaacccggggg

SEQ ID NO: 421808 - DNA, 731 bp, Homo sapiens
  misc_feature: GZ8MTXP02FXTTL.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagcgtgggtggaatcggtggggggagtcgttgggtacaacggtccgtagggtacgggtcccctggacgtactcctccgtgtgccacgtcctcgtgtacttcctaccttcaggttcggacttaccgttacagtgacgcgtaggactcccggccgacggccgtacccgggaggggacggggtcgtcgacggtaggtcgggttcctaccgaacctatttaagttacgttagtaacgttaacggtacgggggaaacctaaacccgtaaacgtacgtttaccgaaccggtactacggtaaaccttcggttacggtaccggggtaaaaccgggtcccgttcctttaccctacccgttaactaccccgtaccggaaacgggaaccctaaacccgggacctaaagaaccccttacgaacttacgtacgtacctacgaacaaagttacaaccgtagtaacgtaacgacggaacgaacgaccggaacggttcctcgttactggtacgtcgacggttaggtgggacgggagaacgggtacggtaaccgg

SEQ ID NO: 421809 - DNA, 511 bp, Homo sapiens
  misc_feature: GZ8MTXP02IQGAS.51.37.D04.1.454.CMB.2.raw
  modified_base (259)..(259): a, c, t, g, unknown or other
  modified_base (390)..(390): a, c, t, g, unknown or other
  modified_base (479)..(479): a, c, t, g, unknown or other
  modified_base (482)..(482): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagctgggttttccttgttgctattatagaaggtgtccagtgtcaggtgcagctggtggaatcgtgggggagcttggtcaagcctggagggtccctgagactctcctgtgcagcctntggattcaccttcagtgctacttcatgagctggactccgccaggctccgaggggagggctgcgagtggtctcacatattagtgactaagtggggacaaccatattctacgcagactctgagagggcattcncatctacgaggacaacgccaagactcactgtactctgacaaatagaactagtacaagacgaccgtaaagaccgacgggcctcgtacctntgngcgtagtggtaggacgtacggactacggg

SEQ ID NO: 421810 - DNA, 693 bp, Homo sapiens
  misc_feature: GZ8MTXP02JZ04Q.51.37.D04.1.454.CMB.2.raw
tcagcgatcgtatacacgaccggtgctcgatttagtagcatactgttgagctctgggagaagagccccagtcccagaattcccaggagtttccattcggtgatcagcactgaacacagaggactcaccatggagtttggctgagtcttgggttttccttgttgctattatagaaggtgtccagtgtcaggtgcagcgtggtaggaatcggtgggggagtcgttggtacaaggtccgtgggacgggtccctgacgtactctcctgtcgcacgcctcgtggtactctacctcgagtcgcttactacagtgagtcgtcggactcccgcgacgggtcctaccggaaggggtaacgggtccttgggaccgtagggttcggtactccgaacgtattagttaggtcgtaactaagggtcgggaaccgtaaacccacgtagttacgacgtacgacgaacttcgaacgagggaacgggtccctacttccgcctaacgtcccgaccggaggaccaaacgaccgaaaactcactagtcgtaactcgaacgaacgtaaactacggtaataaccggtaaacgaacggaaccgaacccgggaaagacccggtaaacccgggttcgttacgttacccgtttgtaggttaaccgaacggttcggggtttacgggacggggtaggtaaccgggttacccggtaaacgggg

SEQ ID NO: 421811 - DNA, 661 bp, Homo sapiens
  misc_feature: GZ8MTXP02IIXTK.51.37.D04.1.454.CMB.2.raw
  modified_base (356)..(356): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttggctgagcttgggttttccttgttgcttattatagaaggtgtccagtgtcaggtgcagcgtggtaggaatcgggtgggggacgtcgttggacaaggccgtgggacggtccctaggacgacttctccgtgtcgcacgccctcgtggacttccaccttcaggtcgcttacttcagtgagcgtacggactcccgacgacggcctaccggaggggacgggtcnggtacgaggtcgggtactccgactattagttagtagacgttaaggtcggaaccgtaaacacgttacttacgtacgagtacgtacttccggtgttaacgggaccgggtccttaattcccactacgtcccgtaccgaacggaccaaaccgaccgaaacgtacttacgaacgttacgtacttccgagaacctaaagtacgaaactagtaaccgtaaacgggccaaaccggtacgaaccgtccggtaacgttcgttaacttcgtgcggtacgtaggttacgggaggtaacggacggtttaccgaacggg

SEQ ID NO: 421812 - DNA, 756 bp, Homo sapiens
  misc_feature: GZ8MTXP02H0HT8.51.37.D04.1.454.CMB.2.raw
  modified_base (216)..(216): a, c, t, g, unknown or other
  modified_base (248)..(248): a, c, t, g, unknown or other
  modified_base (466)..(466): a, c, t, g, unknown or other
  modified_base (543)..(543): a, c, t, g, unknown or other
  modified_base (620)..(620): a, c, t, g, unknown or other
tcagcgatcgtatacacgaccggtgctcgatttagtagcatactgttgagctctgggagaagagcccccagtcccagaattcccaggagtttccattcggtgatcagcactgaacacagaggactcaccatggagtttgggctgagcttgggttttcctgttgctattatagaggtgtccagtgtcaggtgcagcgttggtggaatcgtagggggngtcgttggtacaaggccgtgggacgggtcccngacgacttctcctggcgcacgccttcgtggtacttccaccttcaggtcggtcttaacttcagttggacgtcgttgggacctccccggaccgacgggtcctacccgggaaaggggggtaacgggggtccttcgggaccgttaggggtcggggtaccttaccccaaagttattaacgtttaggtacgtaccgttaaaggtcgggggaaactaaacccccngttaacctttccgacggacgtagaacccttgacgggtagaaaccgggggtcctaactttccacccgtagttaccccncccgggaaagggtaccaaaaccggcccgaaaactacttccacgttgtaaccttcgtacgaacgtaaattaccggaanaacggttactaaaacggaccgaccggaaaccgttaccggtccggtacccggttattaaccccggttttggacggttaacgggtacggtacgggttacgggggtaacgggtaacggtaaaccgggttacgggtacgg

SEQ ID NO: 421813 - DNA, 557 bp, Homo sapiens
  misc_feature: GZ8MTXP02JOSLD.51.37.D04.1.454.CMB.2.raw
  modified_base (280)..(280): a, c, t, g, unknown or other
  modified_base (362)..(362): a, c, t, g, unknown or other
  modified_base (382)..(382): a, c, t, g, unknown or other
  modified_base (410)..(410): a, c, t, g, unknown or other
  modified_base (448)..(448): a, c, t, g, unknown or other
  modified_base (523)..(523): a, c, t, g, unknown or other
  modified_base (537)..(537): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcttgggttttccttgttgctattatagaaggtgtccagtgtcaggtgcagctggtggaatcgtgggggagtcgttggtcaagccgtgggacgggtccccgagacctctcctgtgcagcctctggacttcaccttnagtgctacttcatgagctggactccgcaggctccggaggggagggctgctaggtggtctcgacctatagttagcgactaagngggataacccatattccagnagctcgtgtaggaacgggtccattcccncatccgtaccgagggaaccaaccgacaaacgaaacctntaaccttgtactcgtagaccaaagtcgaaactagtaccaaagcggtaacgagacgaccgtcgtcgttactcgtgngcggtggttagggnggacgacggtacgtacggcg

SEQ ID NO: 421814 - DNA, 735 bp, Homo sapiens
  misc_feature: GZ8MTXP02JLIUY.51.37.D04.1.454.CMB.2.raw
  modified_base (198)..(198): a, c, t, g, unknown or other
  modified_base (279)..(279): a, c, t, g, unknown or other
  modified_base (308)..(308): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagcgttgggttttccttgttgactattatagaaggtgtccagtgtcaggtgcagngtggtggaatcggtggggggagtcgttgggtacaaggtccgtgggacgggtccctggacgtacctctcgtgtgcagccctnggcttcgacctcgagtggcttaaccgttnatgacgtcgtcgaccgtccgaccgacggtccggtacggaaggggacgggcgtcggcggtaggttcggtactaccctagtattagttagtacgtaacgtaaggagggtaaaccaaacgtactagttaccgaacgaccgtacgtaccgtgtacggtaacgggaaccggtcccttacgttccctacgtaccgtacccggtaccggaaaccgggtaaacccaaaccggaaccctaaacggtaacccttacgtaaacgttacgttaactcgtaaacggtaaactaaacggtaaacgtaaaccgtaacgtaaacggaaacggtaaaccggaccggaaacggtaacccggtaccggtaccgttaacgttccggttacggtaggtaaccggagggttacggtacggggtacggaacgggtaccggtacggtacgg

SEQ ID NO: 421815 - DNA, 642 bp, Homo sapiens
  misc_feature: GZ8MTXP02F7N20.51.37.D04.1.454.CMB.2.raw
  modified_base (194)..(194): a, c, t, g, unknown or other
  modified_base (303)..(303): a, c, t, g, unknown or other
  modified_base (338)..(338): a, c, t, g, unknown or other
  modified_base (561)..(561): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttgggctgagtcttgggttttccttgttgcttattatagaaggtgtccagtgtcaggtncagctggtaggatcggtgggggagcgttggtacaaggccgtgggacggtccctagacgtacctctccgtgtcgcagcctctggtacttcacttcagtgcctactcatgngctggactccgacgagcctacgggaggggacgggnttggacgtgggtcggtcctacactagttattaggtgtaacttaggtcgggaacaacctatactacgtacgcgtaacgtcctagtacggtaagaccgggccttaactcctacctaatccccgtacggaacggaaccaaaccgaccgaaacgtaaccttcgacttagtactccgtaagaaccttaaagacgtaactaattacgaaaacggacggtaaccggaaanaacccggttacggtcgttacgttaccgttgacggtcggacggtacgtaggggtacggaaacggtacggtacggttaacggg

SEQ ID NO: 421816 - DNA, 717 bp, Homo sapiens
  misc_feature: GZ8MTXP02I6OVK.51.37.D04.1.454.CMB.2.raw
  modified_base (189)..(189): a, c, t, g, unknown or other
  modified_base (270)..(270): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcaccatggagtttggctgagcttgggtttccttgttgctattatagaaggtgtcagtgtcaggtncagcgtggtggaatcgtgggggagcgttggtcaagccgtgggacgggtccctgacgtactctccgtgtcgctacgccttgnggtacttcctaccttcgacggttcggtcccttacttccgaagttcggacgtcggttacggtaaccttccccggaccgtacgggaccgtacccgggaaagggggtaccggggtcgtcggacgtagggtcggtcctacgtactagttagttacggttgaaccgttaaggcgggggtaacaaacctaacttacgttaccgaacgacgtaacgtacgttcgtaacggaacgggtaaccgggtccgttacgttacctaccgtacttacccgaaccggacgggaaaccaaaccggaacctaaacggtaaccttacgtacgttagttaacctacgtacaaacttaaacacgaacgtagtaaaccgtaggaaccggacgtaaaagcccgtaagggtacctacgttacttcggtagtggcggtaggtacggtagggacgtaacgggtacgtaacgg

SEQ ID NO: 421817 - DNA, 670 bp, Homo sapiens
  misc_feature: GZ8MTXP02IJDKF.51.37.D04.1.454.CMB.2.raw
  modified_base (191)..(191): a, c, t, g, unknown or other
  modified_base (307)..(307): a, c, t, g, unknown or other
  modified_base (587)..(587): a, c, t, g, unknown or other
tcagcgatcgtatacacgaccggtgctcgatttagtagcatactgttgagctctgggagaagagccccagtcccagaattcccaggagtttccattcggtgatcagcactgaacacagaggactcacatggagtttgggctgagcttgggttttccttgttgctattatagaaggtgtccagtgtcaggtncagctggtggaatcgtgggggagtcttggtcaaaggccgtggggacggggtccctggacgacttctcctgtgcagccctctggtacttcaccttcagtcggactacttcatggacncgtggactccgccgaggcctaccggaaggggacgggctggcgtaggtcgggtcaccgaactattagttaggtgtactaaaggtcggggaaacgaacccatacgtttcaacgacgaagaccttgtacggtacggaaacgggtccgtaaactttcccaccctagtacccgtacccgaaacggggaacctaaaccggaccaaaacggaaacttcgaaccttagtacttacctagaacctaaaagtcgaaactagtaaccgaaaaggaccggaacccggtaaanaccggtaaccgggtaccgttcgttaaccgttcgtaggtcgggacgtaggttcggggaaggggaacgacggtaaacgtacgggg

SEQ ID NO: 421818 - DNA, 605 bp, Homo sapiens
  misc_feature: GZ8MTXP01CTWVS.10.21.B10.1.454.CMB.2.raw
  modified_base (386)..(386): a, c, t, g, unknown or other
  modified_base (391)..(391): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggcgtgggggtccctgagctctcctgttctgcgtctggattcattctttagtaaatctggcatgtcctgggtcccgccaggttccagggcccacggggctgggaatggggtggccaggatataacaataatgaatgaacaaagtaaaatataactanggganactccttacaagggtccattcacctatcctccaagtacaacaaacttacccgaaagaaactagtaggtagtaatctagactaaagtcgaaccctagccctaaggaacgcgggacccggaaagggtaccggtacgggggtttagtttttaagttaccggttaaggggtaggggtaaagtaaacttcccggttaagggttcgggttaacttaaccg

SEQ ID NO: 421819 - DNA, 556 bp, Homo sapiens
  misc_feature: GZ8MTXP01D618H.10.21.B10.1.454.CMB.2.raw
  modified_base (372)..(372): a, c, t, g, unknown or other
  modified_base (494)..(494): a, c, t, g, unknown or other
  modified_base (550)..(550): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcgtggttttcctcgttgctcttttaagagatgtccagtgtcagatgcagatggtggagtcgtgggggagcgtggtccggcgtgggggtcctgagctctcctgttctgcgtctggattcattctttagtaaatctggctagtcgtccgtggggtcccgccgagggttcccagggccacggggctaggagtgggtggccagatatacaataatgaatgaaanaagtaaaatataactagtagggatacttaccttacgaacgggcctatttaccacctaacttcaccaagaacaacaacttaccaaagtaacagttggtataatctagactaatagacacgccngagagacgacggacgtacggttgttgttagtgtaggtaagtaagtacgttagtggngtaacg

SEQ ID NO: 421820 - DNA, 631 bp, Homo sapiens
  misc_feature: GZ8MTXP01EZSIG.10.21.B10.1.454.CMB.2.raw
  modified_base (362)..(362): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtggggggtccctgagactctcctgttctgcgtctggattcatctttagtaaatctggcatgtcctggggtccgccaggttccagggcccacggggctggaatggggtggccagatatacaataatgntagaacaaagtaaatataactagtaggactacttaccttacgaacgggtcctattacccactactcctaccgaagacgaactaacttaccgaaagaactagttggtataactcgtagacctaaagtcgaaccgacgccgtaaggaaggaccggaccccggaaagggtaaccccggttaacgggggtttagtttttaaacgtttaccggttaaggggttaggggtaaacgttaaaacgttcccggttagggtaacgggttccgttaaccg

SEQ ID NO: 421821 - DNA, 515 bp, Homo sapiens
  misc_feature: GZ8MTXP01D35QM.10.21.B10.1.454.CMB.2.raw
  modified_base (307)..(307): a, c, t, g, unknown or other
  modified_base (370)..(370): a, c, t, g, unknown or other
  modified_base (379)..(379): a, c, t, g, unknown or other
  modified_base (386)..(386): a, c, t, g, unknown or other
  modified_base (411)..(411): a, c, t, g, unknown or other
  modified_base (455)..(455): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcgtgggggagcgtgttccggcgtggggggtccctgagctctcctgttctgcgtctggattcattctttagtaaatctggcatgtcctgggtccncaggttccaggccacgggctggaatgggtgccagatatacaataatgaatgaacagtaaaatntactatganactcttnaagggccgattacacatctacaganaacaattccaaagaacatgtgtatctgacaatgacagcctgagngccgaggactcgggttagtttattacgtggtgggaagtaactccgttagtcgggctaacg

SEQ ID NO: 421822 - DNA, 325 bp, Homo sapiens
  misc_feature: GZ8MTXP01BUFPJ.10.21.B10.1.454.CMB.2.raw
  modified_base (322)..(325): a, c, t, g, unknown or other
tcagcatagtagtgcacgaccggtgctcgatttagtgtcgtcgcaagagagagagggggggctgggaggcctttgttggagaccttgcacttgtactccttgccgttcagccagtcctggtgcacgacggtgaggacgctgaccacacggaacgtgctgttgaactgctcctccgtggtcaccgtctcttcggcctccaccaaggcccatcggtccttcccctggcgccctgctccaggagcacctccgagagcacagcggccctgggctgcctggcaaggctactcccatactatgctgagcggctggcaaggcgcatagnnnn

SEQ ID NO: 421823 - DNA, 321 bp, Homo sapiens
  misc_feature: GZ8MTXP01BA38G.10.21.B10.1.454.CMB.2.raw
  modified_base (317)..(321): a, c, t, g, unknown or other
tcagcatagtagtgcacgaccggtgctcgatttagtgtcgtcgcaagagagagaggggggggctgggaggcctttgttggagaccttgcacttgtactccttgccgttcagccagtcctggtgcacgacggtgaggacgctgaccacacggaacgtgctgttgaactgctcctccgtggtcaccgtctcttcggcctccaccaaggcccatcggtcttcccctgcgcctgctccaggagcacctccgagagcacagcggcctgggctgctgcaaggctactccatactatgctgagcggctggcaaggcgacatagnnnnn

SEQ ID NO: 421824 - DNA, 673 bp, Homo sapiens
  misc_feature: GZ8MTXP01A8RFT.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcgtgggggagcgtggtccggcgtgggggtccctgacgactctcctgttctgcgtctggattcatctttagtaaatctggcatcgtccgtgggtccgccaggtttccaggcccacggggctggaagtgggtgccagatagtacaatatgaatagaactaaagttaaaactattaactagtagggaacgtaccttcccgttacgaaacggggtccctaatttacccacctatttccacccgaagaacggaactaaacgttacccaaaaggtaaacctagttaggggttacgttaaatcccgtttaggaactaaaaacgttcgggaaaccctacggcccgttaaggaaacgggacggaccccgggaaagggttaacccggtaaccgggggttttaggttttaaactttaaccgggtgggttaggggaagtaaaactcccggttaggtaacgggaacttaaccg

SEQ ID NO: 421825 - DNA, 626 bp, Homo sapiens
  misc_feature: GZ8MTXP01CHZNO.10.21.B10.1.454.CMB.2.raw
  modified_base (579)..(579): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagagtgggtggagtcgtgggggaggcgtgggtccggcgtcgggggtccctggacgctctcctgttctgcgtctggtattcattctttagtaaatctggctattcgtccgtggggtcccgtccgtacggtttcccgagggtcccgacgggggtcgtagggaagtggggtgacccgaggattaagtacaaataagtagaatagaaactaaagttaaaatattaacgtagtagggaacgtaccttcccgttacgaacggggtcctatttaccaacctactcctaccgagaaacgactaacgttaccgaaagaactagttagggtatactcgtagacaaaagtcaaccacgcctggagacgccggaaggaccgtaggggttntttagttacgtggtagggaataaacgtccgttaggtcgttcgtaacg

SEQ ID NO: 421826 - DNA, 700 bp, Homo sapiens
  misc_feature: GZ8MTXP01C210N.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggccgtgggggtcctgagactctcctgttctgcgtctggattcattctttagtaaatctgcatcgtccgtgggtcccgcctacggttccacgggcccgacggggcgtggaagtgggtggccagatatacaataatgaatagaaactaaagttaaaaatataactagtagggtaacgtaccttacccgttacgaaacggggtccgtaacttaccaaccctaatcccgtacccgaaagaacgtaaacctaaactttacccggaaaacgtaaaccgtaatttacgggggtattaacgttccgttacggtaacctaaaacgttacggaaccccgaaggccccgttaagggaacggaacgggtaccccgggaaacgggtaaaccgggtaccgggggttttaagttttacggtttaaccggttggggtacggggtaaagtaaacggttcccgttaagggttaacggcgttaacccgg

SEQ ID NO: 421827 - DNA, 662 bp, Homo sapiens
  misc_feature: GZ8MTXP01D9507.10.21.B10.1.454.CMB.2.raw
  modified_base (207)..(207): a, c, t, g, unknown or other
  modified_base (315)..(315): a, c, t, g, unknown or other
  modified_base (373)..(373): a, c, t, g, unknown or other
tcagcatagtagtgcacgaccggtgctcgatttagtgtcgtcgcaagagaggaggggggaggaactgctcagttaggacccagagggaaccatggaagccccagctcagcttctcttcctcctgctactctggctcccagacaccaccggagaaattgtgttgacacagtctccagccacgctgttctttgtctccgaaggggaaancgccaccctctcctgcagggccagtcagagtgttcgctacgttcgttagggtgtatcaacataaactccggcaggctcccaggctcctcatctttgatgctttcaacncgggcccctggcgtcccaggcaggttcagtggctaggtgggtctgggacagtacttcnctctcaccatcagcacgcctagacgcctagaattattttagcttaggtttacttactgtcagcaggggtcgttagccctacggtttcgggacggtacgggtcgtacccgttaacggtttccgggggacgggtaaacggggtaaaccctaaaaaagggttaacgggttaaacggggttaaaccgaaaaaaccgggtaaaccgttggggttacgggttccgtttaccgggaaccctaacccgttaacgtttccgttcggttacccttttaaccgttaacgttttcccccgg

SEQ ID NO: 421828 - DNA, 640 bp, Homo sapiens
  misc_feature: GZ8MTXP01BG5XT.10.21.B10.1.454.CMB.2.raw
  modified_base (613)..(613): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagatgggtggagtcgtgggggaggcgtgggtccggcgtggggggtccctgacgactctcctgttctgcgtctggattcattctttagtaaatcgtggcagttcgtccgtcggggtcccgccgtacggttcccgaacgggcccgacgggggctagggaagtgggggtaggacctaggaatagtaactaagttaatggtaatagaaacgtaaagtaaaaattagttaacgtagttaggacgtaccttaccgttacgaacggggtacctaactttacccaacctactcctacccaagacaaactaacttaccgaaacggtaactacggttagttagtactacgtacgaaactaacgtccgacacgcgtaaggaacggacgtacgggaacgtacggtacgggtttagttcgttagnggtagaagtactcgttagtcgctaacg

SEQ ID NO: 421829 - DNA, 688 bp, Homo sapiens
  misc_feature: GZ8MTXP01B3NIY.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagagtggtggagtcgtgggggagcggtgggtccggcgtgggggtccctgagtctctcctgttctgcgtctggattcattctttaagtaaattcgtggctagtcgtccgtcgggtcccgtccgtacgggttcccacgggcccgacgggggtcgtgggaagttggggtcggaccaaggtataataactaataagtgaattagaaactaaagttaaaaatataaacgtagtaggacgtaccttaccgttacgaaacggggtcccgatttacccgaaccctactacctacccgaggaaactaactaaacttaccggaaacgtaaaccgtaattacgggtacgttactaccgtaggtaaacctaaagtaccgtaacccagtaccccgtaaggaaacggacggacccggaaagggtaacccgtaaggggtttacgtttagtttacgttggtagggtaacggtaaacgttacgttacggttaacgcgttaaccg

SEQ ID NO: 421830 - DNA, 525 bp, Homo sapiens
  misc_feature: GZ8MTXP01D819G.10.21.B10.1.454.CMB.2.raw
  modified_base (353)..(353): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggcgtgggggtccctgagactctcctgttctgcgtctggattcatcttagtaaatctggcatgtcctgggtccgccaggttccaggccacgggctggaatgggtgccagatagtacaataatgntgaacagtaaaatatactatgagactcctagaagggccattcacatctccagagacaattccgaaagaacatggtgtaatctagaccaaatcgacctagcctaagacgagccgaggacgtacggggttgtttattacgtggtagggtaagtaaatccgttaggtggcctaag

SEQ ID NO: 421831 - DNA, 593 bp, Homo sapiens
  misc_feature: GZ8MTXP01D40P4.10.21.B10.1.454.CMB.2.raw
  modified_base (317)..(317): a, c, t, g, unknown or other
  modified_base (387)..(387): a, c, t, g, unknown or other
  modified_base (425)..(425): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagtcttgggttttcctcgttgcttcttttaagagtatgtccagtgtcagatgcagatgggtggagtcgtgggggaggcggtggtccgggccgtggggggtccctggagtctctcctgttctgcgtctggattcattcttagtaatctggctatgtccgtgggtcccncgtacggttccaggcccgacggggccgaagtggggtgcagataatacaatatagatgacaaagtaaaatntactatggactactctacgaggcattcacatctcaganacaattaccaagggaactagtgtacgtatccgtagactaaatcgaacctacgtccctggaacgacggacccggaagggttaccgttaaccggggttattttacgttacgttagggttaagggaagtaaacgttcccggtaggttacgggtaaccttaacgttaacccg

SEQ ID NO: 421832 - DNA, 664 bp, Homo sapiens
  misc_feature: GZ8MTXP01CN5UY.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcttgggttttcctcgttgctcttttaagagatgtccagtgtcagatgcagatggtggagtcgtgggggagcgtggtccggcgtgggggtccctgagctctcctgttctgcgtctggattcattctttaagtaaatctggcatgtccgtgggtcccgcctaggttccagggtcccacggggcttaggaatggggtgaccaggatagtacaataatgaatgaaactaaagtaaaatataactagtaggacgtactccgttacgaagggccctaattaccaacctatcctacccaagaacgaactaaactttacccgaaaagtaaacctattaggggttattaataccgttaggaaactaaaacgttacgggaaccctaggaccccgttaagggaacggaccgggtacccgggaacgggtaaacccgtaacgggggttttacgtttttaagttaccgttaaggggtacgggggtaataaaacgtttcccgttaagggttcgggaaccttaaccgg

SEQ ID NO: 421833 - DNA, 598 bp, Homo sapiens
  misc_feature: GZ8MTXP01BCETV.10.21.B10.1.454.CMB.2.raw
  modified_base (370)..(370): a, c, t, g, unknown or other
  modified_base (482)..(482): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcgtgggggaggcgtggtccggcgtgggggtccctgacgactctcctgttctgcgtctggtattcattctttagtaaatcgtggctagtcgtccgtcgggtccgcctaggtccaggccgacgggctggaagtgggtaggccaggatataacaataatnaatagaactaaagtaaaatataactagtaggactactaccttacgaagggccattaccacctatctaccgagaacactaaacttaccgaaagaactagtgggtatactgtanactaaagtcgaaccctagccctaagaacgacggaccggaaggtaccgtacgggttttagtttacttacggttaaggacgggtaagttaacgtccgttagggtcgttaaccgttaag

SEQ ID NO: 421834 - DNA, 674 bp, Homo sapiens
  misc_feature: GZ8MTXP01CEG1Y.10.21.B10.1.454.CMB.2.raw
  modified_base (562)..(562): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagtcttgggttttcctcgttgcttcttttaaagagatgtccagtgtcagatgcagagtgggtggaggtcgtgggggaggcggtgggtccggcggtcggggggtccctgacgtctctcctgttctgcgtctggattccattctttaagtaaatcgtggctattcgtccgtggggtcccgcctagggttcccagggcccacggggtctagggaagtggggtgccagatatacaataatgaatggaaactaagttaaaatataactagtacggtaacgtaccttaccgttacgaaacgggggtccctaatttacccaacccgtacttccgtacccaagaaacgtaactaaaccgtttaccgaaaagtaacctaagttcgggttataacttccgtagaacctaaagttcgaaaccncggtacccgtaagaacggacggacccggaagggtaaccggttaacgggtttagttttacttacggttgggtagggtaaacgtaaacgttcccggttagtcgggaacttaacg

SEQ ID NO: 421835 - DNA, 581 bp, Homo sapiens
  misc_feature: GZ8MTXP01CKMLB.10.21.B10.1.454.CMB.2.raw
  modified_base (382)..(382): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagtcttgggttttcctcgttgcttcttttaagagatgtccagtgtcagatgcagatgggtggagtcgtgggggagcggtggtccggcgtgggggtccctgagctctcctgtctgcgtctggattcatctttagtaaatctggctatcgtccgtggggtcccgcgtaggttccagggcccacgggctggagtgggtgccagatataacataatgaatagaacaagttaaaatntaactataggactacttccgttacgaagggcctattacacctatcctacaagaacgactaaacttaccgaaagtaacctagtagggtataactcgtagactaaagtcgaactacgcctaaggaagacggccgaaggtacgtacggggttagtttacgttaggtggtagggtaactaaacttccgttaagtcggctaacg

SEQ ID NO: 421836 - DNA, 593 bp, Homo sapiens
  misc_feature: GZ8MTXP01BQN08.10.21.B10.1.454.CMB.2.raw
  modified_base (378)..(378): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcgtggtttcctcgttgctctttaagagatgtccagtgtcagatgcagatggtggagtcgtgggggagcgtgggtccggccgtgggggtccctgagactctcctgttctgcgtctggattcattctttaagtaaatctggctagtcgtccgtcgggtcccgccgtagggtttcccgacgggcccgacggggcttaggaagtcggggtggccaggatataacaataangaatgaaataagtaaaatatagtatgggatactccttacgaacggggtcctattaccaccctatccaccgagaacgtactaaacttaccggaaagtaaacctaagttgggtataatcttaggactaaactacgaccacgcccgtaagaagacggacgacggacgtacgggttagttagttacgtgtaggtaagtaagtaccttagtggcgtaacg

SEQ ID NO: 421837 - DNA, 598 bp, Homo sapiens
  misc_feature: GZ8MTXP01DKVIT.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggccgtgggggtccctgagtactctcctgttctgcgtctggattcattctttagtaaatcgtggcattcgtccgtcggggtcccgccgtacgggttcccacgggcccgacgggggtctagggaagtgggggtcggaccaggtaatagtaacaaattaatagaagtagaaactaaagtaaaatataactagtggaagtaccttccgttagaacgggtcctaattaccacctatcctacaagagaaactaacttaccgaaagtaactagttggtatatcgtagaacaaatcgaccagccgtaagacgacgccggaggtaacggtcgggtttagtttgttacggtgtaggaagtaactcgttagtcgctaag

SEQ ID NO: 421838 - DNA, 632 bp, Homo sapiens
  misc_feature: GZ8MTXP01AD2F8.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcttgggttttcctcgttgctcttttaagagatgtccagtgtcagatgcagatgggtggagtcgtgggggagcgtggtccggcgtgggggtcctgagctctcctgttctgcgtctggtattctattactttaagtaaattctggctagttcgtcccgtcggggtccccgaccgtacgggtttcccacgggcccgacgggggtcctaggggaagtgggggtggacccaggtataactaacaataatgaatgaaactaaagttaaaactatactagtaggacacttccgtacgaagggtcctattaccactatccaccgaagaacaactaaacgttaccgaaagtaacctgttacgggtattaacgtcctaaggaaccaaaagttcgaaacccctagacccgtggaacgagggacccgaaggtaacgtacgggttagttttattacggttaagggtaggaataacgtcgttacgtgcgtaacg

SEQ ID NO: 421839 - DNA, 605 bp, Homo sapiens
  misc_feature: GZ8MTXP01ALEUF.10.21.B10.1.454.CMB.2.raw
  modified_base (319)..(319): a, c, t, g, unknown or other
  modified_base (391)..(391): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagatgggtggagtcgtgggggagcggtgggtccggccggtggggggtccctggagactctcctgttctgcgtctggattcattctttaagtaaatctggcattcgtccgtggggtccnccgagggtttcccagggcccggcgggctgggagtggggtgccagatatacaatatgaatagacaagtaaatntactatgatactccttcgaacgggccgtattaccacctatcctaccgagacgaacaacttacccgaaagaaactattacggtagttatcgtacgaactaaagtcgaacccctagcccgttaaggaaggaccggaccggacgggtaacgtaagggggtttcttttagttacgttgggtagggtaacgtaaaacgtccgttaaggtcgcgttaacg

SEQ ID NO: 421840 - DNA, 569 bp, Homo sapiens
  misc_feature: GZ8MTXP01C63PV.10.21.B10.1.454.CMB.2.raw
  modified_base (420)..(420): a, c, t, g, unknown or other
  modified_base (425)..(425): a, c, t, g, unknown or other
  modified_base (462)..(462): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcgtggtttcgtcgttagctctttaagagatgtccagtgtcagatgcagatggtggagtcgtgggggagcgtggtccggcgtgggggtcctgagactctcctgttctgcgtctggattcattactttagtaaatctggctatcgtccgtcggggtcccgcacgggttccagggtcccgacgggcttaggaatgggggtgaccagatataacataatgaatgaataagtaaaatatatagtgatactctacgaacgggcattacacatcncaganaactaacttaccgaaatataatggtatactcgttaanacaactacgacgacgcgtaacgacgacggacggacggtaacggtacggttagtttagttacggtaaggtaggtaacgtaacgtacgttacgtaacgttaacgtaacg

SEQ ID NO: 421841 - DNA, 762 bp, Homo sapiens
  misc_feature: GZ8MTXP01A4AFE.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggtagtttgggctgagtcgttgggtttttcctcgttgcttacttttaagagatgtccagtgtcagatgcagagtgggtggaggtcggtggggggaggtcggtcgggtccgggtccggtcggggggtccctggacgtctcttccgtgttctggtcgtcgtggtattcattacgtttaagtaatctggctagtcgtcccgtcggggtcccgaccgtacggttcccgacgggcccgtacgggggtcctagggaacggtgggggtacggaccgtaaggtaattaacgtaaactaaattaaagtagtaagttaacggaaacttaaaaggttaaaaaacttagtaaacgttaaggtacgggtaacgttaaccttacccggtttaaaccggaaacgggggtacccctaatttaccccgaacctaacttacccgtaaccgaaagaaccgtaaactaaaccgttaaccaaaggtaaaccgttaagtacgggttataactacgtacggtaaacaaacgtaccgaacccgtacggtcccgtaaggaacgggaccggtaccggaaacgggtaccggttaacggttagtttacttaacggtaagggtacggaataacgtccgttagtcgaactaaccg

SEQ ID NO: 421842 - DNA, 643 bp, Homo sapiens
  misc_feature: GZ8MTXP01ETXOH.10.21.B10.1.454.CMB.2.raw
  modified_base (207)..(207): a, c, t, g, unknown or other
tcagcatagtagtgcacgaccggtgctcgatttagtgtcgtcgcaagagaggaggggggaggaactgctcagttaggacccagagggaaccatggaagccccagctcagcttctcttcctcctgctactctggctcccagacaccaccggagaaattgtgttgacacagtctccagccacgcttgtctttgtctccgaaggggaaancgcccaccctctcctgcagggccagtcagagtgttcgctacgttcggttagggtgtatacaacataaactccggcaggcctcccgaggtcctcctctattcttgattgtactttacaacgacgggtcccctggccgtccccgaggtctaggttcaggtcggcgtaggtcggggtctaggggactagtaacccttcaacctctacacctatcgagcacgcctagacgtctaggtaattattttagactttagtttacttacgtgtacagtctaggggtcgtcgtccgttacggtttcgggcggtaggttccgaccgttacggttcggggacggaacgggtaaacctaaaagtcggaaacggtaacaaaacggtacgttggttacggttcttacgaactacctaagttccgtcgttaccttaacgttaacgttccccg

SEQ ID NO: 421843 - DNA, 742 bp, Homo sapiens
  misc_feature: GZ8MTXP01CF4JQ.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagagtggtggagtcgtgggggaggcggtgggtccggccggtcgggggtccctggacgtctctcctgttctgcgtctggtattctattactttagtaaatcgtggctacgtcgtccgtcgggtcccgccgtagggttcccgagggtaccgaagggggtcgtaggaaggtggggtaggaccgtaaggtaataagtaaactaaagtaacgttagaagtagtaaactaaaagttaaaaaatattaacgtaagtacgggtaacgtaccgttaccgttaacggaacggggtaccctaactttacccaaccctaacgttaccctaccgaaacgtaacgtaaactaaactttaacccggaaaagtaaccgttaagttagggttacgttacgttaccgtaggtaaacctaaagtaccgaacccgtacgtacccgtaagggaacggacggacccgggaaaggtaaccggttacggggtttaagttttacgttacggttaaggggtaggggtaaacgttaacgttaccggttacggtcggttccgttaaccg

SEQ ID NO: 421844 - DNA, 523 bp, Homo sapiens
  misc_feature: GZ8MTXP01BXF4U.10.21.B10.1.454.CMB.2.raw
  modified_base (391)..(391): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggccgtggggggtccctgagactctcctgttctgcgtctggattcatctttagtaaatctggcatgtcctgggtccgccaggttccagggccacgggctggaatgggtggccaggatatacaataatgaatgaacagtaaaatatactatggagactccttnaagggccattcaccatctcagagacaattccgaaagacatggtatatctgactaaatcgaaccagcctgagagccgaggacgtacggggttgtttattacgtggtgggaataaagtccgttagtggcctaag

SEQ ID NO: 421845 - DNA, 609 bp, Homo sapiens
  misc_feature: GZ8MTXP01B78WJ.10.21.B10.1.454.CMB.2.raw
  modified_base (375)..(375): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgcttcttttaagagatgtccagtgtcagatgcagatgggtggagtcgtgggggagcgtggtccggcgtgggggtccctgagctctcctgttctgcgtctggattcattctttagaatctggctatcgtcctgggtccgccaggttccagggccacgggctggaatgggtgccagatatacaataatgaatagaactagttaaaactnttaactagtaggagtactcccgttacgaacgggccgtaattacccacctaacttcctaccaagaacgtaacaaactttacccgaaagaaacctatagggttactaagtccttaggaacctaaagtacgaaccacgccctaaggacgttacggacccggaaggtaaccgtcgggttagttttagttaaccgttgggtacgggtaagtaaacgttccgttaagttcgggccttaag

SEQ ID NO: 421846 - DNA, 658 bp, Homo sapiens
  misc_feature: GZ8MTXP01A0QIS.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggtttcctcgttgctctttaagagatgtccagtgtcagatgcagatgggtggagtcgtgggggaggcggtgggtccggcgtgggggtcctgagctctcctgttctgcgtctggtattcattcgtttaagtaatctggctagttcgtccgtcggggtcccgtccgtacgggttccgacgggtcccgaacgggggtcgttagggaaggttgggggtcggaccaaggtaataagtaaactaaagttaaagtagaagtaaggaaactaaaagttaaaactagtaactagtagggaactaccttaccgttacgaaacgggtcctaattaccaacctatccctaccgaagtaacgaaacctaacttaccggaaagaacctagtagggtactactctagaaccaaagttcgaccgataccgaagaacggacggacccggttaaggtaaccgttaggggttactttgttacggtgggagggtaactaaacgtccgttaaggtcgccgtaag

SEQ ID NO: 421847 - DNA, 672 bp, Homo sapiens
  misc_feature: GZ8MTXP01CNLJS.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagatgggtggagtcgtgggggaggcggtgggtccgggccgtggggggtccctggacgtactctctgttctgtcgtctggtattctattactttaagtaatcgtggctagtcggttccgtcggggtccccgccgtacgggttcccgacgggtcccgacgggggtcgtagggaaggtggggtggaccagatataacaataatgaatagaaactaaagttaaaatataacgtagtacgggtaacgtaccttacccgttaacggaacgggtacctaacttaccgaaaccctactacccgtaccgaacgaaacgtaacctaaactttaccgaaagtaaactagttaggtacgttactacgtagacctaaagtcgaaccctagccgtaaggaacggacggaccggaggtaaaccgtcgggtttagttttacgttacgtaagggtacggtaagtaacgttccgttaggtcgcttaacg

SEQ ID NO: 421848 - DNA, 743 bp, Homo sapiens
  misc_feature: GZ8MTXP01DK7G5.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcttgggttttcctcgttgcttcttttaagagtatgtccagtgtcagatgcagagtgggtggagtcgtgggggagcggtggtccggcgtgggggtcctgagctctcctgttctgcgtctggattcattctttaagtaaatctggctagttcgtccgttcggggtccccgccgtacgggtttcccgacgggcccgaacgggggtcgttgggaaagtgggggttcggacccgaaggtataagtaaccaaagttaatagaatagaaactaaagttaaaaatagtaactatacgggacgtaccttaccgttacgaacgggtccgtattaccacctactcctacccaagaagtaaccaaactttaccgaaaacgtaaccgtaagttacggggttattaacgttccttacgggaaacctaaaacgttacggaaaccccgaacggccccgttaaggaaacggttacggtaacccccgggaaaggggtaaacccggttaacgggggtttacgtttttaacgtttaaaccgggttaaggggtaagggggtaaacggttaaaacgttaccccgggttaaggttcgggaacctttaaacccgg

SEQ ID NO: 421849 - DNA, 595 bp, Homo sapiens
  misc_feature: GZ8MTXP01EPP9G.10.21.B10.1.454.CMB.2.raw
tcagcatagtagtgcacgaccggtgctcgatttagtgtcgtcgcagagagagggggagctctgggagaggagcgcagcactagaagtcggcggtgcctccattcggtgatcagcactgaacacagaggactcaccatggagtttgggctgagctgggttttcctcgttgcttcttttaagagatgtccagtgtcagatgcagatggtggagtcgtgggggaggcgtgggtccggccgtggggggtccctgacgactctcctgttctgcgtctggtattcatctttagtaaatctgctatgtcctgggtccgcctaggttcccaggccgacgggctggaagtgggtcggcagatatacaaatatgatgaacaagtaaaatataactagtaggatacctcttacgaagggcccgtaacttcaaacccacttccacccgaagtaacgactaaacgttccaaaagaacctagtaggtacgtatactagtacaaaattcgaacctacggcctaggaacggacgacccgggagggtacgttaaccggggtttgtttaacttaacgtgggtaacggaagtaaattccgtaagttcgggtaac

SEQ ID NO: 421850 - DNA, 669 bp, Homo sapiens
  misc_feature: GZ8MTXP01DLT9D.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcttgggttttcctcgttgcttcttttaagagtatgtccagtgtcagatgcagatggtggagtcgtgggggagcgtggtccggccgtgggggtcctgagactctctgttctgcgtctggattcattctttaagtaaatctggactagttcgtccgtcggggtcccgccgtaggttccgacgggccgacggggctaggaacgtggggtagccaggtatatacaatatagaatagaaactaaagttaaaatataacttagtacggtaagtaccttaccgttacgaacggggtacccttaattacccaaccctacttaccctaaccgaaaggaacaaacctaaacttaacccggaaaagtaaacttaagttagggtattaactcgtaggtaaaccaaagtacgaacccgacgtccgtaagggaacggacggaccgggaaggtaaacggttaacggggtttagtttaacgttaacggtgggtaagggaacgttaaacgtcccgttaggtcggaacttaaccg

SEQ ID NO: 421851 - DNA, 662 bp, Homo sapiens
  misc_feature: GZ8MTXP01EKLVQ.10.21.B10.1.454.CMB.2.raw
  modified_base (487)..(487): a, c, t, g, unknown or other
  modified_base (533)..(533): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagagactcaccatggagtttgggctgagcgttgggttttcctcgttgcttacttttaaaagatgtccagtgtcagatgcagatggtggagtcgtgggggagtcggtggtccgcgtgggggtccctgacgtctctcctgtctgtcgtctggattcattactttaagtaaattcgtggctagttcggtccctaggggtccccgtccgtagggtttcccacgggtccccgaagggggtcctagggtaagtcgggggtcgggactaacggtacttaagtacaaattagtacgtaatggaaactaaagttaaaaactacttaactaagtcgggtaactacctcgttacgaacgggtcctatcgaacctntctaccagaacaactaaacttccaaagggaaactagtagggtattntaccgtgaacctaaatcgaaccgtacgccgtaggaacgtaccggacggacggttaacgtacggggttatttacgttacggttagtaaggggtaataacgttccgtaggttacgtcgttaagttaacccg

SEQ ID NO: 421852 - DNA, 788 bp, Homo sapiens
  misc_feature: GZ8MTXP01AIO8U.10.21.B10.1.454.CMB.2.raw
  modified_base (257)..(257): a, c, t, g, unknown or other
  modified_base (265)..(265): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagagtggtggagtcgtgggggaggtcgtgggtccggcgtgggggtccctgagctcncctgttcngcgtctggattcattctttagtaaatcgtggctagtcgtccgtcgggtcccgccgtaacgggtttcccagggcccgtaccgggggtaccttggggaaacgttgggggtggaccccgtaggtaattaagtaaccaaagttaaatagaacgttagggaaactaaagttaaaaactagttaaccgtaagtagggacgttaacgtacccgtttacggaaacggggtccgtaattacccgaaacctacttacccttaaacccgaaggaaacgaaacccgttaaactttaaccccggaaaacggttaaaccgtaacgttacgggggttattaaaccttccgttacgggaaaacctaaacgttaccgaacccgttaaaccggcccgttaaggggaaaccggttaaccgggacccgggttaaaacgggggtaccccgttaaagggggttttacggttttaaccgttaacggttaagggttaacgggaaacgttaaacggttacccgttaagggttcgggaacctaaccggg

SEQ ID NO: 421853 - DNA, 724 bp, Homo sapiens
  misc_feature: GZ8MTXP01BLXB8.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagagactcaccatggtagtttgggctgagtcgttgggttttcctcgttgcttacttttaagagtatcgtccagtgtcagatgcagtgtggtggagtcggtggggcgtcggtcggtccggtcggtcggggtcctgacgtctctcgttgttcgtgtcgtcgtgtacttctaacgtttactttaaagtaaacttcgtcggtactagttccggttccggtcgggtccccgtacgtacgggttccgaccgggtccggtaccggggtgtagggtaaggtcggggtacgaccgtaagtaattaccgtaaataagttaaagtagaagttaacgtaaagtaaaagttaaaacttattacgtaggtacgtacgtaccttaccggtacggaacggtcctaacttaccactctaccgagaacgaacgtaactaacgttaacgaaagtaacgtggttaggtactacgttaccgagtaaacctaaaggtacccgtaacgaccggttacggtaaggaacgacccgggacgggttaacgtaccgggttaaggtttacgtttacgttcgggtaagggtaaacgtaacgtaacccgtggttagggtcaacgttaaccgg

SEQ ID NO: 421854 - DNA, 625 bp, Homo sapiens
  misc_feature: GZ8MTXP01BRAV6.10.21.B10.1.454.CMB.2.raw
  modified_base (320)..(320): a, c, t, g, unknown or other
  modified_base (379)..(379): a, c, t, g, unknown or other
  modified_base (381)..(381): a, c, t, g, unknown or other
  modified_base (591)..(591): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcgttgggttttcctcgttgcttcttttaagagatgtccagtgtcagatgcagatgggtggagtcgtgggggagcgtggtccggccgtggggggtccctggacgactctccgtgttctgcgtctggtattcattctttaagtaactcgtgcagtcgtccgtcgggtccnccgtacggttccagggcccgacgggtctaggaagtggggtgccaggtatagtacaatangntagaactaagtaaactatactagtaggactctaccttagaacggggtcctaattaccaacctacgttccaacccgaggaacctaaactaactttaaccggaaaacgtaacgtaagtttgggtacttaactcgttaggaactaaaagtccgaacccagtcccgtaaggaacgacggcccgaagggtaccgtagggttcgtttacttacggnggtaggaacttaaagtcccgttagtcggctaacg

SEQ ID NO: 421855 - DNA, 657 bp, Homo sapiens
  misc_feature: GZ8MTXP01BDIFN.10.21.B10.1.454.CMB.2.raw
  modified_base (352)..(352): a, c, t, g, unknown or other
  modified_base (371)..(371): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcgtgggggagcgtgggtccggcgtgggggtccctgagctctcctgttctgcgtctggattcattcttagtaatctggctatcgtccgtcgggtccgcctacgggttccacgggccacgggggtcgtaggtaagtggggngcccaggataatacaatangaatagaactaagtaaatatactagtagactactcgttacgaacggggtcctacgttaccacctagtccctacgtacgaacgtaacctaaacttacccggaaagtaaccgtagttggggttaatacgttctaacggtaaccctaaagttccggaacccgtaacgccccgttaaggggaacgaccgggttacgggaaacgggtaccgttaaccgggggtttagttttacgttaacgggtggttaacggggaagttaaaccgttccgttaagggtcgaacgttaaccg

SEQ ID NO: 421856 - DNA, 729 bp, Homo sapiens
  misc_feature: GZ8MTXP01A306A.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagtcttgggtttttcctcgttgcttcttttaaagagatgtccagtgtcagatgcagatgggtggagtcgtgggggagcggtgggtccggccgtggggggtccctgacgtacctctccgtgttctgcgtctggtacttctaattactttaagtaactcgtgctattcggtccgtggggtcccgaccgtacgggttccgacgggcccgtacggggtcgtagggtaacggtgggggtacggaccccgtaaggtaatttaacgtaaaccgtaaagttaacgttaggtaagtaacggtaaaacttaaaggttaaaaactacgtttaacgtagtacggggtaactaccgttacccgttacgaaacgggtcctaacttacccaacctacgtacccgtaacaagtaacgtaactaaacgtaccggtaaagaacgtagtgttacgtaactcgtagaactaaacgtcggaaccagtccgaaggaacgacgggaccggttacgggtaacggttaacggggttacttttaacgttacggtaagggtaacgggtaactaaaacggttccgttagggtccgttaactaacccg

SEQ ID NO: 421857 - DNA, 732 bp, Homo sapiens
  misc_feature: GZ8MTXP01CEHB4.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagtcttgggttttcctcgttgcttcttttaagagatgtccagtgtcagatgcagagtgggtggaggtcggtgggggaggtcggtcgggtcccgggccggtcggggggtccctggacgtaccttcgttccgtgttctggtcgtcgtaggtattctattctttaagtaatcgtggctagttcgtccgtcgggtcccgcgtacggttcccgacgggcccgacgggggtcgtagggtaacgtgggggtaggacccaaggtattaataacgtaataacgtagtaagtagtaaaccgtaaaggttaaaattacgttaacgttaaggtacgggtaaccgttaccgttacccggttaacggaaaccgggggtccctaacgttaccccaaccgtacttcccgtaacccgaagtaactaacctaaactttacccggaaaagtaaccgtagttagggttagttaactcgttagaacctaagttccgaaccgtacggtcccgtaaggaacggttacgggaaccggttaggtaacggttacgggttagtttagttacggtgggtaggaacttaacgtcgttagtcgaactaaccg

SEQ ID NO: 421858 - DNA, 529 bp, Homo sapiens
  misc_feature: GZ8MTXP02HMXWE.10.21.B10.1.454.CMB.2.raw
  modified_base (305)..(305): a, c, t, g, unknown or other
  modified_base (360)..(360): a, c, t, g, unknown or other
  modified_base (379)..(379): a, c, t, g, unknown or other
  modified_base (406)..(406): a, c, t, g, unknown or other
  modified_base (413)..(413): a, c, t, g, unknown or other
  modified_base (419)..(419): a, c, t, g, unknown or other
  modified_base (435)..(435): a, c, t, g, unknown or other
  modified_base (440)..(440): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcgtggtttcctcgttagctcttttaagagatgtccagtgtcagatgcagatggtggagtcgtgggggaggcgtggtccggccgtgggggtccctgagctctcctgttctgcgtctggattcatctttagtaaatctggcatgtcctgggtccncaggttccagggtccacgggctggaatggggtgccagatatacatatgatcgaanagtaaaatatactatgganactccttgaagggcctattcaccatcncagacanatacanaacatagtgtatctanacaanagacacgacgacgagacgacggacggacggtacggttacgttagttacgtaaggtaggtaacgtaacgtacgtacggtacgtacgtacg

SEQ ID NO: 421859 - DNA, 554 bp, Homo sapiens
  misc_feature: GZ8MTXP02HUI8W.10.21.B10.1.454.CMB.2.raw
  modified_base (358)..(358): a, c, t, g, unknown or other
  modified_base (412)..(412): a, c, t, g, unknown or other
tcagcatagtagtgcacgaccggtgctcgatttagtgtcgtcgcagagagaggggagctctgggagaggagcccagcactagaagtcggcggtgcctccattcggtgatcagcactgaacacagaggactcaccatggagtttgggctgagcgtggtttccgtcgttagctctttaagagatgtccagtgtcagatgcagatggtggagtcgtgggggaggcgtgggtccggccgtggggggtccctgagactctcctgttctgcgtctggattcatcttagtaaatctggcatgtcctgggtccgccaggttccaggccacgggctggaatgggtgccagatatacaatatgatganagtaaaataatatatagagactacttcaaggacggattacaccaactctcccanagacaattaccaaaacaacagtagtagtatactacgacaactacgacacgacgtacgacgacgaccggacggaacggtacggttacgtttaagttacgttaaggtagggtaacggtaaacgtacgtacgtacggtacgtacg

SEQ ID NO: 421860 - DNA, 497 bp, Homo sapiens
  misc_feature: GZ8MTXP02JL2HO.10.21.B10.1.454.CMB.2.raw
  modified_base (467)..(467): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctggttttcctcgttgtctttaagagatgtccagtgtcagatgcagatggtggagtctgggggaggcgtggtccggcctggggggtccctgagactctcctgtctgcgtctggattcatctttagtaaatctggcatgtcctgggtccgccaggttccaggcccacggggctggaatgggtggcagatatacaatatgatgacagtaaaatatactatggagactcttcaagggccgattcacatctccagagacaattccaaagaacatggtagtatctgcaaatgaccagcctgagagccgaggacacgggtnttatctgtggagaaactctagtaggcatcg

SEQ ID NO: 421861 - DNA, 561 bp, Homo sapiens
  misc_feature: GZ8MTXP02GY1EL.10.21.B10.1.454.CMB.2.raw
  modified_base (260)..(260): a, c, t, g, unknown or other
  modified_base (303)..(303): a, c, t, g, unknown or other
  modified_base (349)..(349): a, c, t, g, unknown or other
  modified_base (368)..(368): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggccgtgggggtccctgagctctcctgttcngcgtctggattcattcttagaatctggcatgtcctgggtcccncaggttccaggccacgggctggaatggggtgccagatatacaatangatgaactaaagtaaaatntaactagtaggaacgtactacccttagaaacggggtcctaatttaccaaccctatcctaccaagtaacgaaactaaacttaccaaagaactatgggtatatcgtagacaaatcgaccagcctagacgagccgaggacgtacgggttcgtttattacgtggtagggaagtaaactccgtaaggtcggactaacg

SEQ ID NO: 421862 - DNA, 587 bp, Homo sapiens
  misc_feature: GZ8MTXP02H3XOR.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcggtgggtccggcgtggggggtccctgagactctcctgttctgcgtctggattcatctttagtaaatctggctatgtcctgggtccgcctaggttccagggccgacgggctaggaagtggggtgccaagatataacaatatgatgaaacaagttaaaaatataactaataggaagtattccttacgaaaggggtcccatttcaaccacttccaccagaacaaactaattaccaaagaacatgggtatatactagacaaatcgaaccagcctagaacgaggacccgaaggtaccgtaacggggttagtttaacgtacgttggtaacggggaaagtaaaacgttcccgtaaggttacggtacctaacg

SEQ ID NO: 421863 - DNA, 581 bp, Homo sapiens
  misc_feature: GZ8MTXP02IXFO6.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtgggtccggccgtgggggtccctgagctctcctgttctgcgtctggattcattcttagtaaatctggcatgtcctgggtccgccaggttccaggccgacgggctggaatggggtgccagatatacaatatgatgaacaagtaaaatataactaagtggaagtacctaccttacgaaacggggccctaattaccacctatcctacccaagaacgaacctaaattacccaaaagtaaccagtgggtataatctagactaaatcgaaccagcctaggagacggccggaaaggaccgtacggggttatttaacgttacgtaaggttacgggaaagtaaaacgtccgtaaagtcggactaacg

SEQ ID NO: 421864 - DNA, 540 bp, Homo sapiens
  misc_feature: GZ8MTXP02JNG7G.10.21.B10.1.454.CMB.2.raw
  modified_base (301)..(301): a, c, t, g, unknown or other
  modified_base (449)..(449): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggcgtgggggtccctgagactctcctgtctgcgtctggattcatctttagtaatctggcatgtcctggtccncgaggttccaggccacgggctggaagtggggtgaccagatatacaatatgatgaactagtaaaactatactatggactactccttacgaacgggccgattacaccatctcagacgacaatacaagaacatggtatatctagactaaancgaccgagccctagacgacgaccggaggaccgtacggggttatttacgttacgtggtagggtaagtaacgtaccgtaaggtcggactaacg

SEQ ID NO: 421865 - DNA, 619 bp, Homo sapiens
  misc_feature: GZ8MTXP02HYFAY.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtccctgagctctcctgttctgcgtctggattcattctttagtaatctggcattcgtccgtgggtcccgcgtaggttcccacgggcccgacgggctggaagtggggtgccagatagtacaatatgatgaactaagtaaaatatactataggatattcctagaacgggtcctattcacctatcctaccagacgaactaacttaaccaaaggtaaacctagttagggtacttactaccgtagaactaaaagtacgaaccgtacgtacccgtaggaaacggacggacccggaagggtaaccggttacgggggtttattttaacggttacggtaagggttaaggggaaacgttaaaacgttaccgtaaggtcggtaactaacg

SEQ ID NO: 421866 - DNA, 515 bp, Homo sapiens
  misc_feature: GZ8MTXP02G6LFH.10.21.B10.1.454.CMB.2.raw
  modified_base (398)..(398): a, c, t, g, unknown or other
  modified_base (421)..(421): a, c, t, g, unknown or other
  modified_base (487)..(487): a, c, t, g, unknown or other
tcagcatagtagtgcacgaccggtgctcgatttagtgtcgtcgcaaaagagagggggtctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggagcgtggtccggccgtgggggtccctgagctctcctgttctgcgtctggattcatctttagtaaatctggcatgtcctgggtccgccaggttccaggccgacgggctggaagtgggtggcagatatacaatatgatgaacagtaaaatatactatggagactccttcaaggccatcacatcnccagagacatccaaagacatgtntatctagacaaatgaccagcctagacgacgccgaggactacgggtgtttaactcgtaggtgggaanaaagtctaaggtcggcactcacgttagg

SEQ ID NO: 421867 - DNA, 593 bp, Homo sapiens
  misc_feature: GZ8MTXP02HBFX9.10.21.B10.1.454.CMB.2.raw
  modified_base (301)..(301): a, c, t, g, unknown or other
  modified_base (336)..(336): a, c, t, g, unknown or other
  modified_base (342)..(342): a, c, t, g, unknown or other
  modified_base (546)..(546): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggagcgtgttccggccgtgggggtccctgagactctcctgttctgcgtctggattcatcttagtaatctggcatgtctgggtccncaggtccaggccacggctggatgggtgccagatanacatangatgaacaagtaaaatataactataggatactccttacgaagggccattacaccatccgtaccaagacaactaaacttacccaaagtaaccaagttgggtagtaactccgtaggaacctaaaatcggaaaccctagacccgttaggaacggaacgcccgggaaagggtaacccgtaacgggggtttattttaacgtttaaacgnggggttacggggaaataaaacgttcccgtaaggttacggacctaacg

SEQ ID NO: 421868 - DNA, 644 bp, Homo sapiens
  misc_feature: GZ8MTXP02JFFPV.10.21.B10.1.454.CMB.2.raw
  modified_base (301)..(301): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggcgtgggggtccctgagctctcctgttctgcgtctggattcatcttagtaatctggcatgtcctgggtccncaggttccaggccacgggctggaatcggggtgccgagagtataacatatgatgaacaagtaaaatataactataggagacttaccttacgaacgggtccgtaatttacaacccatcctaccagacgaaactaaactttacccgaaaagtaaaccagttacggggttattaaacgttccttaggaaccgtaaaattcggaaaccctaacggacccctttagggaacggaaagggcccccgggtaaaaggggaccgtaaccgggggtttagtttttaacgttaaccggttaaggggtagggggtaaacgtaaaacgttcccgttaaaggtcgggtaacttaaccg

SEQ ID NO: 421869 - DNA, 655 bp, Homo sapiens
  misc_feature: GZ8MTXP02IMD4S.10.21.B10.1.454.CMB.2.raw
  modified_base (259)..(259): a, c, t, g, unknown or other
  modified_base (306)..(306): a, c, t, g, unknown or other
  modified_base (357)..(357): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggccgtgggggtccctgagctctctgttcngcgtctggattcattcttaagtaatctggcattgtccgtgggtcccncgtaggttccacgggccacgggctaggagtggggtgccagatatacaatangatagaactaaagttaaaatattaactagtaggaagtaccttacccttacgaaacggggtcctaatttacccaacctactacctaccgaacgtaacgaaacctaaacttacccgaaaagtaaacgtagttagggtactaacgtccttaggaacctaaaagtcgtaacccgacgtacccgttagggaacggacggaccgggaaacgggtaaccggttacgggggtttacgtttttaacgttacgttaaggggtaggggaaaacttaaaacggttccgttaaggttacggtactaaccgg

SEQ ID NO: 421870 - DNA, 553 bp, Homo sapiens
  misc_feature: GZ8MTXP02FZUP0.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggccgtgggggtccctgagactctcctgttctgcgtctggattcatctttagtaaatctggcatgtccgtgggtcccgcctaggttcccagggtccacggggctgggaagtggggtggccagatagtacaatatgatgaacaagtaaaaatataactatagggagacttccttacgaagggccgattacaccatcctacagagacaaattccaaagaactatggtagtatctagacaaaatcgaacagcctagagagcgaggacgacgggttattagttacgtaaggttagggaaacgtaaacgttccgtaaggtcggactacg

SEQ ID NO: 421871 - DNA, 597 bp, Homo sapiens
  misc_feature: GZ8MTXP02F7BL7.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcggtggtccggcgtgggggtccctgagctctcctgttctgcgtctggattcattctttagtaatcgtggctagtcgtccgtgggtcccgccgtagggttcccacgggcccgacggggtctaggggaacgtggggtggccaagtatataacaatatgatagaactaaagttaaaatataactagtaggaactaccttccttacgaacggggtcctaattaccacctatcctaccgaagacgtaactaaacttaccaaagtactagtgggtatactcgtagactaaatcgaaccagtcctaggaacgacggaccggaaggtaccgtacgggttactttacgtacgtggtaggaactaaacgtcgtaggtcgactacg

SEQ ID NO: 421872 - DNA, 553 bp, Homo sapiens
  misc_feature: GZ8MTXP02HMYO0.10.21.B10.1.454.CMB.2.raw
  modified_base (411)..(411): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggagcgtggtccggccgtggggggtccctgagactctcctgttctgcgtctggattcatctttagtaaatctggcatgtcctgggtccgccaggttcccagggtcccagggctggaagtggggtggccagatatacaatatgatgaacaagtaaaatataactatggatactccttacgaagggcctattcaccntctccagacgaactaacttaccaaagaactatgggttatatctgaacaaatcgaccagccctaagagacggacccggaagggacaccggggttgtttaactacggtggtagggaacgtaaactccgtaggtacggactaacg

SEQ ID NO: 421873 - DNA, 531 bp, Homo sapiens
  misc_feature: GZ8MTXP02IOB9G.10.21.B10.1.454.CMB.2.raw
  modified_base (346)..(346): a, c, t, g, unknown or other
  modified_base (348)..(348): a, c, t, g, unknown or other
  modified_base (379)..(379): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggtttcctcgttgctcttttaagagatgtccagtgtcagatgcagatggtggagtcgtgggggagcgtggtccggccgtgggggtccctgagactctcctgttctgcgtctggatcattcttagtaatctggcatgtcctggtccgcaggttccaggccacgggctggatgggtgccagatatacatatgntnaacaagtaaaatatactatggatactccttnaagggccagttacacctatctacagagaactaattaccaaagaacatgggtatactctagacaaaatgaaccagcctagacgacgacgaaggacgtacgggttagttacttacgtaaggtacggaataaacgtaccgtaggtacgacgtacg

SEQ ID NO: 421874 - DNA, 581 bp, Homo sapiens
  misc_feature: GZ8MTXP02H8OEE.10.21.B10.1.454.CMB.2.raw
  modified_base (532)..(532): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgcttcttttaagagatgtccagtgtcagatgcagatggtggagtcgtgggggaggcgtgggtccggcgtgggggtccctgagctctcctgttctgcgtctggattcattcttagtaatctggcatgtcctgggtccgcacggttccacgggccgacgggctaggtaagtggggtgccagtaatatacaaattatgatgaaacaaagtaaaattataactatggaactactccttacgaacggggtccaatttccgaacctatcctaccagaacgaaactacgttaccaaaggtaaactagtgggtagtatcgtagaactaaagtcgaaccagccctagacgcgaccgaaggacgtacggggttntttaacgtagtggtagggaaacgtaactaccggtagtacggtactaacg

SEQ ID NO: 421875 - DNA, 622 bp, Homo sapiens
  misc_feature: GZ8MTXP02JGTRX.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtgggtccggcgtgggggtccctgagctctcctgttctgcgtctggattcattctttagtaaatctggcatcgtccgtgggtcccgccgtacggttccacgggcccgacggggctagggaagtggggtgccagatataacaatatgatgaactaagtaaaaatataactaatacggaagtacctacccgttacgaaacggggccgtaactttaccacccacttaccttacccaaagaacgtaaacctaaactttacccaaaagaaacctaagttacgggttagtaacttcgttagactaaaattacgaaccacgcctaggaacgtacggaccgaggaaccgtacggggttagttttaactacgtggtaggaacgtaactaccgtaggtacggactaacg

SEQ ID NO: 421876 - DNA, 539 bp, Homo sapiens
  misc_feature: GZ8MTXP02HORXU.10.21.B10.1.454.CMB.2.raw
  modified_base (363)..(363): a, c, t, g, unknown or other
  modified_base (420)..(420): a, c, t, g, unknown or other
  modified_base (497)..(497): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtccctgagctctcctgttctgcgtctggattcattctttagtaaatctggctatgtccgtgggtcccgccgacggttccagggcccgacgggctgggaatggggtggccagatatacaatangatgaacaagtaaaatataactatggatactccttacgaaggccattcacctatccncagacgaactaagttaccaaagaacagtggtagtatctagacaaagtgacagcctagagagccgaggactacgggtntttatacgtggtagggaactaaacgtcgtagtcggtactaac

SEQ ID NO: 421877 - DNA, 535 bp, Homo sapiens
  misc_feature: GZ8MTXP02JH7LZ.10.21.B10.1.454.CMB.2.raw
  modified_base (493)..(493): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggccgtgggggtccctgagactctcctgtctgcgtctggattcatctttagtaatctggcatgtccgtgggtccgcctaggttccacgggccacgggctggaagtggggtggccagatatacaatatgatgactaagtaaaatataactatggagacttacccttcaaggggcccattcacccaatctaccagacgacaattccaaagaaccatgggtatatctagacaaatgaaccagcctgagacgccgaggactacgggtntttaatacgtgtagggtaacaaactccgtaagtcggactacg

SEQ ID NO: 421878 - DNA, 570 bp, Homo sapiens
  misc_feature: GZ8MTXP02FUCQD.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtccctgagactctcctgttctgcgtctggattcattctttagtaatctggcatcgtccgtgggtcccgccgtaggttcccacggccgacggggctagggaagtggggtgcccagatatacaatatgatagaactaagtaaaatatactatggatactccttacgaagggcccatcaccatctccagtagactaactaccaagaacatgggtatatctagactaaatcgaaccagccgtagacgaggacccggagggaacccgtacgggggttactttaagttaacgtggttaagggaaggtaaaactccgttaaggtcggactaaccgg

SEQ ID NO: 421879 - DNA, 586 bp, Homo sapiens
  misc_feature: GZ8MTXP02F6I6Q.10.21.B10.1.454.CMB.2.raw
  modified_base (367)..(367): a, c, t, g, unknown or other
  modified_base (369)..(369): a, c, t, g, unknown or other
  modified_base (496)..(496): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcggtggtccggccgtgggggtccctggagctctcctgttctgcgtctggattcattctttagtaaatcgtggcattcgtccgtggggtcccgccgtaggttcccagggcccacggggctggaagtggggtgccagatatacaatangntagactaaagtaaaatataactagtgaataccttaccttcgaaacgggccgtattccacctatacctccaagacgaactaaattaccaaagtaacagttaggtagtaatctagactaaatcgaaccngacctaggacgacggacccggaaggacgtacgggtttagtttaacttacgtaaggttaggggaaataaacgtccgtaagtcggactaacg

SEQ ID NO: 421880 - DNA, 582 bp, Homo sapiens
  misc_feature: GZ8MTXP02HDWLG.10.21.B10.1.454.CMB.2.raw
  modified_base (515)..(515): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggcgtgggggtccctgagactctcctgttctgcgtctggattcattctttagtaatctggcagtcgtccgtcgggtcccgccgtaggttccagggccgacgggctggagtggggtgccagatatacaatatgatagaaactaagttaaaaatataactaagtaggtaacgtacttacccgttagaacggggccgtaatttaccaaccacttacctaccaagaacgaactaaacttaccaaagtaacagttaggtagtatccgtagacaaatcgacagcctagacgngaccggaggacgtacgggttactttaagttacgtggtaggaacgtaacgtccgtagtcggactaacg

SEQ ID NO: 421881 - DNA, 685 bp, Homo sapiens
  misc_feature: GZ8MTXP02GPEOS.10.21.B10.1.454.CMB.2.raw
  modified_base (327)..(327): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgcttcttttaagagtatgtccagtgtcagatgcagagtggtggagtcggtgggggagcggtggtccggccggtgggggtccctgacgctctcctgttctgcgtctggtacttcatttactttaagtaaactcgtggctagttcggtccgtcgggtcccncgtacggttcccgacgggccgtacgggtcgtagggtaacgtggggtcggaccagtattaacgtaactaaattagtagagtagaaacgtaaaagttaaaactaagttaacgtaagtacgggaaactaccgtttaacccgttacggaaacggggtccctaatttacccgaaccctagttaccctaccgaaagtaacgtaaacctaaacttacccgaaaagtaactagttacgggttactaacttccgtaagaactaaaacgtcgtaaccacgtaccgtaggacgacggaccgtaagtaccgtacgttacgtttagtttaacgtaacggttagaagggtaaactaacgtcgtaggtcgaac

SEQ ID NO: 421882 - DNA, 584 bp, Homo sapiens
  misc_feature: GZ8MTXP02F8SB4.10.21.B10.1.454.CMB.2.raw
  modified_base (352)..(352): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcggtggtccggcgtgggggtcctgagctctcctgtctgcgtctggattcattctttagtaatctggctagtcgtccgtgggtccgccgtaggttccacgggccacggggctgggatggggtgccagatanacaatatgatgaactaaagtaaaatataactagtgggaataccttccttacgaacgggccgtaatcacctatccacagagaactaacttaccaaagtaactagtcggttagtactcgtagtacaaaagtcgaaccgagcctaggacggacgacccggaagggtaccgtacggggttatttacggttaacgtgggtaagggaaaccgtaaagtccgtaaggtcggtactaacg

SEQ ID NO: 421883 - DNA, 330 bp, Homo sapiens
  misc_feature: GZ8MTXP02HGX0T.10.21.B10.1.454.CMB.2.raw
  modified_base (327)..(330): a, c, t, g, unknown or other
tcagcatagtagtgcacgaccggtgctcgatttagtgtcgtcgcaagagagagagggggggctgggaggcctttgttggagaccttgcacttgtactccttgccgttcagccagtcctggtgcacgacggtgaggacgctgaccacacggaacgtgctgttgaactgctcctcccgtggtcaccgtctcttcggcctccaccaaggcccatcggtcttcccctggccgcctgctccaggagcacctccgagagcacagccggccctgggctgcctggtcaaggctacttcccactactatgctgagcgggctggcaaggcgcatagnnnn

SEQ ID NO: 421884 - DNA, 688 bp, Homo sapiens
  misc_feature: GZ8MTXP02F73PW.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggccgtggggtccctgagctctcctgtctgcgtctggtattcattactttaagtaatcgtggctagttcggtcccgtgggtcccgccgtagggttcccagggcccgacggggtctaggggaagtggggtggaccgagtatataacgtaatagtgagtagaaactaaagttaaaattataacgttagtaggtaaacgtacctttacccgttacggaaacggggtacccgtaattacccaaccctataccctaccgaaagacgtaaacctaacttacccgaaaagtaacctagttagggttattacttaccgtagtaaccgtaaaattcggaaaccctagtacccgtaggaacggacggaccgggaaaggttaacccggtacggggtttaagtttaacgtttaccggtaagggttaacgggaaacgtaaaccgtttaccggtaaggttccggactttaacg

SEQ ID NO: 421885 - DNA, 589 bp, Homo sapiens
  misc_feature: GZ8MTXP02GEJL4.10.21.B10.1.454.CMB.2.raw
tcagcatagtagtgcacgaccggtgctcgatttagtgtcgtcgcaagagaggaggggggggagaggagcccagcactagaagtcggcggtgcctccattcggtgatcagcactgaacacagaggactcaccatggagtttggctgagcttgggttttcctcgttgcttcttttaagagatgtccagtgtcagatgcagatgggtggagtcggtgggggaggcggtgggtccggccggtcgggggtccctggagtactctcctgttctgcgtctggattcattctttagtaaatctggcatgtccgtgggtcccgccgtaggttccaggcccgacggggctgggagtggggtgcagatataccaatatgatgaactaagtaaatataactagtagggactacttccttacgaaacggggcctattccaacacttcctacagaacgaactaacttaccaaagtaacagtggtacgtatctagacaaaagtcgaaccagcctagacgagccgaagggtactaggggttctttaagttacgtaggtagggaacgtaaaactccgtaagtcggactactccgtacgttgttacg

SEQ ID NO: 421886 - DNA, 621 bp, Homo sapiens
  misc_feature: GZ8MTXP02GGU1F.10.21.B10.1.454.CMB.2.raw
  modified_base (258)..(258): a, c, t, g, unknown or other
  modified_base (304)..(304): a, c, t, g, unknown or other
  modified_base (513)..(513): a, c, t, g, unknown or other
  modified_base (560)..(560): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggcgtgggggtcctgagctctcctgttcngcgtctggattcatctttagtaaatctggcatgtccgtgggtcccnccaggttccagggccacggggctgggaatggggtggaccgagatataacaatatgatgaactaaagttaaaatagtaactaagtggaacgtaccttaccgttacgaaacggggtccctaattaccaaccctatacctaccaagaacaaactaaacttaccaaaagaaactagttgggtatacttacgtagaacctaaaagtcgaaaccngccctaaggacggacggacccggaagggtaaccgtaaccgggggttntttaacgtttaccggtaagggttaagggaagtaaaacgtcccgtaggtacggacgttaacg

SEQ ID NO: 421887 - DNA, 656 bp, Homo sapiens
  misc_feature: GZ8MTXP02HVSO0.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggcgtgggggtccctgagctctcctgttctgcgtctggattcattctttagtaaatctggctatgtcctgggtcccgctagggttccagggcccagggctgggaatcggggtgccagatatacgatatgatagaactaaagtaaaatataactatacggagtaacctccgttacgaacgggcccgtaatttcccgaaccctattccacccgaagaacgaaactaaactttaaccgaaaagtaacctagttagggtattaacgtccgtaggacctaaaagttcggaaaccctaggacccttagggaagaccgggacccgaaacgggtaaacccgttacgggggttaacgttttaacgttaaccggtaagggtttaaggggaaaacgttaaaacgtacccggtttaaggttacgggtaaccttaaccgg

SEQ ID NO: 421888 - DNA, 692 bp, Homo sapiens
  misc_feature: GZ8MTXP02IJBCG.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtccctgagactctctgttctgcgtctggattcattcttaagtaaatctggcattcgtccgtggggtcccgccgtagggttcccagggccgaacgggctagggaagtggggtgccagatatacaatatgatgaacaagtaaaatatactatggaatactaccttacgaagggaccattacaccctatcctaccagaacgaactaaacttaccaaagtaaacagtacggttaagtacgtacttacggaactaaaacgttacgaaacccgtaacggaccccgttaagggaaacggtaaccggacccgggtaaaacggggtaaacccggttaaccgggggtttaacgtttttaaacggtttaaacccggttaacgggggtttaaacgggggtaaaaggttaaaaaccggtttaccccggtttaaagggtttaaacggggtaccctttaaaaccgg

SEQ ID NO: 421889 - DNA, 677 bp, Homo sapiens
  misc_feature: GZ8MTXP02H6CP1.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgcttcttttaagagatgtccagtgtcagatgcagatggtggagtcgtgggggaggcgtggtccggccgtgggggtccctgagactctcctgttctgcgtctggattcattcttagtaatctggcattgtccgtcgggtcccgccgtacgggttccagggcccgacggggctagggaacgtggggtggccaggatataactaatatgatgaaactaaagtaaaatataactagtaggaacgtacctaccgttacgaacggggtacccgtaactttaccaaccctaacttccctaacccgagaacgtaactaaactttacccgaaaacggtaaacctaagttagggttacgttaactacgtacgtaacaaaacgttaccggaacctaacggtacccgtaaggacggtaaacgggacccgaaaggggtaaccgtaacggggtttagttttaacgttacggttaagggtacggggtaaaactaaacggttaccgtaagggtacggtactaacg

SEQ ID NO: 421890 - DNA, 562 bp, Homo sapiens
  misc_feature: GZ8MTXP02G7OEP.10.21.B10.1.454.CMB.2.raw
  modified_base (368)..(368): a, c, t, g, unknown or other
  modified_base (379)..(379): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggcgtggggtccctgacgctctcctgttctgcgtctggattcatctttagtaatctggcagtgtcctgggtccgcctaggttccaggccacgggctggaactggggtgccagatatacaatatgatgacaagtaaaatntaacatggaanactcctagaggccattacaccatctaccaagacgaacaacgttaccaagtaacagttagggtatacttctaggactaaagtacgaccacgccttaaggacgacgacccgaagggaaccgtacggggttatttaacgttagtaacggtagggaaagtaaacgtaccgtaggtacggtactaacg

SEQ ID NO: 421891 - DNA, 534 bp, Homo sapiens
  misc_feature: GZ8MTXP02FU84V.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtctgggggaggcgtggtccggcctgggggtccctggagactctcctgttctgcgtctggattcatctttagtaaatctggcatgtcctgggtccgccaggttccaggccacgggctggaatggggtgccagatatacaatatgatgacaagtaaaatataactatggagtactcccttacgaaacgggccgatttccacctatctacccagacgaccaaattcccaaagaacatgggtgtaatctgacaaatcgacagcctagagagccgaggacacgggtgtttatacgtggtggggaataaacgtccgtaggtcggactacg

SEQ ID NO: 421892 - DNA, 619 bp, Homo sapiens
  misc_feature: GZ8MTXP02FO8CU.10.21.B10.1.454.CMB.2.raw
  modified_base (260)..(260): a, c, t, g, unknown or other
  modified_base (302)..(302): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcgtgggttttcctcgttgctcttttaagagatgtccagtgtcagatgcagatggtggagtcgtgggggagcgtggtccggcctgggggtccctgagctctcctgttcngcgtctggattcatcttagtaatctggcatgtcctgggtccncaggttccaggccacgggctggatgggtgccagatatacaatatgatgacaaagtaaaatataactatggaagacttacccgttacgaaacgggggccctaatttaccacccctaattccctaccaaagagtaaacctaaactttaacccgaaaaggaaaccattaggggtagttaaattaccgtagacctaaaaagtcgaaaccccgtaaggccctaggaaggaacggacccggaagggtaaccgtaccgggggttatttaagttaaccgtgggtagggtaaacgtaaaacttcccgttaacggtggacctaaacg

SEQ ID NO: 421893 - DNA, 603 bp, Homo sapiens
  misc_feature: GZ8MTXP02JQB7S.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggcgtgggggtccctgagactctcctgttctgcgtctggattctattctttagtaaatctggctagtcgtccgtcgggtcccgcgtacggttcccgacgggtcccgacgggcgtgggtaacgtggggtggacctaggataatactaaatatagatagaactaaagttaaaatataactagtaggacgtaccttaccgttacgaacggggccctaattaccacctactacccgtaccgaagacgaacctaacttaaccaaacgtaacagttacgggtagttactcttagaactaaagtcgaccagaccgtgagacgacgaggacgtacggttgttacgttacgtgtaggtaacgtaactcgtagtcggactacg

SEQ ID NO: 421894 - DNA, 558 bp, Homo sapiens
  misc_feature: GZ8MTXP02JW0HB.10.21.B10.1.454.CMB.2.raw
  modified_base (306)..(306): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatgggtggagtcgtgggggagcgtgggtccggccgtgggggtccctgagactctcctgttctgcgtctggattcatctttagtaatctggcatgtcctgggtccnccgtaggttccagggcccacgggctggaagtggggtgccagatatacaatatgatgaactaagtaaaatatactatagggatactccttagaacgggccaattcacctatcctacagagaactaacgttaccaaagaactagtacgggtatactcgtagactaaagtcgacagcctagacgcgacggacggacgtacgggttatttaacgtacgtaaggtagggaactaaacgtccgaagtcggactaaccg

SEQ ID NO: 421895 - DNA, 708 bp, Homo sapiens
  misc_feature: GZ8MTXP02G4YJ5.10.21.B10.1.454.CMB.2.raw
tcagcatagtagtgcacgaccggtgctcgatttagtgtcgtcgcaagagatagggggagctctgggagaggagcccagcactagaagtcggcggtgcctccattcggtgatcagcactgaacacagaggactcaccatggagtttgggctgagcttgggttttcctcgttgcttcttttaagagtatgtccagtgtcagatgcagatgggtggaggtcgtgggggaggtcggtcgggtccggccggtcggggggtccctggacgtctctccttgttctgtcgtcgtggtattcatttactttaagtaactcgtggtctagttcggtccgtcgggtcccgcgtacggttccgacgggccgacgggtcgtagggtaagtggggtagaccgtaagtataactaactaagttaagtaggtataagaaaactaaagttaaaaatataacgttaagtacgggtaaacctccgttaacccgttacggaaacggggtaccctactttaccaacccgtactaccgtaacccgaagtaaccgaaacctaaacttacccgaaaagtaacgtagttcgggttatactaccgtagaaactaacgacgaaccgacgtcgtacggaaacgccggaccggtaaacggtacggttacgggttacgtttaacgttacggtaagggtaaacggtacgtaaaactccggtaaggtacgtacgtaaccg

SEQ ID NO: 421896 - DNA, 535 bp, Homo sapiens
  misc_feature: GZ8MTXP02IH7S2.10.21.B10.1.454.CMB.2.raw
  modified_base (260)..(260): a, c, t, g, unknown or other
  modified_base (303)..(303): a, c, t, g, unknown or other
  modified_base (346)..(346): a, c, t, g, unknown or other
  modified_base (362)..(362): a, c, t, g, unknown or other
  modified_base (382)..(382): a, c, t, g, unknown or other
  modified_base (401)..(401): a, c, t, g, unknown or other
  modified_base (407)..(407): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggccgtgggggtcctgagactctcctgttcngcgtctggattcatctttagtaatctggcatgtcctgggtccncaggttccaggccaggctggatggggtgccagatatacaatangatgacaagtaaaatntactagtggagtctccttanaagggcctatacaccatcnccaganacaacttacaagtaacatgggtatatcgtagacaaatcgaacacgacccgtagaacgcggacggaagtaccgggtagggttaactttagtagtaaggtacggtaagtaactacgtggtacgacttacg

SEQ ID NO: 421897 - DNA, 609 bp, Homo sapiens
  misc_feature: GZ8MTXP02HVYGU.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcgtgggggaggcgtggtccggccgtgggggtccctgagctctcctgttctgcgtctggattcattctttaagtaaatcgtggctattcgtccgtgggtcccgccgtaggttcccagggcccacggggctagggaagtggggtgccagatataacaatatgatgaaactaaagtaaaatataactagtaggacgtactccgttacgaacggggtccctaatttaccaaccctataccctaccaagaacgaaactaaactttacccaaaagtaactagttagggtattaatcctagactaaaatcgaacctagacctagacgtacgaccgaggtacgtacgggttactttaagttacgtggtagggaaagtaacgtaccgttaaggtcggtactaacg

SEQ ID NO: 421898 - DNA, 542 bp, Homo sapiens
  misc_feature: GZ8MTXP02GXCCG.10.21.B10.1.454.CMB.2.raw
  modified_base (260)..(260): a, c, t, g, unknown or other
  modified_base (303)..(303): a, c, t, g, unknown or other
  modified_base (338)..(338): a, c, t, g, unknown or other
  modified_base (345)..(345): a, c, t, g, unknown or other
  modified_base (463)..(463): a, c, t, g, unknown or other
  modified_base (479)..(479): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggcgtggggggtccctgagactctcctgtcngcgtctggattcattcttagtaaatctggcatgtctgggtccncaggtccaggccagggctggatgggtagcagatanacaatangatgaacaagtaaaatataactatgggaactacttaccgttacgaaacgggtcctaattccaacctactacctaccaaaggaacaaacctaaattacccaaaggaactagttagggtntagtctagacaaatanacacgcacgagagacgacgacgacggtacgttatagtgtaggagaacacgtagtacggactac

SEQ ID NO: 421899 - DNA, 633 bp, Homo sapiens
  misc_feature: GZ8MTXP02HS0E3.10.21.B10.1.454.CMB.2.raw
  modified_base (260)..(260): a, c, t, g, unknown or other
  modified_base (538)..(538): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggcgtgggggtccctgagctctcctgttcngcgtctggattcattctttagtaatctggcatgtccgtgggtcccgcctacgggttccagggccgacggggcgtagggaagtggggtggaccaggtattaataactaatatgattagaacaaagttaaaaatataactagtacgggaacgtaccttacccgttacgaaacgggtccgtaactttaccaaccctattacccgtaccagaacgaacctaaactttaccgaaaacgtaaactaagtgggtatatcgtagaacaaacttcgaaccagtcccnggaacggacggaccggacgggtacgtaccgggggttattttaacgttacgtggtagggggaaaacttaacgtacgttacggtcggtactaaccgg

SEQ ID NO: 421900 - DNA, 707 bp, Homo sapiens
  misc_feature: GZ8MTXP02FTLVL.10.21.B10.1.454.CMB.2.raw
  modified_base (262)..(262): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtccctgagactctcctgttcngcgtctggattcattctttaagtaaatctggctagtgtcccgtggggtcccgccgtagggttcccaagggcccgacggggtcctaggggaaagttggggtggacccaaggataaatactaaatatagagtgaaactaaagtaaaaaattagttaactaagtaggtaagtaccttacccgtttacgaaacggggtcccgtaatttacccaaccctattaccctacccaaagaacgaaaacctaaacttaacccaaaggtaaacctaagttaggggtagttaactccgttaggaacccttaaaaagtccgaaaccccgtagaccccgttagggaacgaagggaccccggaaagggaacccgttacgggggtttaaggtttaacgttaaccggtgggttaacgggggaaagttaaaactcccggttaaaggttccggaacttaaccgg

SEQ ID NO: 421901 - DNA, 658 bp, Homo sapiens
  misc_feature: GZ8MTXP02GFTK3.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagagtggtggagtcgtgggggagcggtggtccggcgtggggtcctgagctctctgtctgcgtctggattcattacttagtaatcgtggcagtcgtccgtgggtccccgccgtacggttcccgacgggcccgacggggtactaggggaagtggggtcgaccgaaggtaattaacgtaactaaattagttaggatacgaaaactaaagtttaaaaaatcttaaattaggtagggaacgtaccttacccgttacgaacgggcctaattaccacctatcctacaagaacgaacctaaacttaacccaaaagtaacgtaagttagggtataacgttcacgtaacaaaacgtcgaaaccgtacgtccgtaggacgacggacccggaaggacgggttacgggttacgtttaacgttacggtaaggttaagggaaagtaaacgttccgtaaggtcggacttaacg

SEQ ID NO: 421902 - DNA, 676 bp, Homo sapiens
  misc_feature: GZ8MTXP02H5DC9.10.21.B10.1.454.CMB.2.raw
  modified_base (274)..(274): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcttgggttttcctcgtttgcttcttttaagagatgtccagtgtcagatgcagagtgggtggagtcgtgggggaggcggtggtccggcggtgggggtcctgagctctctgttctgcgtctggnttcattctttaagtaatcgtggctagtcgtccgtcggggtccgccgtacggttccgagggcccgacggggctaggggaagtggggtcggccaggtatataacaattagtagtagtagaaactaaagttaaaaattactaacgtagtacgggactaccttacccgttaacgaacggggtaccctactttaccacctaactaccgtacccgagaacgaactaaacgttaccaaaagtaactaagtggtagtactacgtaggtaacaaacgttcggaacctacgtccgtaggacggaaacggacccggtaaacgggtaaccggttaccggggtttagtttttaacgtaacgttaaggggaagggtaaaacgtaaccgttacgttacggtacggtaaccgtaacgg

SEQ ID NO: 421903 - DNA, 610 bp, Homo sapiens
  misc_feature: GZ8MTXP02H8IVE.10.21.B10.1.454.CMB.2.raw
  modified_base (221)..(221): a, c, t, g, unknown or other
  modified_base (260)..(260): a, c, t, g, unknown or other
  modified_base (266)..(266): a, c, t, g, unknown or other
  modified_base (442)..(442): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcgtggtttcctcgttagctctttaagagatgtccagtgtcagatgcagagtggtggagtgtgggggagnggtcgggtccggtcggtggggtcctgacgctctctgtcngcgtcnggtatcattcttaagtaatcgtgctagttcgtccgtcgggtccgccgtacggttcccgaggtccccgagggctaggtagtgggcgccagtatacactaatagtgatagaaacaaagttaaaatataatagtagaacgtaactcttaacggacgggtaccattaccacctattaccnccgaagaacactaaacttaccgaaaaggtacagttgtagtacttacgagtaacaaacgtacaacgacgtaccgtagaacggacggaccggaacggaccggtacgggttaacgtttacgttacgtaacggttacggaaagtaacgtacgtacggtacggtacgtaaccg

SEQ ID NO: 421904 - DNA, 690 bp, Homo sapiens
  misc_feature: GZ8MTXP02HAYKW.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggtagtttgggctgagtcttgggttttcctcgttgtcttacttttaagagtatgtccagtgtcagatgcagagtgggtggagtcggtgggggaggcggtcgggtccggccggtcgggggtccctggacgtctctctgttcgtgtcgtctggtattctattactttaagtaactcgtggtctagttcgtccgtcgggtccgccgtacggttcccaggccgacgggtacgtagggtaagtggggtcggaccgtaagtaattaagtaactaaagttagtagtagtacgtaaaataaaagttaaaaatacgttaaagtaagtacggtaaactaccttacccgttaacgaaacgggtctaaacttccaacctacgttacccaactaacggtaactaaaacctaaacttaaaccgaaaacgtaactagttagggttactactacgtacgaaactaagtacgaaccacgtaccgaggaacggacgaccggtaaggtaacgtacgggttaatttacgaacggttaaggaaggtaaacgtaactcgtaggtcgtaactaccg

SEQ ID NO: 421905 - DNA, 756 bp, Homo sapiens
  misc_feature: GZ8MTXP02JTGXM.10.21.B10.1.454.CMB.2.raw
  modified_base (305)..(305): a, c, t, g, unknown or other
  modified_base (353)..(353): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtccctgagctctcctgttctgcgtctggattcatctttagtaatctggcatgtcctgggtcccncaggttccaggccacgggctggaatggggtgccagatatacaatatgntagaactaagtaaaaatataactagtgggaacgtaccttacccgttacgaaacggggtcccgtaactttaccgaaccctattaccctacccgaagaacggtaaaccctaaactttaaccccgaaaacggtaaacctaaggtttacggggtttaacgttaaacgtttacccgttaagggtaaccctaaaaaagtttaccgggaaaaccccgtaacggtacccccgttagggaaaacgggaaaccggggaccccgggtaaaacgggggtaaacccggttaaaccggggggttttaacgttttttaaaacggtttaaccggttaagggggttaaacgggggtaaaacggttaaaaaccggtttaccccggtttaaaggggtttaccggggtaacctttaaacccgg

SEQ ID NO: 421906 - DNA, 714 bp, Homo sapiens
  misc_feature: GZ8MTXP02H24H6.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcgtgggttttcctcgttgcttcttttaagagatgtccagtgtcagatgcagatggtggagtcgtgggggaggcgtgggtccggccgtgggggtccctggacgctctcctgttctgcgtctggattcattctttaagtaaatctggctagtcgtccgtcggggtccccgcctacgggtttcccagggtcccgacggggtctaggggaacgtggggtcggcccaggtattaagtaacaaattatagatgaaacaaagttaaaaatataactagtggaatacctccttagaaacggggcctattaccgaccctatccctaccgaagacgaaacctaaactttacccgaaaagtaaacccgtagtttaggggttaacgttaacttacgttacggaactaaaaacgttcgaaacccgtacgtaccccgttagggaacgggaaccgacccgggaaacgggtaaacccggtaaccgggggtttatttttaaccgtttaaacggttggggttaaacgggggaaattaaaaacggttccccgttaaaagggttcgggtacccgttaaaccg

SEQ ID NO: 421907 - DNA, 699 bp, Homo sapiens
  misc_feature: GZ8MTXP02GGVKA.10.21.B10.1.454.CMB.2.raw
  modified_base (262)..(262): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatgggtggagtcgtgggggaggcggtggtccggccgtgggggtccctgagctctctgttcngcgtctggattctattctttaagtaaatcgtggctagtcggttccgtcgggtcccgccgtacggttcccgacgggtcccgacggggtcgtaggggaagtggggtgaccgaagtactaagtaactaaatagttagatagaaactaaagttaaaaatataacgttaagtagggtaacgtacctttacccgttacggaaacgggggtcctaaactttacccaaccctaacttaccctaccgaaagaacgtaaacctaaaacttacccgaaaagtaacctagttacgggtacttaactcgtagtaaactaaaacgtcgaaacccacgtacccgtaggaaaggaccggaacccgggtaaacggaccggtaacgggtttaggtttaaccgttaaggtggttaacggggaaagttaaacgtacggttacgttacggactaaccg

SEQ ID NO: 421908 - DNA, 326 bp, Homo sapiens
  misc_feature: GZ8MTXP02IQ1VP.10.21.B10.1.454.CMB.2.raw
  modified_base (324)..(326): a, c, t, g, unknown or other
tcagcatagtagtgcacgaccggtgctcgatttagtgtcgtcgcaagagagagaggggggggctgggaggcctttgttggagaccttgcacttgtactccttgccgttcagccagtcctggtgcacgacggtgaggacgctgaccacacggaacgtgctgttgaactgctcctcccgtggtcaccgtctcttcggcctccaccaaggcccatcggtctcccctggcgcctgctccaggagcacctcgagagcacagccggccctggctgcctggtcaaggactacttcccactactatgctgagcggctggacaggcgcatagnnn

SEQ ID NO: 421909 - DNA, 550 bp, Homo sapiens
  misc_feature: GZ8MTXP02JCBLK.10.21.B10.1.454.CMB.2.raw
  modified_base (357)..(357): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggccgtggggggtccctgagactctcctgttctgcgtctggattcatctttagtaatctggcatgtcctgggtccgccaggttccagggcccgacgggctggaatgggtggccagatatacaatatgntgacaagtaaaatatactatggagtactccgttacgaagggccgattcaccctatctaccagagacaaattaccaaagtaacagtggtagtatctagacaaatcgaccagccctagagacgaccggaggacgtacggggttatttaagttacgtggtaggggtaaagtaaacgttccgtaggtcggactaacg

SEQ ID NO: 421910 - DNA, 596 bp, Homo sapiens
  misc_feature: GZ8MTXP02JAECV.10.21.B10.1.454.CMB.2.raw
  modified_base (309)..(309): a, c, t, g, unknown or other
  modified_base (360)..(360): a, c, t, g, unknown or other
  modified_base (362)..(362): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgcttcttttaagagatgtccagtgtcagatgcagatgggtggagtcgtgggggagcgtggtccggccgtgggggtcctgagctctctgttctgcgtctgattcattctttagtaaatcgtggctatcgtccgtgggtcccnccgtaggttccagggcccgacgggctaggagtgggtgccagatatacatangntgaacaaagtaaaatataactagtaggacgtactcccgttagaacggggcctaattaccacctactcctacagacaaacaacttaccaaagtaacagttgggtatatcgtagactaaatcgaaccacgtcctaggacgtacgacccgggaagtaaccggtacgggtttaacgtttaacgttacggttgggacgggtaaaacgtaaccgttacgttacggtacggactttaaccg

SEQ ID NO: 421911 - DNA, 694 bp, Homo sapiens
  misc_feature: GZ8MTXP02I7DU5.10.21.B10.1.454.CMB.2.raw
  modified_base (273)..(273): a, c, t, g, unknown or other
  modified_base (396)..(396): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcttgggttttcctcgttgcttcttttaagagtatgtccagtgtcagatgcagagtgggtggagtcggtgggggaggcggtgggtccggccggtcgggggtccctgacgtctctcctgttcngcgtctggtattcattctttaagtaaatcgtaggtcagttcgtcccgtggggtcccgtccgtacgggttcccacgggcccgaacggggtctagggaagtggggtgaccagtataatacaatangatagaactaaaagttaaaatataacgtagtagggtaaactaccttaccgtacggaaacggggtaccctaactttaccaacccttattaccctacccgaagaacgtaaaccttaaacttaacccgaaaaggtaacctagttaggggttaacttactaccgttaggaaacctaaaagttccggaaacctacggtcccgtaaggaacggacggacccggtaaaggtaaccggttacggggtttattttaacggtagttaagggtagggaaacgttaaacgtcgtaaggtcggaacttacg

SEQ ID NO: 421912 - DNA, 681 bp, Homo sapiens
  misc_feature: GZ8MTXP02GFQPM.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtccctgagactctcctgttctgcgtctggattcattctttagtaaatctaggcatgtcctgggtccgccacggttccagggccgacgggctgggaagtgggtggccagatagtacaatatgatgaacaagtaaaatatactagtggagtactccttcgaagggtccgattaccgacctattaccctacccaaggaacgtaacctaaactttaccccgaaaagtaaaccgtaagttaggggtacgtttaaacgttcctttagggaaccttaaaacgttacgggtaacccaaacggtcccgttaagggaaacggtaacgggaacccccggaaaggggaaaccgttaaccgggggtttagtttttaaaccgttacggttaaggggttacgggggtaaaacgttaaaacgttcccggttaaaagggttcggtaccgttaaaccg

SEQ ID NO: 421913 - DNA, 764 bp, Homo sapiens
  misc_feature: GZ8MTXP02GA3KN.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcgtgggggagcgtggtccggccgtgggggtccctgagctctcctgttctgcgtctggattcattctttagtaaatctggctatgtcccgtggggtcccgccgtacggttcccgacgggccccgacggggtctaggggaacgtgggggtacggacccgtaaggtataaacgtaacgtaaattagtaggtactagggaaacctaaaaggttaaaaattaacgtaactttaagtagggtaaacgtacctttacccgtttaacggaaacggggtccctaactttccgaaccctaataccctaccgaaagtaacgaaacctaaaacgtttcccaaaacggtaaacctaagtttcggggttacttaacgttaccgttaggaaccctaaaagttccgggaaacccctaacggtccccgttagggaaaacccggtacggtaaccccgggaaaggggtaaacccggttacgggggtttaactttttaacggtaacgttaacggggttaagggggtaaacttaaaaccggttcccgtaaggtttacgggacctttaaccgg

SEQ ID NO: 421914 - DNA, 532 bp, Homo sapiens
  misc_feature: GZ8MTXP02HP87N.10.21.B10.1.454.CMB.2.raw
  modified_base (309)..(309): a, c, t, g, unknown or other
  modified_base (353)..(353): a, c, t, g, unknown or other
  modified_base (361)..(361): a, c, t, g, unknown or other
  modified_base (414)..(414): a, c, t, g, unknown or other
  modified_base (420)..(420): a, c, t, g, unknown or other
  modified_base (451)..(451): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggccgtgggggtcctgagctctcctggttctgcgtctggattcattctttaagtaatctggcattgtccgtggggtcccnccgtaggttcccagggccacgggctggaagtgggtgccagatanacaattangatgaacaagtaaaatatacatagatactcctagaacgggctaatcaccatcnccaganactaaactccaaagtacagtggtatactcgngaacaatagacacgacacgagagacgacggaacgtacggtacgttattatgtaggtagtaaactacgtacgtacggataac

SEQ ID NO: 421915 - DNA, 725 bp, Homo sapiens
  misc_feature: GZ8MTXP02IY37Y.10.21.B10.1.454.CMB.2.raw
  modified_base (341)..(341): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagtcttgggttttcctcgttgcttcttttaagagtatgtccagtgtcagatgcagagtgggtggagtcggtgggggaggtcggtgggtccgggccggtcgggggtccctggacgtcttctccgtgttctcgcgtctggtattcgattacgtttaagtaaactcgtggctagttcgtcccggttgggtcccnccgtacggttcccgacggtcccgacgggtcgagggtaagtggggtcgccgtaagtaactataactaaagttataggagtaggaaactaaagttaaaaatacttaaacgtaagtacgggtaaactacccgttacccgttacggaaacggggtacccttaagttcccaacctacgtcccttaaccgaaaggtaacaaaccgtaaaccttaccgaaaagtaactaggttagggtactaactcgtaacgtaactaaagtaccgtaacaacggaccttaagggacgaaccggggacggtaaacgggtacggtttaaccgggttagttttaaccgtacggtaacggggtaggtaaacgtaaacggttacgtacggtacgacgtttaaccg

SEQ ID NO: 421916 - DNA, 615 bp, Homo sapiens
  misc_feature: GZ8MTXP02FQ03O.10.21.B10.1.454.CMB.2.raw
  modified_base (512)..(512): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcgtgggggaggcgtggtccggcgtgggggtcctgagctctctgtctgcgtctggattcattcttagtaatcgtggctatcgtccgtgggtcccgcgtacggttccagggaccgaaggggtctagggaagtggggtcggacctaagagtataactaaagttatagagtagaaactaaagttaaaaatataactagtaggtaacgtaccttaccttacgaaacggggtcctaacttaccaacctactcctaccaaagaacgaaacctaaacttacccaaaaggtaactagtgggtatactntagaactaaatcgaacacgctaggagacgacggtaaggacgtacggttagtttacgttaagcgggtttaagggaacttaaacgtccgttaaggcgactaaccg

SEQ ID NO: 421917 - DNA, 642 bp, Homo sapiens
  misc_feature: GZ8MTXP02JGZV9.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcgtggtttcctcgttgctctttaagagatgtccagtgtcagatgcagatgggtggagtcgtgggggagcgtggtccggcgtgggggtcctgacgctctctgttctgcgtctggattcattctttaagtaatcgtggctagttcggtccgtcggggtcccaccgtacggttccccgacgggtcccgacggggtcgtaggggtaacgtggggtacgaccgagtataacgtaactaatagtacgatagaaacgtaaaagtaaaatataactagtaggaacgtaccttccgtaagaacggcctattacacctattaccaccgaagaactaaactaaacgttaccgaaaagtactagtagggtattaatcgtaagaacctaaatcgaacccgagaccctaggacgaccggacccgggtaaagaccgggtttacgggttatttaccgtaaacggtggtaaggggaaactaaacgttccgaggttacgaccttaacg

SEQ ID NO: 421918 - DNA, 611 bp, Homo sapiens
  misc_feature: GZ8MTXP02FXG3H.10.21.B10.1.454.CMB.2.raw
  modified_base (518)..(518): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcgtggtttcctcgtagctctttaagagatgtccagtgtcagatgcagagtggtggagtcgtgggggagcgtggtccggcgtggggtcctgacgctctcctgttctgcgtactggtacttcactttctttaagtaaatcgtggctatcgtccgtggtcccgcgtacggttccacgggcccgaggggtcctagggtagtggggtcgaccgagtatataactaagtatagattacgaaataaagttaaaaatagtaactagttaggaaacgtaccttacccgttagaaacgggcctaattaccaacctacttacgaccgaaagacgtaaacctaaacttaccaaaggaactagtaggtactatacgaanaacaacacgacgacgacgacgacgacgacgacgtacgtacgttacgttagttacgtaaggtaggtaacgtacgtacgtacgtacgtacgtacg

SEQ ID NO: 421919 - DNA, 633 bp, Homo sapiens
  misc_feature: GZ8MTXP02I3BPH.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggcgtgggggtccctggagactctccgtgttctgcgtctggattcattctttagtaatctggctatgtccgtgggtccgccgtaggttccacgggccacgggctggagtggggtgccagatatacatatgatgaactaagtaaaaatattaactagtagggaacgtaccttacccgttacgaacggggtacccgttaacgttaccaaccctaacttcctaacccgaagaacgtaaacctaaactttaaccccgaaaagtaaaccgaattagggtacgttaaacttaccgtaagacctaaaaagttcgaacccgaagcccgtaggacggaccgtacgggaacggtaccgttacggttattacgttaggtaaggtacgaagtacgtacgtacggtcgacgttaccg

SEQ ID NO: 421920 - DNA, 565 bp, Homo sapiens
  misc_feature: GZ8MTXP02F3AY3.10.21.B10.1.454.CMB.2.raw
  modified_base (263)..(263): a, c, t, g, unknown or other
  modified_base (495)..(495): a, c, t, g, unknown or other
  modified_base (501)..(501): a, c, t, g, unknown or other
  modified_base (507)..(507): a, c, t, g, unknown or other
  modified_base (522)..(522): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggattcaccatggagtttgggctgagcgttgggttttcctcgttgcttcttttaagagatgtccagtgtcagatgcagatggtggagtcgtgggggaggcgtggccggccgtgggggtccctgagctctcctgttcngcgtctggtattcattcttagtaaatctggctagtgtcccgtggggtcccctcgtacgggttcccagggcccgaacgggggtccttagggaagtgggggtgccctaagtatagtaataatatgatagaaactaaagtaaaactataactagtggaactacttccgtagaaacgggcctattaccactactctaccaagacaaactaaacttaccaaagactagttggattanacgtanaacaancgacacgcgagacgngacgagacgtacgttattagtagtgtagatactcgagcatacg

SEQ ID NO: 421921 - DNA, 706 bp, Homo sapiens
  misc_feature: GZ8MTXP02GF3Y4.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcgtgggggaggcgtggtccggcgtggggtccctgagctctcctgtctgcgtctggattcattacttaagtaatcgtggctatcgtccgtcgggtcccgccgtacggttccgacgggcccgacggggtcgtagggaaggttcggggtggaccgtaaggtaacttaagtaaactaagttaagttagagtaacgtaaacgtaaaagttaaaaacttacgtaacgttaagggttacgggggtacccttaccgttaacggaacggggtaccgtacttacccaacctacttacccgtaaccgaagtaacgaaacctaaacgttaaccgaaaaggtaaacctagttagggttacgttaatcccgttaagaacctaaaagtaccggaaccacggtacccgtaggaacggaccggaccggtacgggaacggttaacgggttacgtttaagttacggtaggtaagggtaaacgtaaacttccggaggttcgacgtacgtaccg

SEQ ID NO: 421922 - DNA, 581 bp, Homo sapiens
  misc_feature: GZ8MTXP02IT03Z.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggccgtgggggtccctgagactctctgttctgcgtctggattcattcttagtaatctggcatgcctgggtcccgctaggttccaggccgacgggctggaagtggggtgccagatatacaatatgatgaactaagtaaaatatactaatggaagtactccttacgaacgggcattacacctatacctaccagacgaactaaacttaccaaacgtaagtatgggttataactcgttacgaacaaaattcgaaccctagacccgtaggacggaacggacccgaaagggacgttaccggggttatttaacgtagttggtagggaaacgtaaactaccgttaggtacggtactaacg

SEQ ID NO: 421923 - DNA, 720 bp, Homo sapiens
  misc_feature: GZ8MTXP02F0RF9.10.21.B10.1.454.CMB.2.raw
  modified_base (343)..(343): a, c, t, g, unknown or other
  modified_base (361)..(361): a, c, t, g, unknown or other
  modified_base (363)..(363): a, c, t, g, unknown or other
  modified_base (636)..(636): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggcgtgggggtccctgagctctcctgttctgcgtctggattcattctttagtaaatctggcagtcgtccgtcgggtccgccgaggttccagggcccgacgggctaggatggggngttccagatatacaatangntagaaacaaagttaaaatataacgtaagtgggaaacgtaccttacccgtttaacgaaacgggggtccctaatttacccaaccctaacttacccttacccgaaaggaaccgtaaacctaaactttacccgaaaaggtaacctagttaggggttaattaacttacccgttaggaacctaaaaacgttccggaaaacccgacggtaccccgttaagggaaaccggtaccgggaaccccgggaaaagggggtaacccggttaaaccggggggttttnttttaaaaccggtttacggttaaggggttaacggggtaaaacgtaaaaccgttccggttaaacgggttcgacgtttaaacccgg

SEQ ID NO: 421924 - DNA, 588 bp, Homo sapiens
  misc_feature: GZ8MTXP02IG04Y.10.21.B10.1.454.CMB.2.raw
  modified_base (275)..(275): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgcttcttttaagagatgtccagtgtcagatgcagagtggtggagtcgtgggggaggcggtgggtccggccggtgggggtccctgagactctctgttctgcgtctggnttcattctttaagtaaatcgtggcagttcgtccgtcggggtcccgccgtagggttcccacgggcccgacgggtctgggaagtggggtgccagtatatacaatatgatagaacaagtaaaatatactataggatactccttacgaacggcctaattccaacctactctaccagagaactaacttacaaagtaacagttagtatactacgtacactaaatcgaaccagaccctagacgacggaccggtagggaacctacggggtttactttaagtacgtaagggtaggaactaaacgtcgtaggtcggactaccg

SEQ ID NO: 421925 - DNA, 701 bp, Homo sapiens
  misc_feature: GZ8MTXP02JA05U.10.21.B10.1.454.CMB.2.raw
  modified_base (260)..(260): a, c, t, g, unknown or other
  modified_base (307)..(307): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtgggtccggcgtgggggtccctgagctctcctgttcngcgtctggattcattctttagtaatctggctatcgtcctgggtcccnccgtagggttccagggtcccgacggggtctaggggtaacgtggggtcgaccgaggtaattaacgtaacaagtacgtagatgaaactaaagttaaaactataactaagttgggaacgtaccttacccgttacgaaacggggtcctaactttaccaaccctactaccctacccgaaagaacgtaaacctaaattacccgaaaacgtaaaccgtaagttaggggttataaacgttccgtagaaaccctaaagttacgaaacccgacgtacccgttacgggagaaccgggacccggaaagggaaccggttaccgggggtttacgttttaaagttaaccggttaacgggtaaggggtaaacgttaaaacgttcccgtaaaggtttacggacttaaaccg

SEQ ID NO: 421926 - DNA, 668 bp, Homo sapiens
  misc_feature: GZ8MTXP02HLXPJ.10.21.B10.1.454.CMB.2.raw
  modified_base (535)..(535): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcgtgggttttcctcgttgctcttttaagagatgtccagtgtcagatgcagatgggtggagtcgtgggggagcgtgggtccggccgtgggggtccctgagctctctgtctgcgtctggtattctattctttaagtaaatcgtggctagttcgtccgtcgggtccgccgtaggttcccgacgggtcccgaacggggcgtaggggtaagtggggtggacccgtaagtaatacgtaaacaaattagtggtataaggtaaactaaaagttaaaaattacttaactaagttaacgggacttacccgttaccgttacggaaacgggggtccctaactttccaaccctacttacccaccgaagaacaaacctaaacttaaccaagtaaacngttagggtatactcgtacgaacaactacggaccacggtaccaggacggacgaccggaaagggaccgttacggggttagtttaacttacggtgggtaaggaaaacggttactaccggtaggtacggtactaccg

SEQ ID NO: 421927 - DNA, 698 bp, Homo sapiens
  misc_feature: GZ8MTXP02FVZAG.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggattcaccatggagtttgggctgagcttgggttttcctcgttgcttcttttaagagtatgtccagtgtcagatgcagatggtggagtcggtgggggagcggtggtccggccgtgggggtccctgagtctctctgtctgcgtctgtatctattacttagtaaatcgtggctagttcgtccgtcgggtcccgccgtacggttcccgaacgggcccgtacggggtccgtaggggaaaggttgggggtacggcccgtaaagtactaataaactaagttagtagagtacgaaactaaaagtttaaaatacgttaaacgtaagtacgggaaacgtaccttaccgttacggaacgggtccctaacttaccaccgtactcctaccgaaagacaaacctaaactaaccgaaaagtaactagttagggtacttaactcgtaacaacgtaaataccgaaccgacgaccgtaagaggaccgacgggtaaacggaacgggttaccgggtttagtttaacgtttacggtaagggtttaacgggaaaacgttaaaccgttcggttaacggtcggtacttaaaccgg

SEQ ID NO: 421928 - DNA, 535 bp, Homo sapiens
  misc_feature: GZ8MTXP02GGCVD.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgcttcttttaagagatgtccagtgtcagatgcagatggtggagtcgtgggggagcgtggtccggccgtgggggtccctggagctctcctgttctgcgtctggattcatcttagtaatctggcatgtcctggtccgcaggttccaggccacgggctggaagtgggtgccagatatacaatatgatagacaagtaaaatatactataggatactccttacaaggtccgattcacatctccagagacaattaccaagaaacacttaggtgtactctagactaaagtcgaccacgtctacgagacgcggaacggactacggggtactttaagttacgtggtagggaagtaaactccgtagtcggactaacg

SEQ ID NO: 421929 - DNA, 581 bp, Homo sapiens
  misc_feature: GZ8MTXP02GC4HM.10.21.B10.1.454.CMB.2.raw
  modified_base (489)..(489): a, c, t, g, unknown or other
  modified_base (498)..(498): a, c, t, g, unknown or other
  modified_base (573)..(573): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgcttcttttaagagatgtccagtgtcagatgcagatggtggagtcgtgggggagcgtggtccggccgtgggggtccctgagctctcctgttctgcgtctggtattcattctttaagtaaatctggctagttcgtccgtgggtcccgccgtacgggttccacgggcccgacggggtctaggaagtggggtgaccagatagtaacaatatgatagaactaaagtaaaatataactatagggataccttccgtacgaacgggtcctaattccacctatccctaccgaagacgtaactaagttaccaaagtaaactgttagggtntaatcgtanacgtaaatcgacctagcctagacgacgacgaggacgtacggttattatacgtggtacggaaatactaccgttagngactaccg

SEQ ID NO: 421930 - DNA, 896 bp, Homo sapiens
  misc_feature: GZ8MTXP02HWLTF.10.21.B10.1.454.CMB.2.raw
  modified_base (264)..(264): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtgggtccggccgtgggggtccctgagtactctcctgttcngcgtctggattcattctttagtaaatctggctagtgtccgtacggggtcccgtaccgtacggtttaccgacgggcccgtacggggtacgtcggggtaaaggttggggtacggaccctagtttaacgttaactaaacgtaaagttaagttaggtagttacgggaaaaccgtaaaaggtttaaaaactttaagttaaaccgttaaagtttaacgggggtaaacgttaaaccccgtttaaccccggtttaacggaaaaccgggggtaccccggttaaacgtttttacccccgaaacccgtttaaaaccgtcccttaaccccgaaaaggtaaacccgggtaaaacccttaaaaccttttaacccccgaaaaaagggttaaacccttaaaacggtttgggggttaccgttaacttaccgtaacggtaaacctaaaacgttaccgtaaacccgaacggtaccccgttaaagggaaacggaaccggggtaccccgggaaacggggttaaaccccgttacggggggtttttaaaaccgttttaaggttaaacccggttaagggggttaaaccgggggttaaaaggttaaaacccggttacccgggtttaaaggttaccggggttaaactttaaaccccgg

SEQ ID NO: 421931 - DNA, 687 bp, Homo sapiens
  misc_feature: GZ8MTXP02FZJBD.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcttgggttttcctcgttgcttcttttaaagagatgtccagtgtcagatgcagatggtggagtcgtgggggagcggtggtccggccggtgggggtccctggacgactcgtcctgttctgtcgtctggtattctattaccgtttaagtaaatcgtggtcagttcgtccgtcggggtcccgccgacgggttccgagggcccgacggggtcgttagggaaggttcggggtggacccgaggtataactaactaatagtagagtagaaactaaaggtaaaaacttattaacgtaagtacgggtaactaccgttacccgttacgaaacggggtccctaacttaccaccctagtacctaccgaaagtacgaaacctaaacttaacccaaaagaactaagttacgggttaattacgtacgttacgaaactaaaacgtcgacccgtaaagtcccgtaggaacgtacggaccggtaaaggtaccggtacgggtttagttagttacgtggtaaacgggtaagtaacttccggtagtcgtactaaccg

SEQ ID NO: 421932 - DNA, 687 bp, Homo sapiens
  misc_feature: GZ8MTXP02HOGPI.10.21.B10.1.454.CMB.2.raw
  modified_base (219)..(219): a, c, t, g, unknown or other
  modified_base (527)..(527): a, c, t, g, unknown or other
  modified_base (569)..(569): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcttgggttttcctcgtttgcttctttttaagagatgtccagtgtcagatgcagagtggtggagtcgngggggagcgtggtccggccgtggggtccctgagcctctctgttctgcgtctggtcttctattcttaagtaatctggctagtcgtcccgtgggtcccgcgtacggttccgagggtcccgagggtctaggaggtcggggtagccagtactagtacaatagtggattagaaactaaagttaaaatacttaacgtatagggtaactaccctccgttaacgaacggggtccttaacttccgaaccctatccctacgaaagtaacgtaaactaaccgttaaccaaacgtaaactagttacggggttattaaacncttacggaaacctaaagttaccgaaccctaggttaacccggnggaaaaccggtcggaaaccggaacggggttaaacggtaccgggttttagttttaacgtacgggttaagggttaaaggggaacgttaaaacgttccggtaagttcggggtactttaacg

SEQ ID NO: 421933 - DNA, 664 bp, Homo sapiens
  misc_feature: GZ8MTXP02HXX5O.10.21.B10.1.454.CMB.2.raw
  modified_base (246)..(246): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcgtggttttcctcgttagctcttttaagagatgtccagtgtcagatgcagatggtggagtcgtgggggagcgtggtccggccgtgggggtcccngagactctcctgttctgcgtctggtattcattctttaagtaaatcgtggctattcggtccgtcggggtacccgcccgtagggttccccacgggtcccgacggggtccgtagggaaggtcggggttggaccaggtataactaacaattagtagattagaaactaaagttaaaatataacgtaagtagtacgtaccttccgttaacgaaacgggtcccgtaattacccaccgtataccctacccgaaggactaaaccgtaactttaaccccgaaaagtaccgtaagttagggtacgtaaccttgacgtaacaaaacgttcgaaccgagtaccgtacggaacgacggacggaacggtaacggtacggtttagtttaagtacgtaagggtacgaaacgtacttaccgtaggttcgacgtaac

SEQ ID NO: 421934 - DNA, 647 bp, Homo sapiens
  misc_feature: GZ8MTXP02I3R30.10.21.B10.1.454.CMB.2.raw
  modified_base (263)..(263): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcttgggttttcctcgttgcttcttttaagagatgtccagtgtcagatgcagatggtggagtcgtgggggagcgtgggtccggccgtggggtcctgacgtactctctgttcngcgtctggactcattcgttagtaaatctgctagtcgtcctcgggtccgccgtacggttccgacggccgacgggctaggaagtggggtcgctagtatataacaatagtagacgtaggaaactaaaggtaaaacttataacgtagtagggaactaccttcccgttacggaacgggtaccctaacttaccaccgtactaccgtaccgaaagtacgtaaactaaccgttaaccaaacggtaactagttcggtagttaactcgtaagactaaaactcgaaccgacgtccgtaggaacgacggaccggtaaggaacgtttacgggttaagtttaacgttaacgtaagggtaagggaacttaaaccggtaccgtaggtacggtacttaacg

SEQ ID NO: 421935 - DNA, 612 bp, Homo sapiens
  misc_feature: GZ8MTXP02F6HD2.10.21.B10.1.454.CMB.2.raw
  modified_base (372)..(372): a, c, t, g, unknown or other
  modified_base (396)..(396): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcttgggtttttcctcgttgcttcttttaagagatgtccagtgtcagatgcagatggtggagtcgtgggggagcgtggtccggccgtggggtcctgacgactctcctgttctgcgtctggattcattcttaagtaactctggctagtcgtccgtggtcccgcgtaggttccacgggcccgaggggtctggaagtggggtgaccagactagtaactaaatangtagtcgaaataaagttaaaaatnttaactaagtaggaactaccttaccgtacgaaacgggtcctaattacccacctaatacctaccgaaagaagaaacctaaaacttaccaaaacgtaactagtaggttagtatcgaagactaaaatcgaaacagaccgtaggacgacggcggaaacgggtacgttacggttagtttacgttagtaaggtaggaagtaaactcgtaagtcggactaacg

SEQ ID NO: 421936 - DNA, 758 bp, Homo sapiens
  misc_feature: GZ8MTXP02FUCJL.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgcttcttttaagagatgtccagtgtcagatgcagatggtggagtcgtgggggagcgtggtccggccgtgggggtcctgagctctctgtctgcgtctggattcattctttagtaactcgtggctatcgtccgtgggtcccgccgtacggttccacgggcccgacgggtctgggaagtggggtgaccgagtatataacaatatagatagaactaaagttaaaatataaacgtagtacgggtaaacgtaccgttacccgttaacgaaacggggtcccgtaactttaccccaacccttacgttaccccttaaccccgaaagggtaacgtaaaacccttaaacctttaaccccggaaaaagtaaacccgttaagtttaacgggggttaagttaaccttacgttaacggaaacctttaaaaacgtccggtaaaacccgaacggtacccccgttaacgggaaaccggtaaaccggacccggggtaaaacgggtaaccggttaaccgggggttttacgttttaaagtttaccggtaaggggttaaacgggtaaaacgtaaaaccggtttcccgtaaagggttccggactttaaaccgg

SEQ ID NO: 421937 - DNA, 654 bp, Homo sapiens
  misc_feature: GZ8MTXP02JLH4B.10.21.B10.1.454.CMB.2.raw
  modified_base (408)..(408): a, c, t, g, unknown or other
tcagcatagtagtgcacgaccggtgctcgatttagtgtcgtcgcaagagaggaggggggaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcggtgggtccggccggtggggggtccctggagtactctcctgttctgcgtctggattcattctttaataaatctggctagtcgtccgtgggtcccgccgtaggttccgacgggccgacggggtcgtagggaacggtggggtaggcgaaggtaataagtaacaaattagtagtaataggactaaaagttaaaatntaactaagtaggactactacgtacgaaacgggtcctaattccactactccgtaaccagaacgaactaaagttcccaaaagaacgttagtacgggttattactacgtacgaactaaaagtccgaaacacggtcgaaggacgacgggaacgaacggtacggtacgggtttagttacgttacggtagggtacggaaaagttacacgttggacggtactacgtaccgtacgttacggtttctttacgggg

SEQ ID NO: 421938 - DNA, 614 bp, Homo sapiens
  misc_feature: GZ8MTXP02FLC9G.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtccctgagctctcctgttctgcgtctggatcattctttagtaaatctggctatgttccgtgggtcccgccgtacggttcccgaggcccgacggggtcctagggaagtggggtgcccgagatataacaatatgatagactaaagtaaaactagtaactagtaggaacgtacttacccgttacgaacgggtccgtaactttaccgaccctactcctacccaagaacgaaactaaacttaccaaagtaaccagttaggtagtaactcgtagactaaagtcgaaccagcctaggacgtacgaccggaacggtacgtacggggtttacgttacttaacgtggtaggaacgtaaacgtccgtaaggtacggacttaacg

SEQ ID NO: 421939 - DNA, 650 bp, Homo sapiens
  misc_feature: GZ8MTXP02F6C7V.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgcttcttttaagagatgtccagtgtcagatgcagagtggtggagtcgtgggggagcggtggtccggcggtcgggggtccctggacgactctccttgttctgcgtctggtattctattacttaagtaaatctggctagttcgtccgtcgggtcccgccgtacggttcccgacgggcccgtacggggcgtagggaaggtggggtgaccgagtataataactaatagtagataacgaaactaaagtaaaatataactagtacggacgtaccttaccgttacgaacgggtcctagtaccacctactccgtacaagacgaacctaattaacccgaaagtaactagttacgggtatactacgtacgaactaagtcgaaccctaggtacccgaaggaccggtaccggaccggtaaacggtaccgttacgggttaacgtttacgtaaccgggtaaggtaaagtaacgtaccgtagtacgacctacgtacg

SEQ ID NO: 421940 - DNA, 748 bp, Homo sapiens
  misc_feature: GZ8MTXP02F3DCT.10.21.B10.1.454.CMB.2.raw
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagctgggttttcctcgttgctcttttaagagtatgtccagtgtcagatgcagagtggtggagtcgtgggggagcgtggtccggcgtggggtccctgagctctcctgttcctgcgtatcggtattcattcgtttaagtaaatcgtggctagtgtccctgggtcccgccgtaggttcccagggtcccgacggggtcttaggggaacgtggggtcgaccgagatactaactaataagttggattgaaacctaaaggttaaaaatacttaacgtagttacgggaaacgtacgttacccccgttagaaaacggggtccctaatttaaccccacccgttattaacccgttcccaaaagggaacgtaaacccgttaaaaacctttaccccgaaaaaacgggaaacttaacggttacgggggttaaatttaccttacccggtttaaagacccggttaaaaaacgtaaccgtaaccgtaaccgtaccgtaacggtaacggtaaccgggaaccggtaaacggtaaaccggttaaccgggtttaacggtttaacgtttaacggttaacggtaacggtaacgtaaacgttacgtacggtacgtacgtacg

SEQ ID NO: 421941 - DNA, 524 bp, Homo sapiens
  misc_feature: GZ8MTXP02HZU1Z.10.21.B10.1.454.CMB.2.raw
  modified_base (303)..(303): a, c, t, g, unknown or other
  modified_base (352)..(352): a, c, t, g, unknown or other
  modified_base (357)..(357): a, c, t, g, unknown or other
  modified_base (402)..(402): a, c, t, g, unknown or other
  modified_base (405)..(405): a, c, t, g, unknown or other
  modified_base (437)..(437): a, c, t, g, unknown or other
  modified_base (439)..(439): a, c, t, g, unknown or other
  modified_base (442)..(442): a, c, t, g, unknown or other
  modified_base (444)..(444): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcgtgggttttcctcgttagctcttttaagagatgtccagtgtcagatgcagatggtggagtctgggggagcgtggtccggctggggggtccctgagctctcctgttctgcgtctggattcatctttagtaaatctggcatgtcctggtccncaggttccaggccacgggctggaatgggtgccagatatacaatattagntgaanaagtaaataatatatagagactcttacaggacgacttcaccatcncanacacaattaccaaataacatagtagtatctananaananacacgacgacgagagacgacggacgtacgttacgttagttagtaaggtaggtaacgtaacgtacgtacgtacgtactacg

SEQ ID NO: 421942 - DNA, 694 bp, Homo sapiens
  misc_feature: GZ8MTXP02FL846.10.21.B10.1.454.CMB.2.raw
  modified_base (341)..(341): a, c, t, g, unknown or other
  modified_base (405)..(405): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcgttgggtttttccctcgttgtcttacttttaaagagtatgtccagtgtcagatgcagagtggtggagtcggtgggggaggtcggtcgggtccgggccggtcggggggtccctggacgtactccgtcgttgtctgcgtcgtggtattctattactttagtaactgtggcagttcgtccgtcgggtcccncgtcggtccgaggccgacgggctgggagtggggtgaccgtagtatagtataatagtacgagtanaaacgtaaaataaaactattaagtagtaggaccttacgttacccgttagaaacggtccgtaacttacccgaacctactacctccgaaacggtaactaaaccctaaacttaaacccgaaaagtaaaccgtagtttagggttattaacgtcgtaacggaaactaaacgaccgtaaaccgtacgaccgtaaggacggaacggaccggtaacgggtaacgtttacgggtttagttaacgttaggtaagggtaacgggtaaacgtagttaccggttaggtccgtacttaaccgg

SEQ ID NO: 421943 - DNA, 788 bp, Homo sapiens
  misc_feature: GZ8MTXP02JA49Q.10.21.B10.1.454.CMB.2.raw
tcagcatagtagtgcacgaccggtgctcgatttagtgtcgtcgcaagaggagaggggggagagcccagcactagaagtcggcggtgcctccattcggtgatcagcactgaacacagaggactcaccatggagtttgggctgagcttgggttttcctcgttgcttcttttaagacgtatgtccagtgtcagatgcagagtggtggacgtcggtgggggaggcggttgggtcccgggtccggttcggggggtcccctggaacgtccttctcccttggttctagcgttctggaattcattcttaagtaaacttcgtggtctagtcgtccgttgggtccgcgtacggtttccgaaggcccggacggcgtaggaacgtggggtgacgagtacgtaataactaaacgtagtcgaaagtacgtaaacgtaaaggttaaaaattacgtaattaaacggtacggtaaacgtacctttaacccgtttaaccggtaaacgggggtacccgttaaacttacccgtaaaccctaacgtttaccctaaccccgaaaaggaaaccggtaaacctaaactttaaaccccgaaaagtaaaccgttaaaggttccggtttacggtaaagttacctttagaaacgtaaaaccgttacgaacctacgaccgtacgaacggtaacgggtaccggaacgggtaaccgttaacggggttacgtttaaacggttaacgttacgggtagggtaaaaccgtaagtaccgttaacggtacggctaacgtcgttaacccggtgtttaactttcggg

SEQ ID NO: 421944 - DNA, 661 bp, Homo sapiens
  misc_feature: GZ8MTXP02HWQ3Q.10.21.B10.1.454.CMB.2.raw
  modified_base (297)..(297): a, c, t, g, unknown or other
  modified_base (301)..(301): a, c, t, g, unknown or other
  modified_base (406)..(406): a, c, t, g, unknown or other
  modified_base (508)..(508): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagtcgttgggttttcctcgttgcttcttttaagagtatgtccagtgtcagatgcagagtgggtgggaggtcggtggggggaggcggttcggggtcccgggtccggttcggggggttccctggacggaccttctccgtgttctgcgtntggnttcattcttaagtaatctggtcagttcgtccgtcgggtcccgccgtacggttcccagggcccgacgggtcgtaggggagtggggtcgacagtataactacgaatntagatagaactaaagtaaaattatacagttggaatctaccgttacggaacggtcgtactacgacctactctaccgagactaaactaacttaccgaaaacgtntaaacggttggtaattacgtcttacgaaacgtaaatccgaaacgtcgacccggtagggacgaccggacggtaacggtaacggttacgggtttacgtttaagtacggtaaggtaacggtaaacgttacgtaacgtacgggtacgtacttaaccg

SEQ ID NO: 421945 - DNA, 679 bp, Homo sapiens
  misc_feature: GZ8MTXP02FWRYV.10.21.B10.1.454.CMB.2.raw
  modified_base (371)..(371): a, c, t, g, unknown or other
  modified_base (480)..(480): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcgtggtttcctcgtagctctttaagagatgtccagtgtcagatgcagatggtggagtcgtgggggagcggtgggtccggccggtgggggtccctggacgtaccgtctcccttgttctgcgtctggattcattctttagtaaatctggcatgtccgtgggtccgcacggttccacgggtccacggggtctaggaatcggggtggccagtatatacaatanggatcgaataaagtaaaatagtaacttagtgaacgtacttccgttacgaacgggtcgtaactttacaccctatcctacgaacaccaaactaaacgttacaaacggtaanagttaagttaggtaactccggtgtaactaaaacgttcggtaaccacgttacccggtaacgacccgggttaaaggacccgggaaagggtaaccgttaacccgggggttttaggttttaaaaccgtttacggtttaacggggacggggtaaaagggtaaaacttaccccggtttaaaggccccggggtatttaaacccggg

SEQ ID NO: 421946 - DNA, 695 bp, Homo sapiens
  misc_feature: GZ8MTXP02F4383.10.21.B10.1.454.CMB.2.raw
  modified_base (250)..(250): a, c, t, g, unknown or other
tcagcatagtagtgcacgaccggtgctcgatttagtgtcgtcgcagagagagggggagctctgggagaggagcccagcactagaagtcggcggtgcctccattcggtgatcagcactgaacacagaggactcaccatggagtttgggctgagcttgggttttcctcgttgcttcttttaagagtatgtccagtgtcagatgcagatgggtggagtcgtgggggagcggtggtccggccgtgggggtcccngagctctcctgtctgtcgtctggattctattacttaagtaatcgtggctagtcgtccgtcggggtcccgccgtacggttcccgacgggcccgacggggtccgtagggaagtggggtagcccgagtaactaataacaagttactagatagaaactaaagttaaaaatacgttaactaagtaggtaacgtaccttacccgttacgaaacggggtccctaacttaccaacctatacctaccgaagtaacgaaacctaaacgttacccaaaagtaacgtagttagggtacttaacgttaccgtagtaaccgtaaaaactccggtaaacccgtacgtacccgtaggaaccggaacggacccgggtaaacgggtaaccggtacgggtttagttaacgttaccgtaagggtaacggaacgttaaaccgtcgttacggtacggactttaacgg

SEQ ID NO: 421947 - DNA, 565 bp, Homo sapiens
  misc_feature: GZ8MTXP01DHQ5M.15.25.C03.1.454.CMB.2.raw
  modified_base (355)..(355): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacatattggattggtactgcagaagccaggcagtctccacaactctgattctagtttgggttactaagtccgggcctccggggtccccctgactggttcagtgcngtggatcgaggcaagtatatttacactagaaaatcagacaaggaggtgggagcgtaggtagggtacggtttaggggtttaattacgttggctatgacgtaaaggtactaaaccgaaaccccgtatcctaaccgttcggaacggacggacgtacgccgtaggaacgttaacgttaaacgactgtacggctcggaccacctaacttcgttcg

SEQ ID NO: 421948 - DNA, 524 bp, Homo sapiens
  misc_feature: GZ8MTXP01DD3TU.15.25.C03.1.454.CMB.2.raw
  modified_base (344)..(344): a, c, t, g, unknown or other
  modified_base (354)..(354): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcaccccctggagagccggcctccatctcctgcaggtctagtcagagcctccagcatactgatggatacaactattggattggtacctgcagaagccagggcagtctccacaactcctgatcttattgggttctaagtcggctccggggtccccctgacngttcagtgcngtggatcaggcatagatttacactagaaatcagcagaggtggaggctagaggtacggttggggtttattacttggactagtgcaaggtctaaaccaaacccgtatacaccgttcggccgagggcacgccgtaggagaagttaacgaactgtaggctgcaccaagttcctg

SEQ ID NO: 421949 - DNA, 551 bp, Homo sapiens
  misc_feature: GZ8MTXP01D7CUA.15.25.C03.1.454.CMB.2.raw
  modified_base (358)..(358): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctccagcatactgatggatacaactattggattggtacctgcagaagccagggcagtctccacaactctgatcttatttgggttctaagtcgggcctccgggggtcccctgacaggttcagtggcngtggatcaggcatagtattttacactagaaaatcagcagagtggaggcgtgaggacggttggggtttaggtttaacgttgtctagtgcgaacggtacgtaaccaaacccgtactacgtaccgttcggccggacgggacgacgccgtaggagaagttaaacgttaacgtaagtggcgtcgcactaacttcttcg

SEQ ID NO: 421950 - DNA, 579 bp, Homo sapiens
  misc_feature: GZ8MTXP01DLOY2.15.25.C03.1.454.CMB.2.raw
  modified_base (403)..(403): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcccgcaggtctagtcagagcctccagcatactgatggatacaactatttggattggtacctgcagaagccagggcagtctccacaactcctgatctagtttgggtctaatcgggcctccggggtcctgacaggttcagtggcagtggatcgaggcatagtattttacactagaaaatcagcagagtggaggngtaggaggtaggtttagggtttaattacggtgtactagtagacgtaaacgtacctaaaccgaaacccgactaccgtaccgttccggaccggaacgggaacgaccgtacgttaaggaaacgtaaacgttaaaacgacgttaggtcggtcgtaacgaccacttacgttcgttcgttcc

SEQ ID NO: 421951 - DNA, 523 bp, Homo sapiens
  misc_feature: GZ8MTXP01EE540.15.25.C03.1.454.CMB.2.raw
  modified_base (496)..(496): a, c, t, g, unknown or other
  modified_base (521)..(521): a, c, t, g, unknown or other
tcagtctacgtagccacgaccggtgctcgatttagtagtgtagatttgggtttgggtgatcaggactcctcagttcaccttctcacaatgaggctccctgctcagctcctggggctgctaatgctctgggtctctggatccagtggggatattgtgatgactcagtatccactctccctgcccgtcacccctggagagccggcctccatctcctgcaggtctagtcagagcctccagcatactgatggatacaactatttggattggtacctgcagaagccagggcagtctccacaactcctgattctatttggttctaatcgggcctcccggggtccctgacaggttcaagtgcagtggatcaggcatagatttacactgaaatcagacagagtggagcgtggaggtacggtttggggggtttattacgttgcagtgactaaggtactaaccaaaccccggtatccaccgttcggccgagggacacgcctggagnttaaacgaactgtggctgctaaccntc

SEQ ID NO: 421952 - DNA, 514 bp, Homo sapiens
  misc_feature: GZ8MTXP01A79TO.15.25.C03.1.454.CMB.2.raw
  modified_base (352)..(352): a, c, t, g, unknown or other
tcagtctacgtagccacgaccggtgctcgatttagtagtgtagatttgggtttggggatcaggactcctcagttcaccttctcacaatgaggctccctgctcagctcctggggctgctaatgctctgggtctctggatccagtggggatattgtgatgactcagtctccactctccctgcccgtcacccctggagagccgctccatctcctgcaggtctagtcagagcctccagcatactgatggatacaactattggattggtacctgcagaagccagggcagtctccacaactctgatctatttgggtctaagtcgggcctccggggtccccctgacaggttcagtggcngtggatcgaggcatagatttacactagaaatcagcagagtggagctgaggtacgttggggtttatactgcagtgcaaggtctaaaccgaacccgtatccaaccgttcggccgagggacacgcgtaggaagagttaaacgactgtggctgacactaattcgtg

SEQ ID NO: 421953 - DNA, 505 bp, Homo sapiens
  misc_feature: GZ8MTXP01A5RJV.15.25.C03.1.454.CMB.2.raw
  modified_base (502)..(502): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagagccggcctccatctcctgcaggtctagtcagagcctccagcatactgatggatacaactatttggattggtacctgcagaagccagggcagtctccacaactcctgatctattggttctaatcgggcctcccggggtcctgacaggttcaagtgcagtggatcaggcatagatttacactagaatcagcagagtggaggctgaggtacgttggggggtttattacgtgcatgcaaggtctaacaacccgatcaccgtcggcgagggacacgcctggagattaaacgaactaggtgctgcaaccntcg

SEQ ID NO: 421954 - DNA, 531 bp, Homo sapiens
  misc_feature: GZ8MTXP01A9CVZ.15.25.C03.1.454.CMB.2.raw
  modified_base (357)..(357): a, c, t, g, unknown or other
tcagtctacgtagccacgaccggtgctcgatttagtagtgtagatttgggtttggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctccagcatactgatggatacaactattggattggtacctgcagaagccagggcagtctccacaactcctgatctatttgggttctaagtcgggcctccggggtccccctgacaggttcagtggcngtggatcgaggcatagatttacactgaaatcagcagagtggaggcgtgaggacgttagggtttaggttacgtgtcgagtgcgaagtacgtacaaacccgtaactactaccgtcgccgacggacgacgccgtcggagagttaacgaacgtaagtagcgtcgcactaacgttctcg

SEQ ID NO: 421955 - DNA, 598 bp, Homo sapiens
  misc_feature: GZ8MTXP01BCKVC.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccaggcagtctccacaactcctgatctagtttgggtactaagtcgggctccggggtccccctgacaggttcagtgcaaggtgatcgaggcaagtagtatttacactagaaatcaagcaagaggtggaggcgtggagggtacggtttaggggtttattacgtggactagtggacaagggtacctaaaccgaaaccccgtatacccgtaacccgttccgggaaccgaacggggacccaaccgccgttagggaacgttaacgtttaaaaccggaaccgttaaggtcgggtaacttacggacccttaccgtaagttcctttcgg

SEQ ID NO: 421956 - DNA, 505 bp, Homo sapiens
  misc_feature: GZ8MTXP01BTJ4M.15.25.C03.1.454.CMB.2.raw
tcagtctacgtagccacgaccggtgctcgatttagtagtgtagatttgggtttgggtgatcaggactcctcagttcaccttctcacaatgaggctccctgctcagctcctggggctgctaatgctctgggtctctggatccagtggggatattgtgatgactcagtatccactctccctgcccgtcacccctggagagccggcctccatctcctgcaggtctagtcagagcctccagcatactgatggatacaactattggattggtacctgcagaagccagggcagtctccacaactcctgatctatttggtctaagtcgggcctcccggggtcctgacaggttcaagtggcagtggatcaggcatagatttacactagaatcagcagagtggagctgaggtacgttggggggtttattacgtgcatgcaaggtctacaaaccccgatccactcggcgagggacacgcctggagattaaacgaactgtggctgcaaccgaatcg

SEQ ID NO: 421957 - DNA, 510 bp, Homo sapiens
  misc_feature: GZ8MTXP01AZX18.15.25.C03.1.454.CMB.2.raw
  modified_base (352)..(352): a, c, t, g, unknown or other
  modified_base (448)..(448): a, c, t, g, unknown or other
tcagtctacgtagccacgaccggtgctcgatttagtagtgtagatttgggtttggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcagcatactgatggatacaactattggattggtacctgcagaagccagggcagtctccacactcctgatctatttgggtctaagtcgggcctccggggtccccctgacaggttcagtgcngtggatcgaggcatagtatttacactagaaatcagcagagtggagctgaggtacgtttggggttattacgtgcagtgcaaggtctaacaacccgtntacacctcggcgaggacacgccgtggaacgagttaaacgacgtgtacggctgcactgttctg

SEQ ID NO: 421958 - DNA, 545 bp, Homo sapiens
  misc_feature: GZ8MTXP01AHO95.15.25.C03.1.454.CMB.2.raw
  modified_base (361)..(361): a, c, t, g, unknown or other
  modified_base (469)..(469): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacactcctgatctagtttgggtactaagtccgggcctccggggtccccctggactaggttcaggtggcnggtggatcgaggctagtagtatttacactagaaatcagcagagtggagcgtgagggtacgtttggggtttattacgtgcagtgacgtaaggtcctaaccaaacccgtntaccgaccgttcggaaccgagggacacggcgtaggagttaacgttaaacgactggtgtcgtcgcacctaattcgtg

SEQ ID NO: 421959 - DNA, 512 bp, Homo sapiens
  misc_feature: GZ8MTXP01CJWGL.15.25.C03.1.454.CMB.2.raw
  modified_base (355)..(355): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcaccccctggagagccggcctccatctcctgcaggtctagtcagagcctccagcatactgatggatacaactattggattggtacctgcagaagccagggcagtctccacaactctgatctatttgggtctaatcgggcctccggggtccccctgacaggttcagtggcngtggatcaggcatagatttacactagaaatcagcagagtggaggctgaggtacgttggggtttattacgtggtcagtgcgaaggtctaacaacccgtatcaccgttcggcgaggacacgcgtaggagagttaacgacgtgtggctgcactgttctcg

SEQ ID NO: 421960 - DNA, 522 bp, Homo sapiens
  misc_feature: GZ8MTXP01EQ4K9.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttggtctaagtcgggcctcccggggtcctgacaggttcaagtgcagtggatcaggcatagatttacactagaaatcagacagagtggaggctaggaggtacggttggggggtttattacgtgcatgctaaggtactaaccaaacccgatccaccgttcggccgagggacacgccgtaggacgattaaacgaactgtggctgcaaccgaatcg

SEQ ID NO: 421961 - DNA, 565 bp, Homo sapiens
  misc_feature: GZ8MTXP01EWHLI.15.25.C03.1.454.CMB.2.raw
  modified_base (358)..(358): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatggattggtactgcagaagccagggcagtctccacaactcctgatcttagtttgggttactaagtcgggcctccggggtccccctgacaggttcagtggcngtgatcaggcatagtatttacactagaaaatcagcaagagtgggaggctaggaagggtacggtttagggggttttaattacgttgacgtatagacgtaaaggtacctaaaccgaaaccccgtatccgaacccgttcgggaaccggagggaccacggccgtaggaagaaagttaaacgaacttggtaggctggcacctaagttcgtcg

SEQ ID NO: 421962 - DNA, 520 bp, Homo sapiens
  misc_feature: GZ8MTXP01BQKKB.15.25.C03.1.454.CMB.2.raw
  modified_base (355)..(355): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctccagcatactgatggatacaactattggattggtacctgcagagccagggcagtctccacactcctgatctatttgggtctaatcgggcctccggggtccccctgacaggttcagtgggcngtggatcaggcatagtattttacactgaaaatcagcagagtggaggctgaggtacgttggggtttattacgtgtcatgcaaggtctaacaaacccgtatcaccgttcggcgagggacacgccgtaggacgagttaaacgaacgtgtaggctgcactaagttctcg

SEQ ID NO: 421963 - DNA, 542 bp, Homo sapiens
  misc_feature: GZ8MTXP01DZ6IH.15.25.C03.1.454.CMB.2.raw
  modified_base (401)..(402): a, c, t, g, unknown or other
  modified_base (412)..(412): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcagcatactgatggatacaactattggattggtacctgacagaagccagggcagtcctaccacaactctagatcttagtttgggtactaagtccgggcctccggggtccccctggacgtaggttcaggtgcaaggtgatcgaggcagtagtatttacatagaaatcannagagtggagntgaggtacgttgggtttatacgtgcagtgacgtaaggtacctaaaccaaaccccgtataccaccgttcggaaccgagggacacgcgtagggattaagttaaacgatggtagctgcacctaagttcgttcg

SEQ ID NO: 421964 - DNA, 512 bp, Homo sapiens
  misc_feature: GZ8MTXP01BHMBU.15.25.C03.1.454.CMB.2.raw
  modified_base (355)..(355): a, c, t, g, unknown or other
  modified_base (450)..(450): a, c, t, g, unknown or other
tcagtctacgtagccacgaccggtgctcgatttagtagtgtagatttgggtttggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctccagcatactgatggatacaactattggattggtacctgcagaagccagggcagtctccacaactcctgatctatttgggtctaatcgggctccggggtccccctgacaggttcagtgggcngtggatcaggcatagattttacactagaaatcagcagagtggaggctgaggtacgttggggttattactgcatgcaaggtctaacaaaccccgtntccaccttcggccgagggacacgccgtaggacgagttaacgactgtggctgcaccaattctg

SEQ ID NO: 421965 - DNA, 563 bp, Homo sapiens
  misc_feature: GZ8MTXP01D602I.15.25.C03.1.454.CMB.2.raw
  modified_base (355)..(355): a, c, t, g, unknown or other
  modified_base (391)..(391): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactctgatctatttgggtctaagtcgggcctccggggtccccctgacaggttcagtggcnggtggatcaggcatagtatttacactagaaatcagnagagtggagcgtagaggtacgttggggtttattacgtgctagtgacgtaggtactaaccgaaaccccgtatacctaccgttcggaaccggaacgggaccaccggccgtagggaagttaaacgtttaaaacgaaccgttgtacgggtctcggaccttacctaacttcgttccg

SEQ ID NO: 421966 - DNA, 529 bp, Homo sapiens
  misc_feature: GZ8MTXP01EXP31.15.25.C03.1.454.CMB.2.raw
  modified_base (357)..(357): a, c, t, g, unknown or other
  modified_base (486)..(486): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactcctgatctattttgggtctaagtcgggcctccggggtccccctgacaggttcagtggcngtggatcaggcatagtattttacactagaaatcagcaaggagtgggagcgtgaggtacggtttggggtttattacgttgcagtgacaaggtcctaacaaaccccgtatccaccgttcggccgagggacncgcgtaggagttagttaaacgactgtgctgccactaattctcg

SEQ ID NO: 421967 - DNA, 535 bp, Homo sapiens
  misc_feature: GZ8MTXP01APLPR.15.25.C03.1.454.CMB.2.raw
  modified_base (339)..(339): a, c, t, g, unknown or other
  modified_base (460)..(460): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagagccagggcagtctccacaactcctgatctatttgggtctaagtcgggcctccggggtcccccngacgaggttcaggtggcaagtcggatcaggcatagtatttacactagaaatcagcagaggtggaggcgtgagggtacgtttggggtttattacgtgcagtgcaaggtctaacaaacccgtntacaccgtcggccgaagggacacgccgtaggaacgttaagttaaacgacgtgtcggctggccactaacttcgtcg

SEQ ID NO: 421968 - DNA, 532 bp, Homo sapiens
  misc_feature: GZ8MTXP01ECT2B.15.25.C03.1.454.CMB.2.raw
  modified_base (349)..(349): a, c, t, g, unknown or other
  modified_base (383)..(383): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatggattggtacctgcagaagccagggcagtctcacaactctgatctatttgggtctaatcgggctccggggtcccctgacaggttcagtgcngtgatcaggcatagtatttacactagaaatcagnagagtggagcgtgaggtagtttgggttattacgtgacagtgacgtaaggtactaaaccaaacccgtataccgtaacccgttggaacccgagggaccacggccgtaggaagaagttaaacgaactggtggaactgcacctaagttcgttg

SEQ ID NO: 421969 - DNA, 674 bp, Homo sapiens
  misc_feature: GZ8MTXP01B6F2P.15.25.C03.1.454.CMB.2.raw
  modified_base (513)..(513): a, c, t, g, unknown or other
  modified_base (552)..(552): a, c, t, g, unknown or other
  modified_base (643)..(643): a, c, t, g, unknown or other
  modified_base (656)..(656): a, c, t, g, unknown or other
tcagtctacgtagccacgaccggtgctcgatttagtagtgtagatttgggtttgggggatcgggactcctcagttcaccttctcacaatgaggctccctgctcagctcctggggctgctaatgctctgggtctctggatccagtggggatattgtgatgactcagtctccactctcccctgccccgtcacccctaccggaggacgccggccccgtccctactccttcctcgtcgacggtacgttacgttacgacgaaggccctcccacgacactaacttagtagtaggtagtaactaaaccttaattttaggtagttaggttacccgttacgcgaacgaaaggacccgacgggacgacgtacttaccccaccaaacctacccttggtattactttacgttttaggggttttcgtaacgttaccgggcccggttcccgggggttccccgttcgacgtacggttcgtacgttggtcgagtggagtcaggacatagtattttacactagaaatacngacagagtggagcgtgaggtacgttggggtttattacgngtcatgacaaggttacctacaaaccccggctcgacccgttccggcggaacgggattaccggcccttaggaaggtaacttaaacgttaacgngttgggctgaccncacgttcgttcgttaacc

SEQ ID NO: 421970 - DNA, 563 bp, Homo sapiens
  misc_feature: GZ8MTXP01BWP1K.15.25.C03.1.454.CMB.2.raw
  modified_base (352)..(352): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacactctgatctatttgggtctagtcgggcctccggggtcccctgactggttcagtggcnggtggatcgaggcatagtattttacactagaaatcagcaggaggtggaggcgtggaggtacggtttggggtttattacgtgctagtcgacgaacggtacctaaaccgaaaccccgtataccgtacccgttccgggcggaacgggaccaccggccgtagggaacgttaaacgttaaacggaacgtggtggcgtcgcttacctaattcgttcg

SEQ ID NO: 421971 - DNA, 530 bp, Homo sapiens
  misc_feature: GZ8MTXP01AH2HP.15.25.C03.1.454.CMB.2.raw
  modified_base (291)..(291): a, c, t, g, unknown or other
  modified_base (354)..(354): a, c, t, g, unknown or other
  modified_base (511)..(511): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctccagcatactgatggatacaactattggattggtacctgcagaagccagggcagtcnccacactctgatctatttgggttctaagtcgggcctccggggtcccctggacaggtcagtgcngtggatcgagctatagtatttacactagaaatcagcagagtggaggcgtgagggtacgtttggggtttattacgtgcagtgcgaaggtacctaaccaaaccccgtatccgaccgttcggccgagggacacggccgtaggaagacgttaaacgactgngctgccactaattcgttcg

SEQ ID NO: 421972 - DNA, 575 bp, Homo sapiens
  misc_feature: GZ8MTXP01E1H0D.15.25.C03.1.454.CMB.2.raw
  modified_base (345)..(345): a, c, t, g, unknown or other
  modified_base (357)..(357): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctccagcatactgatggatacaactattggattggtacctgcagaagccagggcagtctccacaactcctgatctatttgggtctaagtcgggcctccggggtccccctgacnggttcagtggcngtggatcaggcatagtattttacactagaaaatcagcagagtggaggctggaggtacggttggggtttattacgtggcagtgacgtaaggtactaaccgaaaccccgtataccaacccgttccgggccggaacggggaccaccggcccgtagggaacggttaaacttaaaacccgaacgttggtacgggtcctcggaccaacccctaagttccgttcg

SEQ ID NO: 421973 - DNA, 566 bp, Homo sapiens
  misc_feature: GZ8MTXP01AR4L3.15.25.C03.1.454.CMB.2.raw
  modified_base (290)..(290): a, c, t, g, unknown or other
  modified_base (358)..(358): a, c, t, g, unknown or other
  modified_base (472)..(472): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtcnccacactcctgatctagtttgggtctaagtcggggcctccggggtcccctgactaggttcagtgggcnggtggatcgaggctatagtatttacatagaaatcagcagaggtaggaggcgtaggagggtacggtttggggtttacttagtggcagtgactaaggtacctaaccgaaacccgtntaccgtaccgttcggaaccggacggaccgacgccgtaggtaacgttaacgttaaacgacgtggtggcgttacggccttaccgtaagttcgttcg

SEQ ID NO: 421974 - DNA, 560 bp, Homo sapiens
  misc_feature: GZ8MTXP01A6LPZ.15.25.C03.1.454.CMB.2.raw
  modified_base (286)..(286): a, c, t, g, unknown or other
  modified_base (334)..(334): a, c, t, g, unknown or other
  modified_base (351)..(351): a, c, t, g, unknown or other
  modified_base (402)..(402): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtggggatattgtgatgactcagtctccactctccctgcccgtcacccctggagagccggcctccatctcctgcaggtctagtcagacgcctccagcatactgatggatacaatatggattggactgcagagccaggcagtcncacactctgatcttagtttgggtactagtcgggcctccggggtccccngacaggttcaggtggcnggtggatcgaggctagtagtatttacactagaaatcagcaggagtggaggntaggacggtaggtttggggttattacgtggtcagtgacgtaacggtaccaaccgaaacccgtataccgtaccgttcgggaaccgaagggaccacggccgtaggaacgttaacgttaaacgacgtaaggtcggcgtacggccttacgtaacgttcttcg

SEQ ID NO: 421975 - DNA, 522 bp, Homo sapiens
  misc_feature: GZ8MTXP01A3VAF.15.25.C03.1.454.CMB.2.raw
  modified_base (334)..(334): a, c, t, g, unknown or other
  modified_base (349)..(349): a, c, t, g, unknown or other
  modified_base (392)..(392): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacactctgatctatttgggtctaatcgggctcggggtccccngacaggtcagtggcngtgatcaggcatagatttacactgaaaatcagcagagtggagngtgaggagttgggttaggttacgtgtgagtgacgacgtacgtaccaacccgtactacgtaccgtcggcggacggacgacgacgtacggaagaacgttaacgttacgtgtcggcgtcgcactcgttcgtcg

SEQ ID NO: 421976 - DNA, 578 bp, Homo sapiens
  misc_feature: GZ8MTXP01DVZ3X.15.25.C03.1.454.CMB.2.raw
  modified_base (364)..(364): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactcctgatcttagtttgggttactaagtccgggccgtccggggtccccctggacaggttcaggtggcnggtggatcgaggcatagtatttacactagaaatcagacagaggtggagtcgtaggaggtacggtttaggggtttaattacgtgtactagtcgacgtaacggtacctaaaccgaaaccccgtactaccgtacccgtcggaaccggaacgggacaccgccgtaggaagttaacgttaaaccgaacgtggtacgcgtcgaccactaacgttcgttcg

SEQ ID NO: 421977 - DNA, 551 bp, Homo sapiens
  misc_feature: GZ8MTXP01C5P8T.15.25.C03.1.454.CMB.2.raw
  modified_base (298)..(298): a, c, t, g, unknown or other
  modified_base (350)..(350): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtactgcagaagccaggcagtctccacaactcngatctattggtctaactcgggcctccggggtccccctggacaggtcagtgcngtggatcgaggcagtagtatttacactagaaaatcaagcaagagtggaggctagaggtacggtttgggtttattacgtgtcagtgacgtaaggtacctaaccaaaccccgtataccgtaacccgttcgggaacccgtaagggaccgacgccgtaggaacgttaagttaaacgaacgtggtagctggccactaacttcttcg

SEQ ID NO: 421978 - DNA, 513 bp, Homo sapiens
  misc_feature: GZ8MTXP01DSAWK.15.25.C03.1.454.CMB.2.raw
  modified_base (354)..(354): a, c, t, g, unknown or other
  modified_base (513)..(513): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctccagcatactgatggatacaactattggattggtacctgcagaagccagggcagtctccacaactctgatctatttgggtctaatcgggctccggggtccccctgacaggttcagtggcnggtggatcaggcatagtattttacactagaaaatcagcagagtggaggctgaggtacgttggggtttattactgcatgcaaggtctaacaaacccgtatcaccttcggcgagggacacgccgtggagagttaaacgaactgtggctgcaccaattcgtn

SEQ ID NO: 421979 - DNA, 521 bp, Homo sapiens
  misc_feature: GZ8MTXP01CAGP5.15.25.C03.1.454.CMB.2.raw
  modified_base (290)..(290): a, c, t, g, unknown or other
  modified_base (361)..(361): a, c, t, g, unknown or other
  modified_base (397)..(397): a, c, t, g, unknown or other
  modified_base (407)..(407): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (452)..(452): a, c, t, g, unknown or other
  modified_base (507)..(507): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtcnccacaactcctgatctatttgggtactaagtcggggcctccgggggtccccctggactaggttcagtggcngtggatcgaggctatagtatttacatagaaatcagnagagtggagngtgaggtagttggttatagtgnagnganaagtacaaccaaacctntaccgtacgtcggaacggagacgacgcgtaggaacttaagttaacgacgtgtgcngaccactcttcgtg

SEQ ID NO: 421980 - DNA, 603 bp, Homo sapiens
  misc_feature: GZ8MTXP01DLZK3.15.25.C03.1.454.CMB.2.raw
  modified_base (360)..(360): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactcctgattcttagtttgggtctaagtccgggcctccggggtccccctgacaggttcagtggcngtggatcgaggcatagtatttacactagaaaatcagcaggagtggaggcgtggaggtacggtttaggggtttattacgtggactagtgacgtaacggtacctaaaccgaaaccccgtactaccgtaacccgttccgggaaccggaacggggaccgtaaccggacccgtaagggtaacgttaaacgtttaaaacggaaccgttaagggttacggccttacggaccaccgtaacgttccgtttcg

SEQ ID NO: 421981 - DNA, 560 bp, Homo sapiens
  misc_feature: GZ8MTXP01BCOKG.15.25.C03.1.454.CMB.2.raw
  modified_base (343)..(343): a, c, t, g, unknown or other
  modified_base (355)..(355): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccaggcagtctccacaactctgatcttatttgggtctaagtcgggcctccggggtcccctggacnggttcagtggcngtggatcaggcatagtattttacactagaaatcagcgagagtggaggcgtaggagggtacggtttagggggtttattacgtggcagtcgcgaaggtcctaaccgaaaccccgtataccgaccgttccgggaaccggagggaccacgccgtagggaacgttaacgttaaacgaacgtggtacggctcgacacctaagttcttaacg

SEQ ID NO: 421982 - DNA, 593 bp, Homo sapiens
  misc_feature: GZ8MTXP01EHF0M.15.25.C03.1.454.CMB.2.raw
  modified_base (292)..(292): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgccccgtcacccctggagagccggcctccatctcctgcaggtctagtcagagcctccagcatactgatggatacaactatttggattggacctgcagaagccagggcagtcnccacaactctgattcttagtttggttctaagtccgggcctccccggggtcctgactaggttcaaggttgcagtggatcgaggcattacgtatttacactagaaatcagacaggtaggtgggaggcgtggtagggttacggtttggggggtttaattacgtgctagtgacgtaacggtacctaaccgaaaccccgtataccgtaacccgttcgggcccggaggggaccttacggtaccgtaggaacgttaacgtttaaaacggaacgttagtgggtctcggacctaacccgttaatttcccg

SEQ ID NO: 421983 - DNA, 617 bp, Homo sapiens
  misc_feature: GZ8MTXP01A90NP.15.25.C03.1.454.CMB.2.raw
tcagtctacgtagccacgaccggtgctcgatttagtagtgtagatttgggtttggggatcaggactcctcagttcaccttctcacaatgaggctccctgctcagctcctggggctgctaatgctctgggtctctggatccagtggggatattgtgatgactcagtctccactctccctgcccgtcacccctggagagccgcctccatcctcccgcaggtctagtcagagcctccagcatactgatggatacaactattggattggtacctgcagacgccaggcagtcctccacaactcctgatcttagtttggtctaagtccggccgtccgggtccctgactaggtcaggtgacagtgatcaggctagtagtattttacacttagaaatcgagacgaggtaaggtgggaggtacgtgggtaacgggttacggtttaggggtttacttaacgggtggctaagtcggaacgtaacggttacctaaccgaaacccccgtattccccgaaccgttcccggaccggaagggaccaaccggtcccgttagggaaacgtaacgtttaaaacggaccgtttaggcgggtccttaacggaccacccgttattcgttcggttttccc

SEQ ID NO: 421984 - DNA, 567 bp, Homo sapiens
  misc_feature: GZ8MTXP01CA06P.15.25.C03.1.454.CMB.2.raw
  modified_base (355)..(355): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctcacaactctgatcttatttgggtctaagtcgggcctccggggtccccctgacaggttcagtggcngtggatcgaggcatagtatttacactagaaatcagcagagtggaggctggaggtacggtttaggggtttattacgtggacagttgacgtaacggtactaaaccgaaaccccgtatacctaccgttccgggaaccggaacgggaccaccggccgtagggaacgttaaacgttaaaacggaacgtggtacggctggaccaacctaattcgttcg

SEQ ID NO: 421985 - DNA, 560 bp, Homo sapiens
  misc_feature: GZ8MTXP01ALGKZ.15.25.C03.1.454.CMB.2.raw
  modified_base (394)..(394): a, c, t, g, unknown or other
  modified_base (468)..(468): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctccagcatactgatggatacaactattggattggtacctgcagaagccagggcagtctccacaactcctgatctagtttgggtctaagtcgggcctccggggtccccctgacaggttcagtgcaagtggatcgaggcatagtatttacactagaaatcagnagagtggaggcgtgaggtacgtttggggtttattacgtggcagttgactaacggtacctaaccgaaaccccgtntaccgtaccgttcgggaaccggaacgggaccgaccgccgtaggaacgttaacgttaaacgaacgtgggtcgctgccacctaagttcttaacg

SEQ ID NO: 421986 - DNA, 522 bp, Homo sapiens
  misc_feature: GZ8MTXP01B0CM6.15.25.C03.1.454.CMB.2.raw
  modified_base (355)..(355): a, c, t, g, unknown or other
  modified_base (457)..(457): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactcctgatctatttgggtctaatcgggctccgggggtccccctgacaggttcagtggcngtggatcaggcatagatttacactagaaatcagcagagtggaggcgtgaggtacgttggggtttattacgttggcatgacgaaggtcctaacaaaccccgtntccaccgttcggccgagggacacgccgtggagttagttaacgactggtggctgcacctaattctg

SEQ ID NO: 421987 - DNA, 608 bp, Homo sapiens
  misc_feature: GZ8MTXP01ENRAG.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagcccggcctccatctcctgcaggtctagtcagagcctccagcatactgatggatacaactattggattggtacctgcagaagccaggacagtctccacaactctagatcttagtttgggtactaagtccgggccgtccggggtccccctgacgtggttcaggtcggctggtggatcgaggctatagtatttacactagaaatcagacgaaggaggtgggaggtcgtagggtagggttacgggtttaggggtttaattacgtgtactagtacggtacgtaaacggttacctaaaccgaaaccccgtagtacccgtaccggttccgggaaccgggaacggacgaccgttccgtaagggtaacgttaaacgttaaacgaacgttggtacggctcgaccttaactcttcgttcg

SEQ ID NO: 421988 - DNA, 605 bp, Homo sapiens
  misc_feature: GZ8MTXP01C1H25.15.25.C03.1.454.CMB.2.raw
  modified_base (384)..(384): a, c, t, g, unknown or other
  modified_base (393)..(393): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtgggatattgtgatgactcagtatccactctccctgcccgtcacccctggagacgccggcctccatctcctgcaggtctagtcagagcctcagcatactgatggaatacaactatttggattggtacctgcagaagccagggcagtctcacaactcctgatctagtttgggtactaagtcgggtcctccccggggtccctggacaggttcaagttgcagtgatcgaggcatagtatttanactagaatnagagagagtggaggagtaggaggtagggtttaggggggtttagtttaacgttgtacgtagtagtacgtaacggttaccgttaaccgtaaaccccggtaacctaccgtaccgttaaccgggtaccggacgggtaaccgaccgaccgtacggttaaggttaacgttaaacgtaaccgtaggttcggcgtacggacgaaccgttaacgttaaccg

SEQ ID NO: 421989 - DNA, 579 bp, Homo sapiens
  misc_feature: GZ8MTXP01BQQM5.15.25.C03.1.454.CMB.2.raw
  modified_base (476)..(476): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactcctgatctatttgggtctaagtcgggcctccggggtcccctgacaggttcagtgctaaggtggatcgaggcatagtatttacactagaaatcagacaggaggtggggactggagggtacgtttaggggtttattacggtgtacgatacggacgaacggtcctaaaccgaaaccccgtntacccgtaaccgttccggacccggaacgggaccaccggccgttaggaaacgtaacgttaaacggacttaggtcggctaacgacaccttattccgttcgtttcc

SEQ ID NO: 421990 - DNA, 538 bp, Homo sapiens
  misc_feature: GZ8MTXP01B2R3P.15.25.C03.1.454.CMB.2.raw
  modified_base (356)..(356): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactcctgatcttatttgggttctaagtcgggcctccggggtcccctgacaggttcagtgcngtggatcaggcatagtatttacactagaaaatcagcagaggtggaggcgtggaggtacggtttggggtttattacgtgcagtgacaaggtacctaaccaaacccgtactcctaccgttcggaaccggagggaccacgccgtaggaagttacgttaaacgactgtgctgcacctaattcgtcg

SEQ ID NO: 421991 - DNA, 632 bp, Homo sapiens
  misc_feature: GZ8MTXP01AYMP3.15.25.C03.1.454.CMB.2.raw
  modified_base (270)..(270): a, c, t, g, unknown or other
  modified_base (334)..(334): a, c, t, g, unknown or other
  modified_base (349)..(349): a, c, t, g, unknown or other
  modified_base (410)..(410): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctccagcatactgatggatacaatattggattagtacngcagaacgcaggcagtcacacaactctgatctagtttggtactagtcgggcctccggggtcccngacgtggtcagtgcnggtggatcgaggctaagtagtactttacactagaaaatcgaagtcgaaggaggtgggaggngtagggtaagggttacgggtttaggggtttaacttacgtagtacgtagtaggtaccgtaaacgggttacctaaaaccgaaccccgtacgtacccgtaacccgttaccggggaacccggaacgggaaccgtaccgggaccggttaaggggtaaacgttaaacgtttaaacggaaacgttgggtacggtaactacggaccttacccgtaacgttccgtttccgg

SEQ ID NO: 421992 - DNA, 563 bp, Homo sapiens
  misc_feature: GZ8MTXP01CNEEB.15.25.C03.1.454.CMB.2.raw
tcagtctacgtagccacgaccggtgctcgatttagtagtgtagatttgggtttgggtgatcaggactcctcagttcaccttctcacaatgaggctccctgctcagctcctggggctgctaatgctctgggtctctggatccagtggggatattgtgatgactcagtatccactctccctgcccgtcacccctggagagccggcctccatctcctgcaggtctagtcagagcctccagcatactgatggatacaactattggattggtacctgcagaagccagggcagtctccacaactcctgattctatttgggttactaagtcgggcctccccggggtccctgacaggttcaagtgcagtggatcaggcatagtatttacactagaaatcagcagagtggagcgagagggtacggtttggggggtttaattacgtgacagtgacgaaggtacctaaccgaaaccccgtactaccgaccgttccgggaccggacggggaccacggacccgtgggaacggttaacttaaacgaactaggtggctggaccaaccgttaagttccg

SEQ ID NO: 421993 - DNA, 591 bp, Homo sapiens
  misc_feature: GZ8MTXP01DTJ52.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactcctgatcttagtttgggttctaacgtcgggcctccggggtccccctgacaggttcagtgcaagtggatcaggcatagtatttacactagaaatcagcaggagtggaggcgtagagggtacgtttagggggtttattacgtggtactagtgacgtaaggtaccttaaaccaaaccccggtataccgtaccgttccggggaaccgtacggggaccaccggcccgttagggaacgttaaacgttaaaaccgttaacgtgggtagggccttacggaccttacctaagttcccgtttg

SEQ ID NO: 421994 - DNA, 604 bp, Homo sapiens
  misc_feature: GZ8MTXP01B5HUL.15.25.C03.1.454.CMB.2.raw
  modified_base (369)..(369): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccgagggcagtcctaccacaactcctgattcttattttgggttctaagtccggggccgtccgggggtccccctggactaggttcagtggcnggtggatcagggcagtagtaatttacactagaaatcagcagagtgggaggcgtagaggtacgggtttggggtttattacgtgacgtagtgacgtaacggtacctaaaccgaaaccccgtatacctacccgttcggggaacccggaacggggaccgaccggttaccgtaggggtaacgttaacgtttaaaaccggaaccgttgggtacggtcgtacggcttaccctaattcgttcg

SEQ ID NO: 421995 - DNA, 594 bp, Homo sapiens
  misc_feature: GZ8MTXP01EX65E.15.25.C03.1.454.CMB.2.raw
  modified_base (366)..(366): a, c, t, g, unknown or other
  modified_base (404)..(404): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagcccggcctccatctcctgcaggtctagtcagacgcctccagcatactgatggatacaactattggattcggtacctgcagaagccgagggcagtctccacaactctgattcttagtttgggtactaagtccgggcctccggggtcccctggactaggttcaggtggcnggtggatcgaggctatagtatttacactagaaatcagnagagtaggaggcgtggaggtacggtttgggtttattacgtggtactagtgacgtaacggttacctaaaccgtaaacccgtactaccgtacccggttccgggaaccggaacggggaccaccgggttaccgtagggaacgttaaacgttaaaacggacgttggtacggctcggaccttaactcgttcgttcg

SEQ ID NO: 421996 - DNA, 565 bp, Homo sapiens
  misc_feature: GZ8MTXP01C1G1C.15.25.C03.1.454.CMB.2.raw
  modified_base (360)..(360): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagtaagccagggcagtcctccacactctgatcttagttgggttctaagtccgggcctccggggtccccctgacgtggttcagtggcngtggatcgaggcatagtatttacactagaaaatcagcgagaggtggaggcgtgagggtacggtttggggtttattacgtgtcagtcgacgaacggttacctaaacccaaaccccgtataccgaccgttccgggaaccggaacgggaccaaccggcgtacggaagttaacgttaaacgacgtgtcggctgccactaacgttcgtcg

SEQ ID NO: 421997 - DNA, 563 bp, Homo sapiens
  misc_feature: GZ8MTXP01DHU4Q.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactctgatcttatttgggttctaagtccggggcctccggggtccccctggacaggttcaggtggcaaggtggatcgaggcatagtatttacactagaaatcagcagagtggaggcgtaggaggtacgtttaggggtttattacgtgacagtgacgtaaggtacctaaaccaaacccgtataccgaccgttccgggaaccggaagggaccacggccgtaggaagttaacgttaaacgaacgtggtaggcgtgacacctaagttcgttcg

SEQ ID NO: 421998 - DNA, 620 bp, Homo sapiens
  misc_feature: GZ8MTXP01BEZWL.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagcccggcctccatctcctgcaggtctagtcagagcctccagcatactgatggatacaactattggattggtacctgcagaagccaggcagtctcacactctgatctagtttggtctagtcggcctccggggtcccctgacaggtcagtggctggtggatcgaggctagtagtactttacactagaaaatcaagcgaaggtaggtgggaggtacgtgggtaagggttacgggtttaggggtttaatttacgtggtacctagtacggacgtaaacgggttacctaaacccgtaaaaccccgtattacccgtaacccggttcgggaacccggaacggggacccaccgggttcccgtagggaaacgttaaacgtttaaaaccgaacgttaacggtcggtaaccgttacgacacctaacgttcgttcg

SEQ ID NO: 421999 - DNA, 621 bp, Homo sapiens
  misc_feature: GZ8MTXP01AZCRG.15.25.C03.1.454.CMB.2.raw
  modified_base (421)..(421): a, c, t, g, unknown or other
  modified_base (435)..(435): a, c, t, g, unknown or other
tcagtctacgtagccacgaccggtgctcgatttagtagtgtagatttgggtttggggatcaggactcctcagttcaccttctcacaatgaggctccctgctcagctcctggggctgctaatgctctgggtctctggatccagtggggatattgtgatgactcagtctccactcctccctcgccccgtcacccctggagacgcccggcctccatcctcctgcaggtctagtcagacgcctccagcatactgatggactacaacttgtggattcggtacctgacagacgccgagggcacgtcctaccaacctactccgtagtacttcgtttaagtttcgggtactaacggtccgggtccgttccggggtcccctgacgtaggttcaggtcgactggtgatcgagtctaatagtattacataanaaatcgagagaggngtagggagtcgtagggtacggttaggtttagggttattacgtggtacctagttacgaacgtaacggtacctaaaccgacccgtagtaccgtaccgggtcggaacccggaggaccgtacgttacgtaagggtaacgttaacgtttaaccgaggttggacgtcgtacgaccttaccgttcgttccgtc

SEQ ID NO: 422000 - DNA, 564 bp, Homo sapiens
  misc_feature: GZ8MTXP01ARFAU.15.25.C03.1.454.CMB.2.raw
  modified_base (351)..(351): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctccagcatactgatggatacaactatggattggtacctgcagaagccagggcagtctcacactctgatctatttgggtctagtcggcctccggggtcccctgacaggttcaggtgacnggtgatcaggctatagtatttacactagaaatcagcaggagtggaggcgtaggaggtacggtttaggggtttattacgtgtcagttgacgtaacggtactaaccgaaaccccgtactaccgtacccgttcggaaccggtaagggaccgaccgaccgtagggtaagttaacgttaaacgttacgtggtacggctcgccttactaacttcgttcg

SEQ ID NO: 422001 - DNA, 592 bp, Homo sapiens
  misc_feature: GZ8MTXP01DOQEM.15.25.C03.1.454.CMB.2.raw
  modified_base (257)..(257): a, c, t, g, unknown or other
  modified_base (365)..(365): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagagccggcctccatctcctgcaggtctagtcagacgcctccagcatactgatgatacaatntgattggtacctgcagaagccgagggcagtcctaccacaactcctgattcttagtttgggtactaacgtccgggccgtccggggtcccctggactggttcaggtcggntggtggatcgaggcatagtatttacactagaaatcagcagagtggaggcgtaggtagggtacggtttaggggtttattaacgtgacgtagtagacgtaaacggtacctaaacccgaaaccccgtataccgtacccgttccgggaaccggaacgggacctacgccgtaggtaacgaaacgttaaacggaacgtaaggtcggcgtacgaccgttacctaattccgttcg

SEQ ID NO: 422002 - DNA, 545 bp, Homo sapiens
  misc_feature: GZ8MTXP01C0FMV.15.25.C03.1.454.CMB.2.raw
  modified_base (357)..(357): a, c, t, g, unknown or other
  modified_base (406)..(406): a, c, t, g, unknown or other
  modified_base (437)..(437): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtactgcagaagccagggcagtctccacaactctgatcttatttgggttctaagtcgggcctccggggtccccctgacaggttcaggtggcnggtggatcgaggcatagtatttacatagaaaatcagacagagtggaggngtgaggtagttagggtttaggttaacgtgtnatgcgaaggtacgtaaaccaaacccgactactaccgttccggccggacgggacgacgccgtaggaagaagttaaacgaacgtaagtggcgtgcacctaacttcgttcg

SEQ ID NO: 422003 - DNA, 594 bp, Homo sapiens
  misc_feature: GZ8MTXP01BOACF.15.25.C03.1.454.CMB.2.raw
  modified_base (294)..(294): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtctccactctccctgccccgtcacccctggagacgccggcctccatctcctgcaggtctagtcagacgcctccagcatactgatggatacaactatttggattggacctgcagaagccagggcagtcnccacaactcctgattcttagtttggttactaagtccgggccttccccggggtccctgactaggttcaaggtgcagtggatcgaggtcaatagtatttacactagaaatcagacgagaggtggagcgtaggagggtacggtttggggggtttattacgtgcagtcgacgtaacggtacctaaacccgtaaaccccgtatacccgtacccgttccgggccggaacggggaccttacggacccgtagggaacgttaacgttaaaacggaacgtggtaacggtctgacctaaccgttaattccg

SEQ ID NO: 422004 - DNA, 609 bp, Homo sapiens
  misc_feature: GZ8MTXP01ATM2M.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccgagggcagtctccacaactctgatcttatttgggtctagtcgggccgtccggggtcccctgacgaggttcaggtggcaaggtggatcgaggcagtagtatttacactagaaatcagcagaggtggaggcgtaggagggtacggtttaggggtttattacgtggtctagtacgacgtaacggtacctaaacccgaaaccccgtactacccgtacccgttccgggaacccggaacggggaccgtaccggaccggttaacgggaaagttaaacgtttaaaaccggaaccgttggtacgggtaactacggaccttaaccgtaacttcgtttcg

SEQ ID NO: 422005 - DNA, 578 bp, Homo sapiens
  misc_feature: GZ8MTXP01CFRQL.15.25.C03.1.454.CMB.2.raw
  modified_base (368)..(368): a, c, t, g, unknown or other
  modified_base (489)..(489): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagcccggcctccatctcctgcaggtctagtcagagcctccagcatactgatggatacaactagttggattggtacctgcaagaagccaggcagtctaccacaactcctgattcttagtttgggtctaagtcgggcctccgggggtccccctggacgtaggttcaggtgggcnggtcgggatccgaggcagtagtattttacactagaaatcgagcgagtaggtgggaggtctaggaggtacgttaggggtttattacgtgcagtcgacgtaaggtacctaaccgaaacccgtntacccgaccgttcgggaaccgacggggacaccggcgtaggagttaaacgttaacgacgttggtaggctcggtacacctaacttcgttcg

SEQ ID NO: 422006 - DNA, 596 bp, Homo sapiens
  misc_feature: GZ8MTXP01BDDRZ.15.25.C03.1.454.CMB.2.raw
  modified_base (340)..(340): a, c, t, g, unknown or other
  modified_base (356)..(356): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaacttattggattggtacctgcagaagccagggcagtctccacaactctgatctatttgggtctaagtcgggcctccggggtcccccngacaggttcagtggcnggtggatcgaggcatagtatttacactagaaatcagcaggagtggaggcgtaggaggtacggtttaggggtttattacgtgactagtgtacgtaacggtactaaaccgaaacccgtattaccgtaaccggtttcgggaacccggtaacggggaccgtaccggaccgttaaggggaacgttaaacgtttaaacggaaacgttcgggtacgggtctacggccttaacccgtcgttcgttccg

SEQ ID NO: 422007 - DNA, 580 bp, Homo sapiens
  misc_feature: GZ8MTXP01B0J10.15.25.C03.1.454.CMB.2.raw
  modified_base (354)..(354): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatggattggtacctgcagaagccaggcagtctcacaactctgatcttagtttgggtactaacgtcgggcctcggggtccccctgacaggttcagtgcngtgatcaggcatagtatttacactagaaatcagcgagagtaggaggcgtagaagggtacggtttagggggtttaattaacgttggacctaagttacggaccgtaaacgggtaccttaaacccgaaaccccgtacgtacctaacccgttcggaaccggacgggaccgacgccgtaggaagttaacgttaaacgacgtaaggtcggctaggcacctaacgttcgttcg

SEQ ID NO: 422008 - DNA, 545 bp, Homo sapiens
  misc_feature: GZ8MTXP01DVMCI.15.25.C03.1.454.CMB.2.raw
  modified_base (291)..(291): a, c, t, g, unknown or other
  modified_base (299)..(299): a, c, t, g, unknown or other
  modified_base (357)..(357): a, c, t, g, unknown or other
  modified_base (404)..(404): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgacagaagccagggcagtcncacactcngatcttagttgggtctaacgtcgggcctccggggtccccctgactaggttcagtggcnggtgatcaggcatagtatttacactagaaatcagcaagagtggacgngtggaggtacggtttgggtttattactgatagtgacgaacggtctaaaccgaaacccgtatacgaccgttcggaaccggacgggacaccgccgtaggaagttaacgttaaacgacgtaaggtgctgacacctcgttcgtcg

SEQ ID NO: 422009 - DNA, 723 bp, Homo sapiens
  misc_feature: GZ8MTXP01DWQFA.15.25.C03.1.454.CMB.2.raw
tcagtctacgtagccacgaccggtgctcgatttagtagtgtagatttgggtttgggggatcaggactccctcagttcaccttctcacaatgaggctccctgctcagctcctggggctgctaatgctctgggtctctggatccagtggggatattgtgatgactcagtctccactcctccctgcccgtccacccctggagagcccggcctccatctcctgcaggtctagtcagagcctccagcatactgatggaatacaactagttggattggtacctgacaagaacgccgagggacagtcctaccaaccaacgtcctagtattccgtttagttttcgggttacctaaacgttcccgggccgttccccgggggtcccccctggtacgtaggtttccaaggtggacgtggtaggatacgaggactaagttagttaaacttttaacaagttaagaaaaactcgaagacgaaaggtagggttagggaggtacggtagggtaagggttaacgggttttaggggttttattaacgttgacgtagttacgaacgtaacggttaccctaaaacccgaaaccccgtacgttacccgtaacccggttcccgggaacccgggtaacggggaacccgtaaccgggttacccgtaagggggtaaacttaaaacggtttaaaaccggttaaccggttgggtacggtcgttacggacttaccctaattccgttttccg

SEQ ID NO: 422010 - DNA, 589 bp, Homo sapiens
  misc_feature: GZ8MTXP01BACYX.15.25.C03.1.454.CMB.2.raw
  modified_base (395)..(395): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcagcatactgatggatacaactattggattggtacctgcagaagccagggcagtctccacactctgatctatttgggtctaagtcgggcctccggggtcccccctgacgtgtcgaggtcggctggtgatcgaggctaagtagttactttaccataagtaaanacgagagagaggtaggaggagtaggtagggtacgggtttagggtttaggttacgtgtacgtagtagtacgtacgtaccgtaaacccgtaaacccgtaccgtaccgtaccgttccggaaccggacgggacgaccgccgtacggaagttaacgttaacgttaacgtgtacggtcgcgacacctaacgttcgttccg

SEQ ID NO: 422011 - DNA, 603 bp, Homo sapiens
  misc_feature: GZ8MTXP01BL77X.15.25.C03.1.454.CMB.2.raw
  modified_base (474)..(474): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagcccggctccatctcctgcaggtctagtcagagcctcagcatactgatggaatacaactattggattggtacctgcagaagccagggcagtctccacaactctgattctagtttgggtactaagtcgggtcctccggggtcccctggactggtcaggtcggctggtggatcgaggacatagtatttacatagaaatcagcagagtggaggcgtagaggtagtttggggttatacgtgacgagttcgacgtaacggtacctaaacccgaaaccccgtnttacccgaccgttccgggaacggtaaccgggaccgtaccggcccggttaagggaaacgttaaacgtttaaaccgaaacggtttgggtacggaacgttacggaccgttaacccctaatttccggtttccg

SEQ ID NO: 422012 - DNA, 522 bp, Homo sapiens
  misc_feature: GZ8MTXP01CMR7P.15.25.C03.1.454.CMB.2.raw
  modified_base (285)..(285): a, c, t, g, unknown or other
  modified_base (326)..(326): a, c, t, g, unknown or other
  modified_base (330)..(330): a, c, t, g, unknown or other
  modified_base (454)..(454): a, c, t, g, unknown or other
  modified_base (503)..(503): a, c, t, g, unknown or other
  modified_base (506)..(506): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcagcatactgatggatacaatatggattggtactgcagaagccaggcagtcncacactctgatctattggtctagtcggctcggggtcccccngacnggtcagtgcaagtgatcgagcatagtatttacactagaaatcagcagaggtaggaggcgtaggagggtacggtttaggggtttaattacgtgactagtgacgtaaggtactaaccaaacccgtntaccaccgttcggaaccggaggacacgcgtagagttagttaacgactgnggntgcactaacgttctcg

SEQ ID NO: 422013 - DNA, 608 bp, Homo sapiens
  misc_feature: GZ8MTXP01BSW40.15.25.C03.1.454.CMB.2.raw
  modified_base (364)..(364): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtactgcagaagccagggcagtcctccacaactcctgatcttagtttgggttactaagtcgggccctccgggggtcccctgacgaggttcaggtcggcnggtggaatcgagggctatagtatttacactagaaatcagcagagtggaggctaggaggtacggtttagggggtttattaacgttgacagttgacgtaacgggttacctaaaccgaaaccccgtataccgtaacccgttcgggaaccggaacggggaccaccggaccgtagggaacgttaacgtttaaaacggaaccttgggttacgggaacttcggacccgttaaccgtaacgttccttaacgg

SEQ ID NO: 422014 - DNA, 542 bp, Homo sapiens
  misc_feature: GZ8MTXP01D5S2B.15.25.C03.1.454.CMB.2.raw
  modified_base (355)..(355): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagcccggcctccatctcctgcaggtctagtcagagcctccagcatactgatggatacaactattggattggtacctgcagaagccagggcagtctccacaactctgatctatttgggtctaagtcgggcctccggggtcccctgacaggttcagtggcngtgatcaggcatagtatttacactagaaatcagcaagagtggaggcgtaggaggtacggtttaggggtttaattacgtggcagtgacgaaggtactaaaccaaaccccgtataccaccgttcggcgacgggacacgccgtaggaacgaagttaaacgaacgtggtacggctgcacctaattcgttcg

SEQ ID NO: 422015 - DNA, 555 bp, Homo sapiens
  misc_feature: GZ8MTXP01BJLUV.15.25.C03.1.454.CMB.2.raw
  modified_base (342)..(342): a, c, t, g, unknown or other
  modified_base (352)..(352): a, c, t, g, unknown or other
  modified_base (462)..(462): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatggattggtacctgcagaagccagggcagtctccacaactctgatctatttgggtactaatcgggcctccggggtccccctgacnggtcagtgcngtggatcaggcatagtatttacactagaaatcagacaagagtggaggctggaggtacggtttggggtttattacgtgacagttgactaaggtacctaaccaaaccccgtntaccaacccgttcgggaaccgagggaccgacgccgtagggaagttacgttaaaacggaacgtggtacgggtctcggacaccctaagttccttg

SEQ ID NO: 422016 - DNA, 522 bp, Homo sapiens
  misc_feature: GZ8MTXP01DKHSM.15.25.C03.1.454.CMB.2.raw
  modified_base (355)..(355): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactcctgatctatttgggtctaatcgggcctccggggtccccctgacaggttcagtggcngtggatcaggcatagattttacactagaaaatcagcaagagtggaggctgaggtacgttggggtttattacgtgcatgcaaggtctaacaaaccccgtatccaccgttcggccgagggacacgccgtggagaagttaaacgaactgtaggctgcacctaagttctcg

SEQ ID NO: 422017 - DNA, 555 bp, Homo sapiens
  misc_feature: GZ8MTXP01D9G2Q.15.25.C03.1.454.CMB.2.raw
  modified_base (312)..(312): a, c, t, g, unknown or other
  modified_base (339)..(339): a, c, t, g, unknown or other
  modified_base (347)..(347): a, c, t, g, unknown or other
  modified_base (371)..(371): a, c, t, g, unknown or other
tcagtctacgtagccacgaccggtgctcgatttagtagtgtagatttgggtttgggatcaggactcctcagttcaccttctcacaatgaggctccctgctcagctcctggggctgctaatgctctgggtctctggatccagtgggatattgtgatgactcagtctccactctccctgcccgtcaccctggagagccggcctccatctcctgcaggtctagtcagagcctcagcatactgatggatacaactattgattggtacctgcagagccaggcagtctcacaactctgatctattgggtctaatcggntccggggtcccctgacaggtcagtgcngtggactnagacgtatagtattactaactaangtaaatacgacgacgaagaggtagggggtaggtacggtaggtacgggtacgggttagggtttagttacgttacgtcgtagtacgtacgtaacgtaacgtaaccgaaacccgtaacgttaccgtaccgtaccggaccggacggacgaacgacgtaacgacgtaacgttaacgtaacgttaacgtg

SEQ ID NO: 422018 - DNA, 609 bp, Homo sapiens
  misc_feature: GZ8MTXP01BSOGB.15.25.C03.1.454.CMB.2.raw
  modified_base (268)..(268): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgcccggcctccatctcctgcaggtctagtcagacgcctccagcatactgatgatacatatgattggtacngcagagccgaggcagtctccacaactcctgattcttagtttgggttactaacgtccgggcccgttccgggggtccccctaggacgtagggttcaggtggacaaggtggatcgaggctaatagtatttacactagaaatcagcgaaggaggtaggaggacgtagggtaagggttacgggtttaggggtttaattacgtggtacagtacgacgtaacggtacctaaaccgaaacccgtactaccgtacccggtcggaaccggaagggaccgtaccgacgtaacggaacgttaacgttaaacgaacgtggtacggtaactcgaccacgttaacttccgttaacg

SEQ ID NO: 422019 - DNA, 579 bp, Homo sapiens
  misc_feature: GZ8MTXP01AE8ZM.15.25.C03.1.454.CMB.2.raw
  modified_base (365)..(365): a, c, t, g, unknown or other
  modified_base (475)..(475): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctccagcatactgatggatacaactagttgattggtacctgcagaagccagggcagtctccacactcctgatcttagtttgggttactaagtccggggcctccgggggtcccctggactaggttcaggtggcngtgatcaggctatagtatttacatagaaatcagcagagtggaggcgtggagggtacggtttaggggtttattacgtgctagtgacgtaaggtcctaaaccgaaacccgtntaccgtaccgttccgggaaccggacgggaccaccggaccgtagggaacgttaaacgttaaaaccggaacgttggtcggccttcggaccaaccctcgttcgttcg

SEQ ID NO: 422020 - DNA, 539 bp, Homo sapiens
  misc_feature: GZ8MTXP01C0P6R.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcccgcaggtctagtcagagcctccagcatactgatggatacaactattggattggtacctgacagaagccaggcagtctccacaactcctgatctatttggtctaagtcggcctcgggtcctcgacaggttcagtggcagtgatcagcatagattacatagaaatcagcagagtggaggcgtggaggtacgttaggggttattacgtgcatgactaacggtactaaccgaaaccccgataccgaccgttccgggccgaagggacacggtccgttagggaacgtaacgttaaacgaacttggtcggctcgccaccttatccgttgttcc

SEQ ID NO: 422021 - DNA, 539 bp, Homo sapiens
  misc_feature: GZ8MTXP01EBZ28.15.25.C03.1.454.CMB.2.raw
  modified_base (360)..(360): a, c, t, g, unknown or other
  modified_base (531)..(531): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctccagcatactgatggatacaactattggattggtacctgcagaagccagggcagtctccacaactcctgatcttagtttgggttctaagtcgggcctccggggtccccctgacaggttcagtggcngtgatcaggcatagtatttacactagaaaatcagacgagagtggaggcgtggaggtacgtttaggggtttattacgtgactagtgacgaaggtctaaaccgaacccgtatacaccgttcggaaccggaggacacgccgtaggacttaagttaaacgactgtgctgcacctnttcgttcg

SEQ ID NO: 422022 - DNA, 591 bp, Homo sapiens
  misc_feature: GZ8MTXP01AS4BL.15.25.C03.1.454.CMB.2.raw
  modified_base (296)..(296): a, c, t, g, unknown or other
  modified_base (494)..(494): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagacgccggcctccatcctcctgcaggtctagtcagacgcctccagcatactgatggatacaactattggattggtacctgacagaagccgagggcagtcnccacaactcctgatctagtttggttactaagtccgggcctccccggggtcctgacgtaggttcaaggtggcaggtggatcgaggctagtagtatttacacttagaaatcgagacgagtaggtgggaggcgtaggagggttacggtttggggggtttattacgtgacagtgacgaacggtacctaaccgaaaccccgtntcccgaccgttccgggacggacggggaccaccggtaccgtaagggaacgttaacgttaaacgaacgtggtcggactcggacctaacgttaacgtccg

SEQ ID NO: 422023 - DNA, 538 bp, Homo sapiens
  misc_feature: GZ8MTXP01A2J2G.15.25.C03.1.454.CMB.2.raw
  modified_base (256)..(256): a, c, t, g, unknown or other
  modified_base (264)..(264): a, c, t, g, unknown or other
  modified_base (280)..(280): a, c, t, g, unknown or other
  modified_base (283)..(283): a, c, t, g, unknown or other
  modified_base (288)..(288): a, c, t, g, unknown or other
  modified_base (530)..(530): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagagcctccagcatactgatggatacatntgatgacngcagagcaggcagtcncanactcngatctatttggtctaagtcggcctccggggtccccctgactaggtcaggtcggcaaggtgatcgaggctagtagtatttacactagaaatcagcagagtggagcgtagaggtacgttggggtttattacgtgtacagtagcgtaaacggtacctaaaccgaaaccccgtatcccgaaccgttcgggaaccgagggaccacgccgtaggacgaacgttaaaccgagttgacggctacgcactnttccgttg

SEQ ID NO: 422024 - DNA, 589 bp, Homo sapiens
  misc_feature: GZ8MTXP01BY6I8.15.25.C03.1.454.CMB.2.raw
  modified_base (363)..(363): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactcctgatcttatttgggttactaagtccggggcctccgggggtccccctgacaggttcaggtggcnggtggatcgaggcatagtatttacactagaaatcagcaaggagtaggaggcgtggagggtacgtttaggggtttattacgtgtacagttgacgtaacggtacctaaaccgaaaccccgtatacccgtaacccgttccgggaaccggaacgggacgaccggacccgtaggaacgttaaacgttaaacgaacgttggtggccgtcgaccttacccgtaacttcgttcg

SEQ ID NO: 422025 - DNA, 550 bp, Homo sapiens
  misc_feature: GZ8MTXP01ANQEI.15.25.C03.1.454.CMB.2.raw
  modified_base (344)..(344): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagagccggcctccatctcctgcaggtctagtcagagcctccagcatactgatggatacaactatttggattggtacctgcagaagccagggcagtctaccacaactctgatctagtttggtctaagtcgggcctcccggggtcctgacnggttcaagtgcagtgatcgaggcatagtatttacactagaatcagacgagaggtgggaggcgtaggagggttacggtttggggggtttaattacgtgactagtgacgtaaggtacctaaccgaaaccccgatccgaccgttcgggccgacgggacacggccgtaggacgaacttaacgaactggtcggctcgactaaccgttgtcg

SEQ ID NO: 422026 - DNA, 547 bp, Homo sapiens
  misc_feature: GZ8MTXP01D8TI6.15.25.C03.1.454.CMB.2.raw
  modified_base (359)..(359): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagcccggcctccatctcctgcaggtctagtcagagcctccagcatactgatggatacaactattggattggtacctgcagaagccaggcagtctccacaactctgatcttatttgggtctaagtcgggcctccggggtccccctggacaggttcagtgggcngtggatcgaggcatagtatttacactagaaatcagcagagtggaggctgaggtacgttggggtttattacgtgcatgacaaggtactaaccaaacccgtagtcctaccgttcggaaccggacgggacaccggccgtaggaagttacgttaaaacgaacgtggtaggccgtgccacctaattcgtaacg

SEQ ID NO: 422027 - DNA, 593 bp, Homo sapiens
  misc_feature: GZ8MTXP01AKXEQ.15.25.C03.1.454.CMB.2.raw
  modified_base (357)..(357): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatggattggtacctgcagaagcaggcagtctccacaactcctgatcttagtttgggtctaacgtcggggcctccggggtcccctgactaggttcagtggcngtggatcgagcatagtatttacactagaaatcagcagtagtggaggcgtaggagggtacggtttaggggtttagttacgtgtctaagtggacgtaaggtacctaaccgaaaccccgtactaccgtacccgttcgggaacccggaacgggaccgaccggacccgtagggaacgttaacgttaaaacgttaccgtaagggttacggtccgtacgaccgttaacctaacgttcgttccg

SEQ ID NO: 422028 - DNA, 578 bp, Homo sapiens
  misc_feature: GZ8MTXP01ETVQF.15.25.C03.1.454.CMB.2.raw
  modified_base (244)..(244): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatacngatggatacaactattggattggtacctgcagaagccagggcagtctccacaactcctgatcttatttgggtctaagtccgggcctccccggggtccctgacaggttcaagtggcaggtggatcgaggcatagtatttacactagaaatcagacgagaggtgggaggcgtggtagggtacggtttagggggggttttaattacgtgctagtggacgtaacggttacctaaaccgaaaccccgtatccaccgttccgggaccggacgggacgacgaccgtagggaacgttacgttaaacggaacgtaggtcgggctcggactaaccgaagttccg

SEQ ID NO: 422029 - DNA, 568 bp, Homo sapiens
  misc_feature: GZ8MTXP01CFOEW.15.25.C03.1.454.CMB.2.raw
  modified_base (362)..(362): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctcacaactctgatcttagtttgggttctaagtccggggcctccggggtccccctggactaggttcaggtggcnggtgggatcgaggcatagtatttacactagaaatcagcagaggtggaggctggaggtacggtttggggtttaattacgtggcagtgacaagggtactaaaccgaaaccccgtataccgaccgttcgggaaccggagggaccacggccgtagggaacgttaacgttaaacggaacgttggtacggcgtacgacacctaagttcttcg

SEQ ID NO: 422030 - DNA, 584 bp, Homo sapiens
  misc_feature: GZ8MTXP01D0ABL.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgccccgtcacccctggagacgccggcctccatctcctgcaggtctagtcagagccctccagcatactgatggatacaactatttggattggtacctgcagaagccagggcagtctccacaactcctgattcttagtttgggttctaagtccggggcctccccggggtccctgacgtaggttcaaggtggcgagtggatcgagggctaagttagtattttacactagaaatcagacagagtggagcgtggagggtacgtttggggggtttattacgtgacgtagtgactaaggtacctaaccgtaaaccccgtataccgtaccgtcgggaccggacgggaccaccggaccgtaggaacgttaacgttaaaacgaacgtggtggctcgacctaaccgttaattccg

SEQ ID NO: 422031 - DNA, 526 bp, Homo sapiens
  misc_feature: GZ8MTXP01BPVQ1.15.25.C03.1.454.CMB.2.raw
  modified_base (459)..(459): a, c, t, g, unknown or other
  modified_base (513)..(513): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatcctcccgcaggtctagtcagagcctccagcatactgatggatacaactatttggattggtacctgcagaagccagggcagtctccacaactcctgatctatttgggttctagtcgggcctccggggtccctgaccaggttcagtggcagtggatcaggcatagattttacactagaaatcagcagagtggaggctggaggtacggttggggtttattacgtgctatgacgaaggtctaaccaaaccccgntccaccgtcggccggaagggacacgccgttggaagtaattaaacgacttgtggntgcacatcttgtc

SEQ ID NO: 422032 - DNA, 631 bp, Homo sapiens
  misc_feature: GZ8MTXP01EHMQ5.15.25.C03.1.454.CMB.2.raw
  modified_base (305)..(305): a, c, t, g, unknown or other
  modified_base (400)..(400): a, c, t, g, unknown or other
  modified_base (404)..(404): a, c, t, g, unknown or other
  modified_base (435)..(435): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtccaccccgtggagacgccggcctccatcctctgcaggtctagtcagcgccctcagcatactgatggataacaactagtttggattggtacctgcaggaacgccgagggctagcctaccncaactcctgattcgttagttttggttactaacggtccggggtccgttcccccggggtccctggacgtaggttccaagtcgggctaggtggatcgngganctaaagttactttactacgtaagtaactagngacgaggaggtagggaggtcgtagggtagggttacggggtttagggggtttactttaacgtgactagttgacggtaaccgtactaaaccccgaacccgtacgtaccctaccggtccggaccgggacggtaccgacgtccggtaagacgttaacgttaaacgtaacgtggtaacgtcgtacgacctaacgttcttcg

SEQ ID NO: 422033 - DNA, 571 bp, Homo sapiens
  misc_feature: GZ8MTXP01ATCT8.15.25.C03.1.454.CMB.2.raw
  modified_base (347)..(347): a, c, t, g, unknown or other
  modified_base (360)..(360): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactcctgatcttagtttgggttctaagtcgggcctccggggtccccctgacnggttcaggtggcnggtgatcgaggcatagtatttacactagaaatcagcaagagtggaggcgtgaagggtacggtttggggttattacgtgtcagtgacgtaacggtacctaaccgaaaccccgtagtacctacccgttccgggaaccggaacgggaccgacggccgtagggaacgttaacgttaaacgacgttggtcgggctcgaccaccgtaacttcgttcg

SEQ ID NO: 422034 - DNA, 612 bp, Homo sapiens
  misc_feature: GZ8MTXP01CPO2H.15.25.C03.1.454.CMB.2.raw
  modified_base (366)..(366): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcagcatactgatggatacaactatggattggtacctgcagaagccagggcagtctaccacaactcctgatcttagtttgggttctaacgtcgggcccgtccggggtcccccctggacgtaggttcaggtggcngtggatcgaggcagtagtatttacactagaaatcagcaggaggtggaggcgtaggagggtacgggtttaggggtttaattacgtggtactagttagacgtaacggtacctaaacccgaaaccccgtataccgacccgttcgggaacccggaacgggaccgaccggaccgttaagggaagttaaaacgttaaaaccggaaacgttcgggtacggtaaccgtcggaccacccgtaagttccgtttaag

SEQ ID NO: 422035 - DNA, 537 bp, Homo sapiens
  misc_feature: GZ8MTXP01D0OIH.15.25.C03.1.454.CMB.2.raw
  modified_base (316)..(316): a, c, t, g, unknown or other
  modified_base (340)..(340): a, c, t, g, unknown or other
  modified_base (349)..(349): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagcccggcctccatctcctgcaggtctagtcagagcctccagcatactgatggatacaactattggattggtacctgcagaagccagggcagtctccacaactctgatctatttgggtntatcggctccggggtcccctgacngtcagtgcngtgatcaggcatagtatttacactagaaatcagcaaggagtggaggctggagggtacggtttggggtttattacgtgactagtgacgaaggtacctaaccaaacccgtataccgaccgttcgggccgacgggacacgccgtaggaagttaacgttaaacgaacgtggtaggctgcactaacgttcttg

SEQ ID NO: 422036 - DNA, 564 bp, Homo sapiens
  misc_feature: GZ8MTXP01DL545.15.25.C03.1.454.CMB.2.raw
  modified_base (356)..(356): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactagttggattggtacctgcagaagcaggcagtctccacactctgatcttatttgggttactaagtccgggcctccggggtcccctgactaggtcagtggcnggtggatcgaggctaatagtatttacactagaaatcagcaagagtggaggcgtaggaaggtacggtttaggggtttaattacgtgctagtgacgtaacgtacctaaaccgaaaccccgtatacccgaccgttccgggaaccggaacgggaccaccggccgtagggagttaaacgttaaacgacgtggtagctgacactaagttcttcg

SEQ ID NO: 422037 - DNA, 603 bp, Homo sapiens
  misc_feature: GZ8MTXP01B4IS3.15.25.C03.1.454.CMB.2.raw
  modified_base (486)..(486): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaacttattggattggtacctgcagaacgccgaggcagtcaccacactctgatctatttggtctagtcgggcctccggggtcccctgacgtaggttcaggtggctaaggtgatcgaggctagtagtatttacactagaaatcaagcgaaggaggtgggaggtctagggaaggttacgggtttaggggtttatacgtgactagtcgacgtaacggtacctaaaccgaaaccccgtntacccgacccgttccgggaaccggtaacggggaccgacggttcccgtaagggtaacgttaaacgttaaaccggaacgttgggtcggccttcgaccttacccgtaagttccgttaacg

SEQ ID NO: 422038 - DNA, 645 bp, Homo sapiens
  misc_feature: GZ8MTXP01A490R.15.25.C03.1.454.CMB.2.raw
  modified_base (375)..(375): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggactgcagaacgccagggcagtcctaccacaactcctgtacttcttagtttgggttactaacgtccggggccctcccgggggtccccctggacgtaggttcaggtgggcnggtggatcgaggcagtagtatttacactagaaatcgaagcaaggtaggtaggaggtacgtagggaacgggttaggtttaggggtttaattacgtggtacaagtcggtactaaacgggttacctaaacccgaaaccccggtatacccgtaacccggttccggggaacccggtaacgggaccgaaccggttacccggtaagggtaaacggttaaacgttaaaaccggaacgttgggtacgggtcttacggaccacgttaacttcgtttaacg

SEQ ID NO: 422039 - DNA, 599 bp, Homo sapiens
  misc_feature: GZ8MTXP01EQYP0.15.25.C03.1.454.CMB.2.raw
  modified_base (356)..(356): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactctgatctatttggtactaagtcgggcctccggggtcccctggactaggttcagtggcnggtggatcaggctaagtagtaatttacatagaaatcagcagagtggagctggaggtacggtttggggtttattacgttggactagtagtacgaacggtactaaacccgaaaccccgtagtacccgtacccgttcggggaacccgtaaggggaccaaccggttaccgtaggggtaaacgttaaacgtttaaaacggaaccgttggtacggaacgttggacccttaaccctaagttcccgtttcg

SEQ ID NO: 422040 - DNA, 556 bp, Homo sapiens
  misc_feature: GZ8MTXP01CW48A.15.25.C03.1.454.CMB.2.raw
  modified_base (457)..(457): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcccgcaggtctagtcagagcctcagcatactgatggatacaactattggattggtacctgacagaagccgaggcagtctccacaactctagatctatttggtctagtccgggccgtccggggtcctgactaggttcagtgcagtggatcgaggcatagtatttacactagaaatcagcagagtggagcgtggaggtacggttagggttatacgtgctatgactaacggtacctaaccgaaacccgntaccaccgtcggaccggaaggaccacggtccgaggaaacgtaacgttaaaacggacgttggtaacggactaacggacctaccgttacttcttcgtttcc

SEQ ID NO: 422041 - DNA, 585 bp, Homo sapiens
  misc_feature: GZ8MTXP01AG4XL.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagagccggcctccatctcctgcaggtctagtcagagcctccagcatactgatggatacaactattggattggtacctgccagaacgccgagggcagtctccacaactcctgatcttagtttgggttactaagtccggggccgttccccggggtcctgactaggttcaaggtggcagtggatcgaggcagtagtatttacactagaatcagacgagagtggagtcgtggagggtacggtttaggggggtttattacgtgacagtcgacgtaaggtaccaaaccgtaaaccccgtatacccgtaccgttccgggaccggttagggaaccacggtaccgtaggaacgaacgttaaacggaacgttggaacggtctacgacctaacaagttccg

SEQ ID NO: 422042 - DNA, 568 bp, Homo sapiens
  misc_feature: GZ8MTXP01COZ34.15.25.C03.1.454.CMB.2.raw
  modified_base (363)..(363): a, c, t, g, unknown or other
  modified_base (560)..(560): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagagccgaggcagtctccacaactcctgatcttagtttgggttctaagtccggggcctccgggggtccccctgacgaggttcaggtggcnggtgatcgaggcatagatttacactagaaatcagacgagagtaggaggcgtggtagggtacggtttaggggtttagttacgtgctagtcgacgaacggtactaaaccgaaacccgtactacctaaccgttcggccggaacgggaccgacggccgtacgggagttaaacgttaaacgaacgtgtaggctggccacctnttcgttcg

SEQ ID NO: 422043 - DNA, 591 bp, Homo sapiens
  misc_feature: GZ8MTXP01DWV7F.15.25.C03.1.454.CMB.2.raw
  modified_base (258)..(258): a, c, t, g, unknown or other
  modified_base (292)..(292): a, c, t, g, unknown or other
  modified_base (491)..(491): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctccagcatactgatggatacaactnttggattggtacctgcagaacgccagggcagtcnccacaactctgtatcttagtttgggttactaacgtccgggccgtccgggggtccccctggactaggttcaggtggcaaggtggatcgaggcaagtagtatttacactagaaatcagacagagtggaggcgtaggagggtacggtttggggtttaattacgtgacaagtcgacgtaaggtacctaaaccgaaaccccgtntaccgtaaccgttccgggaaccggacgggacgaccggccgtagggaacgttaaacgttaaacggaacgttggtacggcgtcgaccactaacgttcgttcg

SEQ ID NO: 422044 - DNA, 534 bp, Homo sapiens
  misc_feature: GZ8MTXP01AQYTW.15.25.C03.1.454.CMB.2.raw
  modified_base (354)..(354): a, c, t, g, unknown or other
  modified_base (393)..(393): a, c, t, g, unknown or other
  modified_base (458)..(458): a, c, t, g, unknown or other
  modified_base (498)..(498): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcagcatactgatggatacaactattggattggtacctgcagaagccagggcagtctccacactcctgatctatttgggtctaagtcggcctccggggtccccctggacaggttcagtggcngtggatcaggcatagtatttacactagaaatcagcaagngtggaggctgaggtacgtttggggtttatacgtggcagtgacgaaggtcctaaccaaaccccgtntaccaccgttcggaaccgaagggacacggccgtagggaanacgttaaacgacgtgtcggctgcacctaattcgtcg

SEQ ID NO: 422045 - DNA, 573 bp, Homo sapiens
  misc_feature: GZ8MTXP01CDULD.15.25.C03.1.454.CMB.2.raw
  modified_base (469)..(469): a, c, t, g, unknown or other
tcagtctacgtagccacgaccggtgctcgatttagtagtgtagatttgggtttgggggatcaggactcctcagttcaccttctcacaatgaggttccctgctcagctcctggggctgctaatgctctgggtctctggatccagtgggatattgtgatgactcagtctccactctccctgcccgtcacccctggagagccggcctccatctcctgcaggtctagtcagagcctccagcatactgatggatacaactattggattggacctgcagaagccagggcagtctccacaactcctgattctagttttggtctaagtcgggcctccggggtcctggacaggttcagtggacagtggatcgaggcatagtatttacactagaaaatcagcagagtggagcgtggaggtacggttaggggtttattacggtgactagtacgactaagggtcctaaccgaaaccccgtntaccgtacccgttccgggaccggaacgggaccgacggcccgttagggaacgtaacgttaaaacgaacgttggtaaggcgtcggacacccttattccttgtttcc

SEQ ID NO: 422046 - DNA, 584 bp, Homo sapiens
  misc_feature: GZ8MTXP01EF7IF.15.25.C03.1.454.CMB.2.raw
  modified_base (469)..(469): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgtaggtctagtcagagcctcagcatactgatggatacaatatttggattggtacctgcagaagccagggcagtctaccacactctgatctagtttggtctagtcggcctccggggtcctgacaggttcagtggacagtggatcgaggcatagtatttacatagaaatcagcagaggtggaggcgtggagggtacggtttaggggtttattacggtgtctagtacgacgtaacggtacctaaaccgaaacccgtntaccgtaccgttccgggaccggaacgggaccacggtacccgttagggtaaacgtaacgtttaaaacggacgttacggtcggtacttaacggcacccttagttccgttcgtttccc

SEQ ID NO: 422047 - DNA, 728 bp, Homo sapiens
  misc_feature: GZ8MTXP01AVP4F.15.25.C03.1.454.CMB.2.raw
  modified_base (230)..(230): a, c, t, g, unknown or other
  modified_base (233)..(233): a, c, t, g, unknown or other
  modified_base (236)..(236): a, c, t, g, unknown or other
  modified_base (241)..(241): a, c, t, g, unknown or other
  modified_base (600)..(600): a, c, t, g, unknown or other
tcagtctacgtagccacgaccggtgctcgatttagtagtgtagatttgggtttggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcaggcnccncancatcngagtgatacaattagtgtagtcggtactgcaagacgcgaggcagtcctaccaacacctcgtagtacttctttaggtttcggttactaacggtccgggtcccggttcccggggtcccctaggacgtaggttccgagggttcggacgtgggtagggtactacggacgggtactaaggttaagtttaactttttaaccaacgttaaaaggtaaaacttcgaaacggtagaaagggtagggttaggggaaccggttcggtaagggaaccggggtttacgggggtttttaggggttttaattaacggtggtacctagttacggaacgtaaacgggtttaccctaaaaccccggaaaaccccgtntacccgttacccgggttcccggggaaccggaacggggacccaccggttccggtaagggaacttaaacggttaaaccgttacggttgggtaccgggtcttaccggaccaacccgtttcgtttccgttcg

SEQ ID NO: 422048 - DNA, 576 bp, Homo sapiens
  misc_feature: GZ8MTXP01DLL8F.15.25.C03.1.454.CMB.2.raw
  modified_base (360)..(360): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctagatccagtggggatattgtgatgactcagtctccactctccctgcccgtcacccctggagagccggcctccatctcctgcaggtctagtcagacgcctccagcatactgatggatacaactattggattggtacctgcagaagccagggcagtctccacaactcctgatcttatttgggtctaagtccgggcctccggggtcccctggacaggttcaggtggcnggtggatcgaggcatagtattttacactagaaatcagcagagtggaggcgtagagggtacggtttggggtttattacgtgctagtgacgtaacggtactaaaccgaaaccccgtatacccgtacccgttccgggcccggtaacgggaccaccggcccgtaggaacgttaaacgttaaaacgaaccgtggtcggtctcggaccacctaagttcttcg

SEQ ID NO: 422049 - DNA, 528 bp, Homo sapiens
  misc_feature: GZ8MTXP01ELLYM.15.25.C03.1.454.CMB.2.raw
  modified_base (353)..(353): a, c, t, g, unknown or other
  modified_base (399)..(399): a, c, t, g, unknown or other
  modified_base (422)..(422): a, c, t, g, unknown or other
  modified_base (509)..(509): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctcacaactctgatctatttgggtctaagtccgggctccggggtccccctgacaggttcagtgcnggtgatcaggcatagtatttacatagaaatcagcagagtggaggcngaggtagttggggtttatactgnatgacgaaggtctaaccaaaccccgtatccaccttcggaaccgagggacaacggccgtaggaagaacgttaaacgaactggtcggcnggaccacctaattcgttcg

SEQ ID NO: 422050 - DNA, 643 bp, Homo sapiens
  misc_feature: GZ8MTXP01BBPRF.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagccctcagcatactgatggatacaactattggattggtacctgacagaacgccagggcagtcctaccacaactcctagtattctttagttttgggttactaacggtccgggcccgtcccgggggtcccctggtacgtagggttcaggtcgggacaaggtggatacgagggcaatagtatttacactagaaatcagcaggagtggagcgtaggaggtacggtttaggggttacttacgtgtcagtcgacgtaacggtacctaaaccgaaaccccgtagttaccaacccggttccgggaacccgggaacgggaccgaaccggacccgttaaggggaaacgttaaacgtttaaaaaccggaacgttggggttacggaaccgttacggacccgttaaaccgtcgtttcccggtttcg

SEQ ID NO: 422051 - DNA, 591 bp, Homo sapiens
  misc_feature: GZ8MTXP01DULTV.15.25.C03.1.454.CMB.2.raw
  modified_base (352)..(352): a, c, t, g, unknown or other
  modified_base (363)..(363): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaacttagttggattggtacctgacagaagccagggcagtctccacaactcctgtatcttagtttgggtactaagtccgggccgtccggggtcccctgacnggttcagtgcngtgatcagcatagtatttacactagaaatcagacaagaggtggaggcgtaggtaagggtacggtttaggggtttatttaacgtggactaagtgacgtaaacggttaccttaaacccgaaaccccgtactaccgtacccgtttccgggaaccggaacgggaccaccggccgttagggaacttaaacgttaaacggaacgtgggtacgcgtcgaccactaacgttcttcg

SEQ ID NO: 422052 - DNA, 561 bp, Homo sapiens
  misc_feature: GZ8MTXP01BXR0D.15.25.C03.1.454.CMB.2.raw
  modified_base (340)..(340): a, c, t, g, unknown or other
  modified_base (351)..(351): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctccagcatactgatggatacaactattggattggtacctgcagagcaggcagtctccacaactctgatctatttgggtctaagtcgggcctccggggtcccctgacnggttcagtgcngtggatcgagcatagtatttacactagaaatcagcaaggagtgggagcgtggagggtacggtttaggggtttattacgtgcagtgacgtaacggtacctaaaccgaaaccccgtataccgtaccgttcggaaccggaacgggaccgacggccgtagggaacgttaacgttaaaccgaacgttggtcggtcgtcgcacctaagttcgttcg

SEQ ID NO: 422053 - DNA, 612 bp, Homo sapiens
  misc_feature: GZ8MTXP01C6SKI.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctccagcatactgatggatacaattatggattggacctgcagaagcagggcagtctccaacaactcctagattctttagtttcgggttactaagtccgggccgtccgggggtccccctggactggttcaggtggcaaggtggatcgaggctaatagtactttacaactagaaaatcgagacgaagaggtaggaggcgtagggtagggttacgggtttagggggtttaattacgtggacgtagttcgacgtaaacggtacctaaaccgaaaccccgtatacccgtacccgttcgggaacccggaaggggacctacggccgttacgggaagttaaacgttaaacgaacgttggcggcgtcgaccttacctaattcgttaacg

SEQ ID NO: 422054 - DNA, 590 bp, Homo sapiens
  misc_feature: GZ8MTXP01DNCZ5.15.25.C03.1.454.CMB.2.raw
  modified_base (293)..(293): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagacgccggcctccatctcctgcaggtctagtcagacgcctccagcatactgatggatacaactattggattggtacctgcagaagccagggcagtcnccaacaactcctagattcttagtttgggtactaagtccggggccttccccggggtccctgactaggttcaagtggcagtggatcgaggcatagtatttacatagaaatcagacagagtggagcgtaggaggtacgtttggggggtttaattacgtgactagtgacgtaaaggtacctaaaccgaaaccccgtatacccgtaccggttaaccgggaccggaacgggaccaccggaccgttaagggaacgttaagttaaaacgaacgtggtaacggctacgacctaaccgttaattccg

SEQ ID NO: 422055 - DNA, 670 bp, Homo sapiens
  misc_feature: GZ8MTXP01CNUO9.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccgacctccatctcctgcaggtctagtcagacgcctccagcatactgatggatacaactagttggattggtacctgacagaacgccgagggcagtctaccaacaactctgtattcttaagtttgggttactaacggtccggggtcccgttccgggggttcccccctggtacgtaggggtttcaacggttgggacctaagggtgggaactccggaagggtacctaagtttaaagtaacttttaacaactaaagaaaatcgaagacgaaggtagggtgggaaggtcgttagggtaagggttagggtttaggggtttaattacgtaggtctaagtgaacgtaacgggtacctaaacccgaaacccgtatacccgtacccggttcgggaaccggaaacggaccgtaccggccgttaagggaacgttaaacgttaaaccgaacgttggtacggctacgaccacctaacttcgtaacg

SEQ ID NO: 422056 - DNA, 523 bp, Homo sapiens
  misc_feature: GZ8MTXP01CXW7J.15.25.C03.1.454.CMB.2.raw
  modified_base (289)..(289): a, c, t, g, unknown or other
  modified_base (375)..(375): a, c, t, g, unknown or other
  modified_base (387)..(387): a, c, t, g, unknown or other
  modified_base (511)..(511): a, c, t, g, unknown or other
  modified_base (520)..(520): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagagccggcctccatctcctgcaggtctagtcagagcctccagcatactgatggatacaatattggattggacctgcagaagccagggcagtcnccacaactctgatctatttggtctaagtcgggcctccccggggtcctgacaggttcaagtggcagtggatcaggcatagtatttanactagaatcagnagagtggagctggagggtacggtttagggggtttattacgtgacagtgacgtaaggtacctaaccaaaccccgataccaccgttcggccggagggaccacgcctggaagacttaaacgaactgngctgcaacngtc

SEQ ID NO: 422057 - DNA, 516 bp, Homo sapiens
  misc_feature: GZ8MTXP01CXHDY.15.25.C03.1.454.CMB.2.raw
  modified_base (351)..(351): a, c, t, g, unknown or other
  modified_base (426)..(426): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcaccccctggagagccggcctccatctcctgcaggtctagtcagagcctccagcatactgatggatacaactatggattggactgcagaagccagggcagtctccacactcctgatctattgggtctaagtcgggcctcggggtccccctgacaggttcagtggcngtgatcaggcatagatttacactagaaatcagcagagtggaggcgtgaggacgttggggtttatacgtgcagtgnaaggtctaacaaacccgtatcaccttcggccgaagggacacgccgtaggagaacgttaaacgactaagtggctcgacacctaagttcttg

SEQ ID NO: 422058 - DNA, 619 bp, Homo sapiens
  misc_feature: GZ8MTXP01ESBAB.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctccagcatactgatggatacaattattggattcggtacctgacagaacgccgagggcagtccaccacaacctctgtattctttaagttttcgggttactaacgtccggggcccgttccgggggtccccctggacgtaggttcgaggtcgggactggtggatcgaggctaatagttatttacataagaaatcgagacgaaggaggtgggaaggcgtagggtagggttacgggtttagggtttaacttagtgactagttgaacgtaacggttaccaaaccgtaaacccgtatacccgtaccgttcgggaaccggtaacgggaccacggaccgtagggaaagttaacgttaaacgacgttggtcggctacggaccactaacttcgttcg

SEQ ID NO: 422059 - DNA, 596 bp, Homo sapiens
  misc_feature: GZ8MTXP01DLSLO.15.25.C03.1.454.CMB.2.raw
  modified_base (350)..(350): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctccagcatactgatggatacaactatggattggtacctgcagaagcaggcagtctcacactctgatctatttggttctaagtcggcctccggggtccccctgactaggtcagtggcnggtggatcgaggcatagtatttacactagaaatcagcagagtggaggcgtggaagggtacggtttaggggtttattacgtgctagtgtacgtaacggtacctaaaccgaaaccccgtatacccgtacccgttccgggaacccggaacggggaccgaccggcccgttaagggaacgttaaacgtttaaaaccggaaaccgttgggtacgggtccgttacggaccttaacccgtaagttccgtttccg

SEQ ID NO: 422060 - DNA, 612 bp, Homo sapiens
  misc_feature: GZ8MTXP01AOLAN.15.25.C03.1.454.CMB.2.raw
  modified_base (414)..(414): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtggggatattgtgatgactcagtctccactctccctgcccgtcaccccgtggagagccggcctccatctcctgcaggtctagtcagagcctccagcatactgatggatacaactattggattggtacctgacagaagccgagggcacgtctaccaacaacctctgatcttagtttgggttactaacgtccgggccgtccggggtccccctggacgtaggttcaggtggctgtgggatcgaggctaatagtatttacactagaaatcaganagagtggaggcgtaggaggtacggtttaggggtttagttacgtgtacgtagtacggacgtaaacggtacctaaaccgtaaaccccgtattacccgtaacccggttccgggaacccggtaacgggaaccgaccggaccgttagggaacgttacgttaaaacggaacgtggtacggctacggaccaaccgtcgttcttcg

SEQ ID NO: 422061 - DNA, 598 bp, Homo sapiens
  misc_feature: GZ8MTXP01BJZ4N.15.25.C03.1.454.CMB.2.raw
  modified_base (357)..(357): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagcccggcctccatctcctgcaggtctagtcagagcctcagcatactgatggatacaactattggattggtacctgacagaagccagggcagtctccacactctgatcttatttgggtctaagtcgggcctccggggtcccctggactaggttcaggtgcngtggatcaggcatagtactttacactagaaatcagtcgagaggtgggaggtcgtagtagggtacggtttaggggtttattacgtgtctagtcggacgtaacggttcctaaaccgtaaaccccgtactaccgtaacccggtttccgggaaccggaacggggaccgaccggaccgttagggaacgttaacgtttaaaacgaaccgttggtacggtccgtacggcttacccgtaagttccttcg

SEQ ID NO: 422062 - DNA, 665 bp, Homo sapiens
  misc_feature: GZ8MTXP01BBPE6.15.25.C03.1.454.CMB.2.raw
  modified_base (299)..(299): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtcctcacactcngatcttagtttggtactacgtccgggccgtccggggtccccctgacgtaggtcaggtcgctggtgatcgaggcagtaagttatttacactagaaaatcgaagacgaaggtaggtagggacgggtacgttagggtaacggggttaacgggttttagggggttttaagtttaacgtgggtaaccgtaaggttacgtaaccggtaaacggttaccctaaaacccgtaaaaccccggtacttaccccgtaacccggttccggggaaccggaacggggttaccgaaccggttacccggtagggaacgttaaacgttaaaccggttaacgttaacggtcgaaccgttagacccttaccgtaacttccgttcg

SEQ ID NO: 422063 - DNA, 504 bp, Homo sapiens
  misc_feature: GZ8MTXP01BABAH.15.25.C03.1.454.CMB.2.raw
  modified_base (350)..(350): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcaccccctggagagccggcctccatctcctgcaggtctagtcagagcctccagcatactgatggatacaactattggattggtacctgcagaagccagggcagtctcacaactctgatctatttggtctaatcggctcggggtccccctgacaggtcagtggcngtggatcaggcatagatttacactagaaatcagcagagtggaggctgaggacgttggggtttatacgtgcatgcaaggtctaacaaaccccgtatcaaccgttcggcgagggacacgcgtggagagttaacgactgtggctgcaccaagttctg

SEQ ID NO: 422064 - DNA, 596 bp, Homo sapiens
  misc_feature: GZ8MTXP01EL51N.15.25.C03.1.454.CMB.2.raw
  modified_base (362)..(362): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcaagaagccagggcagtcctccacaactctgatcttatttgggtactaagtccgggccgtccggggtccccctgacaggttcaggtggcnggtggatcgaggctatagtatttacactagaaatcagcagaggtggaggcgtgaggtacggtttaggggtttattacgtggactagtacgacgtaaacggttcctaaaccaaaccccgtactcccgtaaccgttccgggaaccggaacggggacacccggttccgtagggaacgttaacgttaaaaccggttaacgtaagggtacggcgttacggaccacccgtaagttcttcg

SEQ ID NO: 422065 - DNA, 617 bp, Homo sapiens
  misc_feature: GZ8MTXP01BW1JL.15.25.C03.1.454.CMB.2.raw
  modified_base (416)..(416): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtcctccacaactcctgatcttagtttgggttacttaaacgtccggggcccgtccggggtccccctggacgtaggttcaggtgggactggtgggatcgaggtctaatagtatttacactagaaatcaganagagtggaggcgtggaggtacggtttgggtttagttaacgtgtactagtacgacgtaaacgggtacctaaacccgaaaccccgtacgtaccgtacccgttccgggaaccgggaacgggaccgtaccggaccgtagggaacgttaaacgttaaaacgaaccgttggtacggtcgtacggaccttacctaacttcgttaaccg

SEQ ID NO: 422066 - DNA, 561 bp, Homo sapiens
  misc_feature: GZ8MTXP01CNLQW.15.25.C03.1.454.CMB.2.raw
  modified_base (359)..(359): a, c, t, g, unknown or other
  modified_base (476)..(476): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaacttattggattggtacctgacagaagccagggcagtctccacaactctgatcttagtttgggtactagtcgggcctccggggtccccctggactggttcagtgcngtggatcgaggcatagtattttacactagaaatcagcgagaggtgggaggcgtaggagggtacggtttaggggtttattacgtggactagtgacgaaggtctaaaccgaaacccgtntaccgtaccgtcgggaaccgaacgggacacggccgtaggagttaacgttaaacgacgttggcggaactcgcacctaagttcttcg

SEQ ID NO: 422067 - DNA, 516 bp, Homo sapiens
  misc_feature: GZ8MTXP01BRNO1.15.25.C03.1.454.CMB.2.raw
  modified_base (455)..(455): a, c, t, g, unknown or other
tcagtctacgtagccacgaccggtgctcgatttagtagtgtagatttgggtttggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcccgcaggtctagtcagagcctccagcatactgatggatacaactattggattggtacctgcagaagccagggcagtctccacaactcctgatctatttgggttctaagtcgggcctcggggtcctgacaggttcagtggcagtggatcgaggcatagattttacactagaaatcagcagagtggaggcgtggaggtacgttggggttattacggtgcatgacaacggtctaaccgaaaccccgntccaccgttcggccgaaggcacgccttggagtaattaacgacttgtgctgcacatcttgtc

SEQ ID NO: 422068 - DNA, 615 bp, Homo sapiens
  misc_feature: GZ8MTXP01EU3TK.15.25.C03.1.454.CMB.2.raw
  modified_base (359)..(359): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctccagcatactgatggatacaactattggattggtacctgcagaagccagggcagtctccacaactcctgatcttatttgggtctaagtcgggcctccggggtccccctgactaggttcagtggcngtggatcgaggcatagtattttacactagaaatcagacgagagtgggaggctaggaggtacggtttgggggtttatttacgttgctagtgactaaacgggtctaaacccgaaaccccgtactaccgaaccccgtttcgggaacccggaacggggttaccgacggacccgtagggaaacggttaaacgtttaaaaccggaaaccgttaagggtcgggtaaccgttacggaccgttaacccgtaacttccgttaacgg

SEQ ID NO: 422069 - DNA, 547 bp, Homo sapiens
  misc_feature: GZ8MTXP01DCQBM.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagagccggcctccatctcctgcaggtctagtcagacgcctccagcatactgatggatacaactattggattcggtacctgcagaagccgagggcagtctccacaactcctgattcttagtttgggttctaagtcgggccttcccggggtcctgactaggtcaagtgcagtgatcaggcatagatttacactagaaatcagcagagtggagcgtagaggtagttggggggttattacgtgacatgcaaggtctaaccgaacccgataccaccgttcggccgagggaccacgaccgtagggacgttaagtttaaaaccgaagtggtcggtacctcgacctaaccgttaagttcg

SEQ ID NO: 422070 - DNA, 572 bp, Homo sapiens
  misc_feature: GZ8MTXP01C422S.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagagccggcctccatctcctgcaggtctagtcagagcctccagcatactgatggatacaactattggattggtacctgcagaagccagggcagtctccacactcctgattctatttggttctaagtcgggcctcccggggtcctgactggttcaagtggcagtgggatcgaggcatagtattttacactagaatcagcagagtggaggcgtaggaggtacggtttggggggtttaattacgtgtcgagtcgacgaacggttacctaaaccgtaaaccccgtactccgtaacccgttcgggaccggacgggaccgacggaccgtggaacgttaagttaaaaccgtaacgtggtaacggctcgacctaacgaacgttcg

SEQ ID NO: 422071 - DNA, 600 bp, Homo sapiens
  misc_feature: GZ8MTXP01D53NT.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcaagaacgccagggcagtctccaacaactctgtattcttagtttgggtctaagtccgggccgtccggggtccccctggactaggttcaggtgctggtggatcgaggctatagtattttaacatagaaatcagcgaaggaggtgggaggcgtaggtaggtaggtttaggggtttaattacgtgtactagtcgacgtaacggtacctaaaccgaaacccgtactaccgtaccgttccgggaaccgggaacgggaccgaccggccgtaagggaaacgttaacgtttaaaacgaacgttggtacggctacggaccacctaacttcgttaacg

SEQ ID NO: 422072 - DNA, 573 bp, Homo sapiens
  misc_feature: GZ8MTXP01A0RIP.15.25.C03.1.454.CMB.2.raw
  modified_base (270)..(270): a, c, t, g, unknown or other
  modified_base (355)..(355): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatggattggtaccngcagaagccaggcagtctccacactcctgatctatttgggtctaagtcgggcctccggggtccccctggacagggttcaggtgcnggtggatcgaggcaagtagtatttacactagaaaatcagcaagagtggaggcgtaggaggtacggtttggggtttattacgtggtcagtgacgtaacggtactaaaccaaaccccggtataccgtaacccgttccgggaacccggaacggggaccaccggccgtagggaacgttaagttaaacggaactggtacgcgtacggccacctaattcgttcg

SEQ ID NO: 422073 - DNA, 565 bp, Homo sapiens
  misc_feature: GZ8MTXP01D3SPP.15.25.C03.1.454.CMB.2.raw
  modified_base (354)..(354): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctccagcatactgatggatacaatattggattggtacctgcagaagccagggcagtctacacaactctgatctatttggtctaagtcgggcctccggggtcccctgacaggttcaggtggcnggtggatcgaggcatagtatttacatagaaatcagcaggagtggaggctaggaggtacggtttggggtttattacgtgactagtgactaaggtacctaaccgaaaccccgtatacccgtaccgttcgggaacccggagggaccgtaccggccgtaagggaacgttaaagttaaacgaacgttggtacggcgtcgacacctaagttcgttcg

SEQ ID NO: 422074 - DNA, 578 bp, Homo sapiens
  misc_feature: GZ8MTXP01DB8YF.15.25.C03.1.454.CMB.2.raw
  modified_base (361)..(361): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaacttattggattggtacctgcagaagccagggcagtctccacaactctgatcttagttgggttactaagtccgggcctccggggtcccctggactaggttcaggtgcnggtggatcgaggcatagtatttacactagaaatcagacgagagtggaggcgtagagggtacgttggggtttatacgtgacagtgacgaaggtacctaaacccgaaacccgtactaccgtacccgttcgggaacccggacgggaaccacggccgtaagggaacgttaaacgttaaacggaacgtggtcggtaactcggacttacccgtaattcgttcg

SEQ ID NO: 422075 - DNA, 566 bp, Homo sapiens
  misc_feature: GZ8MTXP01COEB6.15.25.C03.1.454.CMB.2.raw
  modified_base (285)..(285): a, c, t, g, unknown or other
  modified_base (327)..(327): a, c, t, g, unknown or other
  modified_base (331)..(331): a, c, t, g, unknown or other
  modified_base (340)..(340): a, c, t, g, unknown or other
  modified_base (388)..(388): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccgcctccatctcctgcaggtctagtcagacgcctccagcatactgatggatacaactatggattggactgcagagcaggcagtcncacactctgatctagttggtacagtccggcctcgggtccccngacngtcagtgcngtgatcgagcagtagtatttacactagaaatcagagagagtaggaggngtgtaggtagggttagggtttacggttacgttagtcgtagtacgacgtaacgtacgtaaccgtaaacccgtaccgtaccgtaccgttaccgggtaaccggaacgggacgaccgaccggtacggtaagttaacgttaaacgttaacgtaagtggtcgtcgcgacctaacgttcgttccg

SEQ ID NO: 422076 - DNA, 540 bp, Homo sapiens
  misc_feature: GZ8MTXP01CZJCH.15.25.C03.1.454.CMB.2.raw
  modified_base (368)..(368): a, c, t, g, unknown or other
  modified_base (474)..(474): a, c, t, g, unknown or other
  modified_base (522)..(522): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactcctgattcttagtttgggttactaagtccggggtcctccgggggtccccctggactaggttcaggtggcnggtggatcgaggcatagatttacactagaaatcagcagagtggaggctagagggtacggtttggggtttattacgtgctagtgacaaggtctaaaccaaacccgtntcaccgtcggccgagggacacgccgtaggagttaacgttaacgactgngctgcacctaagttctcg

SEQ ID NO: 422077 - DNA, 593 bp, Homo sapiens
  misc_feature: GZ8MTXP01CE123.15.25.C03.1.454.CMB.2.raw
  modified_base (342)..(342): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctccagcatactgatggatacaactattggattggtacctgcagagcaggcagtctcacaactctgatctagtttgggtactagtcgggccgtccggggtcccctgacgnggttcagtcggctggtggatcgaggctattagtacttttaacactaagaaatcgagcgaaggaggtgggaggtcgtgggtaacgggttacggtttagggggtttattacgtgcgtagtgacgtaacgggtacctaaacccgaaaccccgtataccgtaccgttcgggaacccggaacgggacaccggccgtagggaacgttaacgttaaacgaacgttggtacggtcgtcgtaccgactaacttcgtttcg

SEQ ID NO: 422078 - DNA, 570 bp, Homo sapiens
  misc_feature: GZ8MTXP01ADRDS.15.25.C03.1.454.CMB.2.raw
  modified_base (474)..(474): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctccagcatactgatggatacatattgatggtactgcagaagccagggcagtctcacactctgatctatttgggtctaagtcggcctccggggtcccctgacaggttcaggtggctaaggtggatcgaggcaatagtatttacactagaaaatcagcgagagtggaggcgtaggtagggtacggtttgggggtttaattacgtggctaagtgacgtaagggtacctaaaccgaaaccccgtntaccgtacccgttcgggaaccgaacggggaccgacggccgtagggaagttaacgttaaaacggaacgtggtagggcctggacaccctaagttctcg

SEQ ID NO: 422079 - DNA, 533 bp, Homo sapiens
  misc_feature: GZ8MTXP01EV4LX.15.25.C03.1.454.CMB.2.raw
  modified_base (518)..(518): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactcctgatctatttgggtctaagtcgggcctccggggtccccctgactaggtcaggtgcaagtggatcgaggcatagtatttacactagaaatcagcagagtggaggctaggaggtacggttggggtttattacgtggacagtgacgaaggtactaaccaaaccccgtatcctaacccttcgggccgaagggacacgccgtaggagaacgttaacgactggngctgcactgttctcg

SEQ ID NO: 422080 - DNA, 626 bp, Homo sapiens
  misc_feature: GZ8MTXP01DMWMB.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagagccggcctccatctcctgcaggtctagtcagacgcctccagcatactgatggatacaaacttattggattggtacctgcagaagcgaggcagtctccacaactctgatctttagtttgggttactaacgtccgggccgtcccggggtcccctggacgtaggttcaggtcggcaaggtggatcgaggtcatagtatttacgaactagaaaatcaagcgaaggaggtagggacggtgtagggtagggttacggttttagggggtttaacttacgtggactagtgaacgtaaacggttcctaaacccgtaaaccccgtatacccgtacccgttcggggaaccggtaacgggacccggacggttacccgtagggaaacgttaagttaaacccggaagttggacggtaactcggacaccttaattcgtttccg

SEQ ID NO: 422081 - DNA, 573 bp, Homo sapiens
  misc_feature: GZ8MTXP01CHNIV.15.25.C03.1.454.CMB.2.raw
  modified_base (213)..(213): a, c, t, g, unknown or other
  modified_base (406)..(406): a, c, t, g, unknown or other
  modified_base (448)..(448): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcaccctggagagccgcctcatctcccgnaggtctagtcagacgcctcagcatactgatggatacaacttattggattggtacctgacaagaacgccgaagggcagtcctaccaacaactcctagattcttagttttggtactaagtccgggccctccggggtcctggactaggttcaggtggacaggtgatcgagcatagtatttacactagaaatcaganagagtggaggcgtaggaggtaggttaggggtttatacggtgngtatgacgtaacggtacctaaccgaaaccccgtatcctaaccggttccggaccgaagggaccacgtccgttaggaacgtaacttaaaccggattcggtggctcgacacttacttcgttcgtttcc

SEQ ID NO: 422082 - DNA, 645 bp, Homo sapiens
  misc_feature: GZ8MTXP01CZF8J.15.25.C03.1.454.CMB.2.raw
  modified_base (396)..(396): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagacgccggcctccatcctcctgcaggtctagtcagacgcctccagcatactgatggatacaactatttggattggtacctgcagaagccagggcagtctcccacaacctcctgtacttctagttttgggttactaacgtccggggccgttccccgggggtcccctggacgtaggttcaaggttggcgtaggtggatacgnggactatagtattttacactagaaactcgagactaggaggtagggaggtcgtgggtagggttacgggtttagggggggtttaattacgtgtacgtagttacgacgtaacgggttacctaaacccgtaaaaccccgtactacccgtacccggttaaccgggaccgggttaacggggaccacggtaccgtgggaaacgttagttaaaccggaacgttcggtcgggtctcggacctaaccgttaagtttccg

SEQ ID NO: 422083 - DNA, 598 bp, Homo sapiens
  misc_feature: GZ8MTXP01BB08Q.15.25.C03.1.454.CMB.2.raw
  modified_base (363)..(363): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccgagggcagtcctaccacaactctgatcttagtttgggtactagtccgggccgtccggggtccccctgactaggttcagtggcngtggatcgaggcatagtatttacactaagaaaatcgagcgaggagtgggaggcgtggagggtacggtttggggtttattacgtgcagtgacgtaacggtacctaaaccgaaaccccgtactaccgtacccgttccgggaaccggaacgggaccgaaccggcccgttaagggaacgttaaacgttaaaaccggaacgttgggtcggccgtacggaccttaccctaatttcgttccg

SEQ ID NO: 422084 - DNA, 631 bp, Homo sapiens
  misc_feature: GZ8MTXP01C0XCD.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccgagcatactgatggatacaactattggattggtacctgacagaagccagggcagtctaccacaactcctgatcttagtttcgggttctaacgtcggggccgtccggggtccccctggacgtaggttcaggttcgggacaaggtgggatcgagggcagtagtatttacactagaaaatcagcgaaggagtggaggcgtagggaggtaacgggtttggggtttaatttaacgtggtactagtagaaccgtaaaggttacctaaacccgaaaccccgtactaccgtacccgttcccggggaaccggaacggggaccgaccggaccgttaagggaacgttaaacgtttaaaacgaaccgttggtaacggtcgtacgacttacccgtaattccgtttaacg

SEQ ID NO: 422085 - DNA, 607 bp, Homo sapiens
  misc_feature: GZ8MTXP01BZNYO.15.25.C03.1.454.CMB.2.raw
  modified_base (431)..(431): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgcccggcctccatcctcccgcaggtctagtcagacgcctccagcatactgatggatacaacttattggattggacctgacagaacgccagggcagtcctaccacaactcctagtacttcttagttttgggttactaacggtccgggtccgtccggggtcctgacgtaggttcaggtggacagtggatacgaagctatacgtatttacatagaaatcagacgagagtgggacgngtaggagggttaggtttagggtttatacggtgtactagtcgaacgtaacggtacctaaaccgaaacccgtctaccgtaaccgttcgggaccggtaacgggaccaccggtccgttaaggaaacgtaacgttaaacggcttagggtcggctaacgacctacttacgtcttcgttaacc

SEQ ID NO: 422086 - DNA, 530 bp, Homo sapiens
  misc_feature: GZ8MTXP01EODVF.15.25.C03.1.454.CMB.2.raw
  modified_base (357)..(357): a, c, t, g, unknown or other
  modified_base (411)..(411): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagcccggcctccatctcctgcaggtctagtcagagcctccagcatactgatggatacaactattggattggtacctgcagaagccaggcagtctccacaactctgatcttatttgggtctagtcgggcctccggggtccccctggacaggttcaggtgcngtgggatcgaggctatagtattttacactagaaaatcagcaaggagtgggaggngtggaggtacgtttggggtttattacgttgctaatgaccaaggtcctaaacaaccccgtatcaccgttcggccggaggacgcgcgtggagagttaacgactgtggctgcactgttgttc

SEQ ID NO: 422087 - DNA, 597 bp, Homo sapiens
  misc_feature: GZ8MTXP01AVEN6.15.25.C03.1.454.CMB.2.raw
  modified_base (361)..(361): a, c, t, g, unknown or other
  modified_base (398)..(398): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactcctgatcttatttgggttactaagtcggggcctccggggtccccctggactggtcagtgggcngtggatcgaggcatagtattttacactagaaatcagnagagtggagcgtagaggtacgttagggttacgttacgtggacagttagcgtaacggtacgtaaccgtaaaccccggattacccgaacccgttcgggaacccggaacggggaccgaccggttacccgtagggaacgttaacgttaaaaccggaacgttaacggtgggaaccgttacggccgaacctaacgttctttccgg

SEQ ID NO: 422088 - DNA, 553 bp, Homo sapiens
  misc_feature: GZ8MTXP01BHMSV.15.25.C03.1.454.CMB.2.raw
  modified_base (289)..(289): a, c, t, g, unknown or other
  modified_base (330)..(330): a, c, t, g, unknown or other
  modified_base (334)..(334): a, c, t, g, unknown or other
  modified_base (344)..(344): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagcccggcctccatctcctgcaggtctagtcagagcctccagcatactgatggatacaactattggattggtacctgcagagcaggcagtcncacactctgatctattggtctagtcggcctccgggtccccngacngtcagtggcngtgatcgagcatagtatttacactagaaatcgagcgtagaggtggaggcgtagagggtaggtttgggtttattacgtgactagtcgacgtaaggtacctaaccgaaaccccgtatacccgtaaccgttccggaaccggacggaccgacgttccgtaggaacgttaaacgttaaacgacgttggtggcctgccttacctaagttccttcg

SEQ ID NO: 422089 - DNA, 511 bp, Homo sapiens
  misc_feature: GZ8MTXP01CY91F.15.25.C03.1.454.CMB.2.raw
  modified_base (264)..(264): a, c, t, g, unknown or other
  modified_base (339)..(339): a, c, t, g, unknown or other
  modified_base (341)..(341): a, c, t, g, unknown or other
  modified_base (343)..(343): a, c, t, g, unknown or other
  modified_base (346)..(347): a, c, t, g, unknown or other
  modified_base (351)..(351): a, c, t, g, unknown or other
  modified_base (360)..(360): a, c, t, g, unknown or other
  modified_base (362)..(362): a, c, t, g, unknown or other
  modified_base (364)..(364): a, c, t, g, unknown or other
  modified_base (367)..(367): a, c, t, g, unknown or other
  modified_base (369)..(369): a, c, t, g, unknown or other
  modified_base (371)..(371): a, c, t, g, unknown or other
  modified_base (373)..(373): a, c, t, g, unknown or other
  modified_base (378)..(378): a, c, t, g, unknown or other
  modified_base (382)..(382): a, c, t, g, unknown or other
  modified_base (384)..(384): a, c, t, g, unknown or other
  modified_base (405)..(405): a, c, t, g, unknown or other
  modified_base (407)..(407): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatgatacaatatggatgacngcagaagcaggcagtctcacaactctgatctattggttctaatcggcgtccgggtcccccgtgacaggtcagtgngngngannaganatatattanananaananananagagngagngngagtagttaggttagttatgnangacgaacgtacgtaaccaaaccgtactactacgtcggaacggacggacgacgcgagaagttaaagttaaacgaacgtaagtagtcgtcgacactaacgttcgtg

SEQ ID NO: 422090 - DNA, 588 bp, Homo sapiens
  misc_feature: GZ8MTXP01A23FE.15.25.C03.1.454.CMB.2.raw
  modified_base (299)..(299): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactctccctgcccgtcacccctggagagcccggcctccatctcccgcaggtctagtcagagcctcagcatactgatggatacaactattggattggtacctgacagaagccgaggcagtctccacactcngatcttatttggtactagtcggcctccgggtcctgactgttcgagtgacagtggatcgagggcatagtatttacactagaaatcagcagtagtggagcgtggaggtacggttagggtttatacgtgtactagtacgacgtaacggtacctaaccgaaaccccgtgtaccctaccggttccgggaccggaaccggaacgttaccggtaccgttacgggtaacgtaaacgtttaaaccggacgttaggtcgggtactcggacctaaccgttagttcccgttgtttaacccg

SEQ ID NO: 422091 - DNA, 544 bp, Homo sapiens
  misc_feature: GZ8MTXP01DLO33.15.25.C03.1.454.CMB.2.raw
  modified_base (356)..(356): a, c, t, g, unknown or other
  modified_base (386)..(386): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactcctgatcttagtttgggtctaagtcgggcctccggggtccccctgacaggtcagtgcngtgatcagcatagatttacactagaaaatnagacagagtggagcgtgaggtacgtttaggggtttattaacgtgctagtgacgtaaggtactaaaccaaaccccgtatccacccgttcggccggaacgggacacgccgtaggaagttaacgttaaacgaacgtggtaggctagcacctaattcgttcg

SEQ ID NO: 422092 - DNA, 587 bp, Homo sapiens
  misc_feature: GZ8MTXP01DI7T7.15.25.C03.1.454.CMB.2.raw
  modified_base (406)..(406): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcagcatactgatggatacaactattggattggtacctgcagaagccagggcagtctccacaactctgattctagtttggttctaagtcgggcctcccggggtcctgacaggttcaagtgcagtgatcaggcatagtatttacactagaaaatcaagacaggagtgggacggngtaggtaggtaggtttagggggtttagtttagttgtacgtagtagtacgtaacgtaaccgtaaccgtaaacccgtaacgtaccgtaccgtaaccggtaccgggacgggaccgaccgtaccgtacggttaacgttaacgttaaacgtaacgtaggtcggtcgtcgactaaccgttaacgtcg

SEQ ID NO: 422093 - DNA, 578 bp, Homo sapiens
  misc_feature: GZ8MTXP01BFRJY.15.25.C03.1.454.CMB.2.raw
  modified_base (352)..(352): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcagcatactgatggatacaactattggatcggtacctgacagaagccagggcagtctccacactctgatctatttggtctagtcgggcctcggggtccccctgacaggttcaggtggcnggtggatcgaggcatagtatttacatagaaatcagcagagtggaggctaggaggtacggtttaggggtttaattacgtggactagtcgacgtaacggtacctaaaccgaaaccccgtatacccgtacccgttcgggaaccggaacggggaccaccggccgtagggtaacgttaaacgttaaacggaacgttggtacgggtctcggaccttaccgtaacttcgttcg

SEQ ID NO: 422094 - DNA, 612 bp, Homo sapiens
  misc_feature: GZ8MTXP01EO1FG.15.25.C03.1.454.CMB.2.raw
  modified_base (335)..(335): a, c, t, g, unknown or other
  modified_base (346)..(346): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacatatggatggtacctgcagaagcaggcagtctcacactctgatctatttgggtactaagtcgggcctccgggtccccctgacnggttcagtgcngtggatcaggcaatagtatttacactagaaatcagcaggagtggaggtctaggagggtacgggtttagggtttagttaacgtggactagtagacgtaaacgggtaccttaaacccgaaaccccgtacgttaccgtacccggtttacccgggccgggaacgggaaaccgtacccggaccggttaagggaacggttaaacgttaaaacggttaaccgttaagggtcggtaaccgttacgggccttaaccctaacttccgtttaacccg

SEQ ID NO: 422095 - DNA, 625 bp, Homo sapiens
  misc_feature: GZ8MTXP01BWM1L.15.25.C03.1.454.CMB.2.raw
tcagtctacgtagccacgaccggtgctcgatttagtagtgtagatttgggtttgggggatcaggactcctcagttcaccttctcacaatgaggttccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccgaggcagtctaccacaactcctgattcttagtttgggtctaagtccgggcctccggggtcctgacgtaggttcaggtggacaggtggatcgaggctatagtattttacactagaaaatcagacagaggtggaggcgtaggagggtacggtttaggggtttattacggtgtacgtagtcgacgtaacggtacctaaacccgaaaccccgtattaccgtaaccccgttccggggacccggaacggggaaccgttaccgggcccgttagggtaaaccgtaaagtttaaaaccggaccgttgggttaacgggccttaacggaccacccgttattccgttcggtttccc

SEQ ID NO: 422096 - DNA, 570 bp, Homo sapiens
  misc_feature: GZ8MTXP01EJ7E0.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatcctcctgcaggtctagtcagacgcctccagcatactgatggatacaacttattgattggtactgcagaagcaggcagtcctccactaactctgattcttagtttcgggtactaacgtcgggcctccggggtcccctggacgtaggtcaggtcggcaaggtgatcgagctatagtatttacatagaaatcagcagagtggagctaggaggtacggtttgggtttatcgtggactagtgacgtacggtactaaaccaacccgtactaccgaccggttcggaaccgggaacgggacaccggaccgtaagggaacgttaaacgttaaacgaacgtggtggaactggaccactaacttccgttaag

SEQ ID NO: 422097 - DNA, 696 bp, Homo sapiens
  misc_feature: GZ8MTXP01CB4GS.15.25.C03.1.454.CMB.2.raw
  modified_base (583)..(583): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccgtggagacgccggcctccatctcctgcaggtctagtcagacgcctcagcatactgatggaatacaacttagttggattcggtacctgacgaagaacgccgagggcagtcctaccaactaacctccgtagtacttcgtttaagttttcggggttacctaacggtcccggggtcccgttcccgggggttccccctggaacgtagggtttccagggttgggactaaggttgggaattccgaagggtactaagttaacgttaacttttaacaacgtaagaaaaactcgaagacgaagggtaggtgggaaggtcgttagggtaagggttacgggttttaggggtttaattaacgtggactagtagaacgtaaacggtacctaaacccgaaaccccgtntacccgtaaccggttccgggaaccggaacgggaccaccggaccgttaagggaaacgttaacgttaaaaccgacgttggacggtaacctcgaccttacctaattccgtttaacg

SEQ ID NO: 422098 - DNA, 646 bp, Homo sapiens
  misc_feature: GZ8MTXP01BD9DL.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcccgcaggtctagtcagagcctccagcatactgatggatacaactattggattggtacctgcagaagccgagggcagtctaccacaactcctgatcttagtttggtctaagtcgggccgtccggggtcctgactaggttcagtggacagtggatcgaggcatagtatttacactagaaatcagcagagtggagcgtaggtagggtacggttaggggtttacttacgtgtacgtagtacggacgtaaacgggttccctaaaccgtaaacccccggtataccccgtacccggtttaccggggacccgggaacgggggaacccgacccgggtacccgttaagggggtaaacgtaaaacgtttaaaaccgggttaaccgttaggggtaacgggtacccgttcgggacccgtaaccttaacgttccgtttcggtttcccg

SEQ ID NO: 422099 - DNA, 566 bp, Homo sapiens
  misc_feature: GZ8MTXP01B979Q.15.25.C03.1.454.CMB.2.raw
  modified_base (357)..(357): a, c, t, g, unknown or other
  modified_base (405)..(405): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatggattggtacctgcagaagccagggcagtctccacaactcctgatcttagtttgggtactaagtcgggcctccggggtcccctgacaggttcagtggcngtggatcgaggcatagtatttacactagaaatcagcagaggtggaggngtgagggtacgtttaggggtttattacgtgctagtgacgtaacggtctaaaccgaaaccccgtataccgtaccgttccgggaaccggaacgggacaccggccgtagggaagttaacgttaaacgaacgtggtacggtctcggaccaccgtaacttcgttcg

SEQ ID NO: 422100 - DNA, 605 bp, Homo sapiens
  misc_feature: GZ8MTXP01DVT0O.15.25.C03.1.454.CMB.2.raw
  modified_base (402)..(402): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagagccggcctccatcctcccgcaggtctagtcagacgcctccagcatactgatggatacaactattggattggtacctgacaagaacgccgagggcagtcctaccaacaactctgattcttagtttggtctagtccgggcctccggggtcctgacgtaggtcagtggacagtggatcgaggcatagtattttacatagaaatcagngaagagtggagcgtggaagggttacggtttaggggtttattacggtgtacgtagtacgacgtaaacggtacctaaaccgaaaccccgtatacccgtaccgttccgggccggaacgggaccgacggtaccgttaggtaaacgtaacgttaaaacggacgttcgggtaacggacgtcgacctaccttacttccgttcgtttaacc

SEQ ID NO: 422101 - DNA, 678 bp, Homo sapiens
  misc_feature: GZ8MTXP01DFOUJ.15.25.C03.1.454.CMB.2.raw
  modified_base (491)..(491): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcaccctggagagccggcctccatctcctgcaggtctagtcagacgcctccagcaatactgatggatactaactattggattggtacctgacaagaacgccgagggcagtcctaccaactaactcctagtattcgtttagtttcgggttactaacggtccgggtcccgtcccgggggttccccctaggtacgtggtttcgaggttacgggactaaggggtgaagttaccgaagggacctaagttaagttaacttttaacaacgttaaagaaaacgtcgaaggtacgaaagggtaggtaggggacggnggttagggtaagggtttacgggttttagggggttttaacttacgtgtacgtagtacgaccgtaaacggttaaccttaaaccccggaaaccctactaccgtacccgttcgggaaccggtaacgggaccaccggcgtaaaggaattaaacgttaaacgagtcggtagcgtagccttactaattcgttcg

SEQ ID NO: 422102 - DNA, 641 bp, Homo sapiens
  misc_feature: GZ8MTXP01DN00X.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaacgcagggcagtctcacaactctgattcttagtttgggttctaacgtccgggccgtccgggggtccccctggacgtaggttccaggtcgggctaagggtggattacgaagggtctaagttagtaacttttacaactaggaaaatcgaagacgaaggaggtagggaggtcgtaggtaagggttaacgggtttaggggtttaatttaacgtgtacctagttcgaacgtaacggtacctaaacccgaaaccccgtatacccgtaccggttcgggaacccggaacgggaccgacgaccggttaagggaacgttaaacgtttaaacggaacgtttggacggtctacggaccttactaacttcgtttaacg

SEQ ID NO: 422103 - DNA, 533 bp, Homo sapiens
  misc_feature: GZ8MTXP01AG28O.15.25.C03.1.454.CMB.2.raw
  modified_base (287)..(287): a, c, t, g, unknown or other
  modified_base (330)..(330): a, c, t, g, unknown or other
  modified_base (334)..(334): a, c, t, g, unknown or other
  modified_base (344)..(344): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatggattggtacctgcagagccaggcagtcncacactctgatctatttggtctagtcggcctccggggtccccngacnggtcagtgcngtgatcaggcatagtatttacactagaaatcagcgagaggtggaggcgtaggagggtacggtttggggtttattacgtgcagtgacgaaggtacctaaccaaccccgtatccaccgttcggaaccgacgggacaccgccgtaggaagttaacgttaaacggaacgtggaggctgacacctaattcgtcg

SEQ ID NO: 422104 - DNA, 633 bp, Homo sapiens
  misc_feature: GZ8MTXP01EFY28.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgcccggcctccatcctcctgcaggtctagtcagacgcctccagcatactgatggatacaacttagttggattcggtacctgacaagaacgccgaggcagtcctaccacaactcctagtattcttagttttcgggttactaacggtccggggccgtccggggtcccctaggacgtggtcaggtggactggtggatcgaggactagtagtatttacaactagaaaatcgagagaaggaggtaggagggagtagggtagggttagggtttaggggtttaattacgtgagtagtacgtacgaacggtacctaaacccgaaacccgtacgttacccgtaccggttcccgggaacggaacgggaccgaccgttaccgtagggtaaacgttaaacgttaaacgttaacgtggtcggtctcgaccttacctaacttcgttccg

SEQ ID NO: 422105 - DNA, 575 bp, Homo sapiens
  misc_feature: GZ8MTXP01BE8GC.15.25.C03.1.454.CMB.2.raw
  modified_base (357)..(357): a, c, t, g, unknown or other
  modified_base (466)..(466): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctcacaactctgatctagtttgggtactaagtccgggcctccggggtccccctggactaggtcagtgcnggtgatcgaggcatagtactttacactagaaatcagcagagtggagcgtgaggtacgttggggtttattacgtggcagtcgacgaacggtacctaaaccgaaacccgtntaccgtacccgttcgggcccggaagggaccaccggcccgtaagggtaagttaaacgttaaacggttaaccgtgggtacggccgtacggccacccgtaacgttcgttccg

SEQ ID NO: 422106 - DNA, 581 bp, Homo sapiens
  misc_feature: GZ8MTXP01DAIZJ.15.25.C03.1.454.CMB.2.raw
  modified_base (187)..(187): a, c, t, g, unknown or other
  modified_base (282)..(282): a, c, t, g, unknown or other
  modified_base (343)..(343): a, c, t, g, unknown or other
  modified_base (363)..(363): a, c, t, g, unknown or other
  modified_base (399)..(399): a, c, t, g, unknown or other
  modified_base (404)..(404): a, c, t, g, unknown or other
tcagtctacgtagccacgaccggtgctcgatttagtagtgtagatttgggtttgggggatcaggactccctcagttcaccttctcacaatgaggctccctgctcagctcctggggctgctaatgctctgggtctctggatccagtggggatattgtgatgactcagtctccactctccctgcccgtnacccctcggagagccggcctccactctcctgcagtctagtcagagcctccagcatactgatggatacaactattggatggtacctgcagaagacnggcagtctcacaaactcctgatcttatttcgggttctaaatcgggcctccggggttccccncgacaggttccagtacggcnggtggactcagggcatagtattttacactagtaaancaganagagtaggacgacgtgtaaggttacggtttgggtttaagttacgtgtactagtacgacgtaacgtaccgtaaacccaacccgtactaccgtaccgttccggaacggtacggacaccgttcgtaaggtaacgttaaacgttaacgaacgtggtacgctcgaccttactcgttcgttcg

SEQ ID NO: 422107 - DNA, 610 bp, Homo sapiens
  misc_feature: GZ8MTXP01EQ215.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcccgcaggtctagtcagagcctcagcatactgatggatacaactattggattggtacctgcagaagccagggcagtctccacaactcctagatcttatttgggttctaagtccgggcctccggggtccctgacaggttcagtggcagtggatcgaggcatagtattttacactagaaatcagcagagtggagcgtaggaggtacggtttaggggtttattacggtgtcgtagtacgacgtaaacggtactaaaccgaaaccccgtacgtcccgtacccgttaccgggacccggaacgggggtaccaacgggcccgttagggaaacgtaaacgttaaaaccggaaacgttacgggtcggtacgtaacggaccgtaccgttacgtttccgttcgtttcccg

SEQ ID NO: 422108 - DNA, 555 bp, Homo sapiens
  misc_feature: GZ8MTXP01ECNV1.15.25.C03.1.454.CMB.2.raw
  modified_base (338)..(338): a, c, t, g, unknown or other
  modified_base (350)..(350): a, c, t, g, unknown or other
  modified_base (386)..(386): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagcccggcctccatctcctgcaggtctagtcagagcctccagcatactgatgatacaactatggatggtactgcagaagccaggcagtctccacaactctgatctatttgggtctaagtcgggcctccggggtcccctgacnggttcagtggcnggtggatcgaggcatagtatttacatagaaatcagngagagtggagcgtgaggtacgttggggtttattacgtgctagtgacgtaaggtacctaaaccgaaacccgtataccgtaccgttcgggaaccggacgggacacggaccgtagggaacgttaacgttaaacgaacgtggtaggcgttcggacttacctaacgttcgttcg

SEQ ID NO: 422109 - DNA, 767 bp, Homo sapiens
  misc_feature: GZ8MTXP01DFU0V.15.25.C03.1.454.CMB.2.raw
  modified_base (756)..(756): a, c, t, g, unknown or other
tcagtctacgtagccacgaccggtgctcgatttagtagtgtagatttgggtttgggggatcgggactcctcagttcaccttctcacaatgaggctccctgctcagctcctggggctgctaatgctctgggtctctggatccagtggggatattgtgatgactcagtctccactctccctgcccgtactaccctccggaggacgccggcccgtcctactctcctcgcgacgtcgtacgtacacgacgcctccacgacataactgtataggtagtaactaactaatttggtagttacggtaccgttcgacgaagaaaggaccgaggacgacgtcttaccactaacctaccttagtattacgtttacttttagggttacgttacgttaccgggtcccgtccggggttccccgtcgtacgtacggtcgtagtacgtaccgagttaagggacgtacacgggtacgtactaagttaacgttttaactaaccgtaagtaaaagttaacaggaccgtaaggaaagggttacgggtgggtaacggttagaagggggttaccggttttaagggggtttaccgttttaagggtaacggtcgtaaagtcggttaaccgaaaccgggttacctaaaccgtaaaaccccgtaccttaccgtacccggtttacccgggcggaaaccgggaacgttccggacccgttagggtaaacgtacgtttaaaaacccggcgtttagtcggacgttaaccgacgaccttacggtttcnccggtttaacc

SEQ ID NO: 422110 - DNA, 620 bp, Homo sapiens
  misc_feature: GZ8MTXP01DTEXB.15.25.C03.1.454.CMB.2.raw
  modified_base (383)..(383): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcaccctggagagccgcctccatctcctgcaggtctagtcagacgcctcagcatactgatggatacaacttattggattcggtactgacaagaagccgaggcagtcctaccaacaacttcctagattcgtttagtttcgggttactaagtccggggtcccgtccggggttccccctaggactaggttcaggtgggacnggtggatcgaaggtctaagtaagttactttacaataaggaaaatcagagagaggtaggagcgtaggagggtaggtttagggtttacttagtggactagtgacgtaacgtaccgtaaacccaaacccgtatacccgtaccgtccgggaaccggaacgggaccgaacgccgtaagggaaacgttaaacgttaaaacgttaccgttggacgtcgttacgacttacctaacttcgtttccg

SEQ ID NO: 422111 - DNA, 509 bp, Homo sapiens
  misc_feature: GZ8MTXP01ALVBP.15.25.C03.1.454.CMB.2.raw
  modified_base (301)..(301): a, c, t, g, unknown or other
  modified_base (337)..(337): a, c, t, g, unknown or other
  modified_base (381)..(381): a, c, t, g, unknown or other
  modified_base (441)..(441): a, c, t, g, unknown or other
  modified_base (454)..(454): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagacgccggcctccatctcccgcaggtctagtcagacgcctccagcatactgatggatacaactattgattggacctgcagaagccagggcagtctccacactccngatctatttggtctagcgggcctcggggtcctgacnggttcagtgcagtggatcaggcatatatttacatagaaatcagnagagtggagcgtggaggtacggttaggggttatacgtgcatgctaagtctaacaaaccgntcaccgtcggcgnggacacggccttaggagaagttaacgacttggtaagctaagcaccatcgttgtcc

SEQ ID NO: 422112 - DNA, 627 bp, Homo sapiens
  misc_feature: GZ8MTXP01ATEY4.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctccagcatactgatggataactaacttattggattggtacctgacaagaagccgagggcacgtctaccactaactcctgtattcttagttttcgggttactaacggtccggggtcccgttccgggggtccccctggacgtaggttcaggtggctggtgggatcgaggtctagtaagtattttacactagaaaatcagcgagaggtggaggcgtggagggtacggtttaggggttacttacgtgcagtacgcgtaaacggtacctaaaccgaaaccccgtatacccgtaaccggttccgggaacccggaacgggaccgaacgttccgtaagggaacgttaaacgttaaaaccggttacgtgggtcggtaactcggaccacccgttcgttcgttcg

SEQ ID NO: 422113 - DNA, 617 bp, Homo sapiens
  misc_feature: GZ8MTXP01C1TYQ.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagacgccggcctccatctcctgcaggtctagtcagagcctcagcatactgatggatacaactattggattggtacctgcagaagccgagggcagtctccacaactcctgattctagtttggttctaacgtcgggcctcccggggtccctgactaggttcaagtgcagtgatcgagcatagatttacactagaatcagcagagtgggagcgtagagggtacggtttggggggtttaattacgtgacgtagtcgacgtaaacgggttaccctaaaccgtaaaccccgtactacccgtaacccggtttccgggaacccggacgggggaaccaccggtacccgtagggttaaaacggttaacgtttaaaaacggtaaccgttagggttaacgggaccgttacggaccctaaccgttaacgtttccg

SEQ ID NO: 422114 - DNA, 626 bp, Homo sapiens
  misc_feature: GZ8MTXP01DZG5W.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagacgccctccagcatactgatggatacaattagtggattcggtacctgacagaacgccgaggcagtcctaccactaactctgattcttagtttgggttactaaggtccgggtccgtccggggtcccctgaacgtggttcaggtcggctggtggatcgagctaagtagtatttacataagaaatcagacaggagtagggaggcgtagggtaggttacgggtttaggggtttattaacgtgtacgtagtacgtaacgtaacggttacctaaaacccgtaaaccccgtacgtacccgtaacccggttccgggaaccggaaccgggacgaccggaccggtaagggaaacgttaaacgttaaaccggacgttggtacggtctacgaccaacctaattcgttcg

SEQ ID NO: 422115 - DNA, 603 bp, Homo sapiens
  misc_feature: GZ8MTXP01B8P6H.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagacgcctccagcatactgatggatacaactattggattggtacctgcagaagccgagggcagtctccaacaactcctgacttcttagtttgggttactaacgtccggggccgttccccggggtccctagaccgtaggttcaaggttgcgagtggatcgaggcatagtatttacactagaaatcagacagagtggagcgtaggagggtacggtttagggggtttattacgtgacgtagtgacgtaaggtacctaaccgaaaccccgtatacccgtacccggttccgggaccggacggggacccacggtacccgttaggaacgttaacgttaaaacggtaacgtggtcggacgtcgaccgtaaccttaacgttccg

SEQ ID NO: 422116 - DNA, 555 bp, Homo sapiens
  misc_feature: GZ8MTXP01DFJR1.15.25.C03.1.454.CMB.2.raw
  modified_base (289)..(289): a, c, t, g, unknown or other
  modified_base (299)..(299): a, c, t, g, unknown or other
  modified_base (400)..(400): a, c, t, g, unknown or other
  modified_base (415)..(415): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggacctgcagaagccgaggcagtcnccacaactcngatctatttgggtctaagtccgggcctccggggtccccctgactaggttcaggtggctggtggaatcgaggcaagtagtaacttttacatagaaaatcagnaaggagtaggaaggngtaggtaaggtaggtttaggggtttaattacttaggctaagtgactaaacggtctaaacccaaacccgtctaccaccgttcgggaaccgagggacacgccgtaggaacgttattaaacgactgtagctgcacctgttctg

SEQ ID NO: 422117 - DNA, 533 bp, Homo sapiens
  misc_feature: GZ8MTXP01B4W4K.15.25.C03.1.454.CMB.2.raw
  modified_base (389)..(389): a, c, t, g, unknown or other
tcagtctacgtagccacgaccggtgctcgatttagtagtgtagatttgggtttggggatcaggactcctcagttcaccttctcacaatgaggctccctgctcagctcctggtgctgctaatgctctgggtctctggatccagtggggatattgtgatgactcagtctccactctccctgcccgtcaccctggagacgccggcctcatctcctgcaggtctagtcagacgcctcagcatactgatggatacaatattggattggactgcagaagcaggcagtctcacaactcctgatctagtttggtctaagtcgggcctcccggggtcctgacaggtcaagtgcagtgatcagcatagtatttacatagaaatcagagagagtggaggngtaggaggtaggttaggggggtttagttagttagacgtagtgacgaacggtacgtaacctaaacccgaactacctaccgtccggaccggacgggacgacgaccgtacgagagttaaacgtaacgtagtgcgcgcaacgaacgtc

SEQ ID NO: 422118 - DNA, 649 bp, Homo sapiens
  misc_feature: GZ8MTXP01BCI9N.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaacttatggattggtacctgacagaagccgagggcagtcctccaacaactcctgtatcttagtttgggtactaacgtccggggtcccgtccggggtccccctaggacgtagggttccaggttggctaaggtgggtatccgagggctaagtagttacttttacaacttaagaaaatcaagacgaaggaggtgggaggtcgtagggagggttacggtttaggggtttattacgtgtacagttcggaacgtaacggttacctaaacccgaaaccccggtactacccgtacccggttccgggaacccggaacgggaccgtacccggccgtaagggtaacgttaaacgtttaaaaccggaaccgttgggtcggtcctacggaccttaaccgtcgttcgttcg

SEQ ID NO: 422119 - DNA, 568 bp, Homo sapiens
  misc_feature: GZ8MTXP01EBQX6.15.25.C03.1.454.CMB.2.raw
  modified_base (289)..(289): a, c, t, g, unknown or other
  modified_base (298)..(298): a, c, t, g, unknown or other
  modified_base (338)..(338): a, c, t, g, unknown or other
  modified_base (354)..(354): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatcctcctgcaggtctagtcagacgcctccagcatactgatgatacaatattggattggtacctgcagaagcaggcagtcncacactccngatcttagtttgggtctaagtcgggcctccggggtccccngactggttcaggtgcngtggatcaggctagtagtatttacactagaaatcagcaaggagtggacggcgtaggagggtacggtttaggggtttattacgtgactagtgacgtaacggttacctaaaccaaaccccgtataccgtaccgttccgggaacggacgggacaccggccgtaggaacgttaaacgttaaacgaacgttcggtggctcgaccacctaagttctttcg

SEQ ID NO: 422120 - DNA, 654 bp, Homo sapiens
  misc_feature: GZ8MTXP01D1RM0.15.25.C03.1.454.CMB.2.raw
  modified_base (247)..(247): a, c, t, g, unknown or other
  modified_base (355)..(355): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccaggtggggatattgtgatgactcagtatccactctccctgcccgtcacccgtggagacgccggcctccatctcctgcaggtctagtcagacgcctccagcatacngatggaatacaactagttggattggtacctgacagaagccagggcagtctccaacaactcctgattcttagtttggtctaagtccgggccttcccggggtcctgacgnggttcaaggtgcgagtggatcgaggctagtaagtatttacactagaaatcagacgagtaggtggaggcgtaggtaagggttacgggttttagggggggtttaactttacggtagtacgtagttacgtaaccgtaacgggttaccctaaaccgtaaacccccgtacgttacccgtacccgtttaaccggggaacccggaaacggggtaacccgaaccggaccgttaagggaaacgttaaacgtttaaaaccggaaacgtttggaacggtacctacggacctaaccccgttaagtttcccg

SEQ ID NO: 422121 - DNA, 601 bp, Homo sapiens
  misc_feature: GZ8MTXP01A5CBK.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatcctcctgcaggtctagtcagagcctcagcatactgatggaatacaactattggattggtactgcagaagccaggcagtcctcacactctgatctagttggtctaagtcgggcctccggggtccccctggactaggttcaggtcggctaaggtggatcgaggctatagtactttacactagaaaatcgagacgaaggaggtgggacggcgtagggtagggttacgggtttaggggtttaacttacgtgtctagtcgacgtaacggtacctaaacccgaaaccccggtatacccgtaccggttccggaacccggaacgggaccgtaccggcccgtagggtaacgttaacgttaaacggaacgtggtacggcgtacgccaactcgttcgttccg

SEQ ID NO: 422122 - DNA, 648 bp, Homo sapiens
  misc_feature: GZ8MTXP01BMP9R.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccgtggagacgccggcctccatcctcctgcaggtctagtcagacgcctccagcatactgatggaatactaacttagttggattcggtacctgacaagaacgccgagggcacgtcctaccaactaactcctagtacttcgttagtttcggtactacgtccgggtccgtccggggtcccctggacgtaggtcaggtgcgtaaggtcggactcgaggtactaagttagttactttacaactaagaaaactcgaagacgaagggtaggtagggacggtcgttagggtaacgggtttacgggttttaggggtttaactttacggtgacgtaagtcgaacgttaacggtacctaaacccgaaacccgtatccgtaccggttccgggaacggaacggacctacggacgtagggaacgttaaacgttaacggacgttggacggtctacgcttacctaattccgttcg

SEQ ID NO: 422123 - DNA, 582 bp, Homo sapiens
  misc_feature: GZ8MTXP01DJ2QE.15.25.C03.1.454.CMB.2.raw
  modified_base (385)..(385): a, c, t, g, unknown or other
  modified_base (402)..(402): a, c, t, g, unknown or other
  modified_base (404)..(404): a, c, t, g, unknown or other
  modified_base (406)..(406): a, c, t, g, unknown or other
  modified_base (422)..(422): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagacgccggcctccatctcctgcaggtctagtcagagcctcagcatactgatggatacaactattggattggtacctgcagaagccgagggctagtctaccacaactcctgattctaagtttgggttactaagtcggggcccttcccgggggtaccctgacgtaggttcaaggttgcgagtggatcaggnatagtatttactataanananagagagaggtggaggngtaggtaggtaggttagggggtttagttagtagtacgagtgacgtaacgtaacgtaaccgtaaacccgtactaccgtaccgtccggacggacgggacgaccggtacgtacggaacgttaacgttaaacgtaacgtagtcggcgtcgactaacgttcgtcg

SEQ ID NO: 422124 - DNA, 543 bp, Homo sapiens
  misc_feature: GZ8MTXP01DL3F4.15.25.C03.1.454.CMB.2.raw
  modified_base (337)..(337): a, c, t, g, unknown or other
  modified_base (348)..(348): a, c, t, g, unknown or other
  modified_base (451)..(451): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctcacactctgatctatttgggtctaatcggctccggggtcccctgacnggttcagtgcngtgatcaggcatagatttacactagaaaatcagcagaggtggaggctggaggtacggtttggggtttattacgtggacagtgacaggtactaacaaacccgtntaccgaccgttcgggaaccgagggaccacggccgttaggacgttaaacgttaaacgaacgttggtacggtcgtagccaccctaagttccttg

SEQ ID NO: 422125 - DNA, 649 bp, Homo sapiens
  misc_feature: GZ8MTXP01BCLTS.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagcccggcctccatctcctgcaggtctagtcagacgcctccagcatactgatggatacaacttagttggattcggtacctgacaagaacgccgagggcagtcctaccacaactcctgtattcttagtttcgggtactaagtccgggtccgtccggggtcccctggacgtaggttcgaggtggctggtgatcgaggctaagtagtactttacagtaagaaatcgagtagaaggtaggtagggaaggtgtagggtaaggggttaacgggttttagggggtttaacttacgttaggtcgtaagtggtaaccgtaaacggttacctaaacccgaaaccccgtactaccgtacccggttcgggaaccggaacgggaccgtaaccggccggtaagggtaacgttaaacgttaaaccggaacgttcggtacggtcgtacggaccacctaagttcgtttcg

SEQ ID NO: 422126 - DNA, 810 bp, Homo sapiens
  misc_feature: GZ8MTXP01CU72H.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagacgccggcctccatctcctgcaggtctagtcagagcctccagcatactgatggatacaacttagttggattggtacctgacaagaacgccgagggcacgtcctaccaacaacctctagtacttctttagtttcgggttactaacggtccgggtcccgttcccgggggtcccccctaggtaacgtagggtttacccgaggttcgggacgtaagggtgggaacttaccggacgggtacctaagtttaaacggttaaactttttaaaccaaacgttaaacggtaaaaaacttacgaaacggtaaccgtaaagggtaaaggggttagggggaacggggtaccggttaaggggtaaacgggggtttaaaccgggggttttttaaggggggtttttaaactttaaccggttagggtaaccgttaaggttacggtaacccggtaaaacgggttaccccttaaaaccccgaaaaccccgtacgttaaccccgtaccccggtttacccggggaacccggaaccggggaaccgtacccgggttaccggtaaacggggtaacgttaaaacgttaaaccggacgttgggtacggtcgtacggaccaaccttaacgttccgttccg

SEQ ID NO: 422127 - DNA, 643 bp, Homo sapiens
  misc_feature: GZ8MTXP01ACA8Z.15.25.C03.1.454.CMB.2.raw
  modified_base (301)..(301): a, c, t, g, unknown or other
  modified_base (356)..(356): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcaccccctggagagccggcctccatctcctgcaggtctagtcagagcctccagcatactgatggatacaactattggattggtacctgcagaagccagggcagtctccacactcngatctatttgggtctaagtcgggcctccggggtcccctgacgaggttcagtggcngtggatcgaggcatagtatttacactagaaaatcagcgagagtaggaggcgtagggaggtacggtttgggggtttaacgtttaacgtggctaagttacggacgtaaacgggttaccttaaacccgaaacccccggtaatacccgtacccgtttaccggggaacccggtaaacggggaccctaaccgggacccgttacggggtaaaggttaacgttttaaaaaccgggaaaccgttaagggtcggtaaccgttacgggaccgttaaccctaacgttccggtttaaccg

SEQ ID NO: 422128 - DNA, 570 bp, Homo sapiens
  misc_feature: GZ8MTXP01BRVO1.15.25.C03.1.454.CMB.2.raw
  modified_base (362)..(362): a, c, t, g, unknown or other
  modified_base (470)..(470): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatcctcctgcaggtctagtcagagcctccagcatactgatggatacaactagttggattggtacctgacagaagccagggcagtcctccacaactctgatcttagtttgggttctaagtcgggcctccggggtcccctgacaggtcagtcggcnggtgatcaggcagtagtatttacaatagaaatcagcagagtggaggcgtagaggtacggttgggtttaattacgtgcagtgacgtaaggtactaaaccgaaacccgtntaccgaccgttcggaaccggaagggacctacggccgtaggaacgttaacgttaaacgaacggttcggtggtcgtacggaccttaccgtaacgttcgttcg

SEQ ID NO: 422129 - DNA, 636 bp, Homo sapiens
  misc_feature: GZ8MTXP01B5Q5K.15.25.C03.1.454.CMB.2.raw
  modified_base (355)..(355): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctcgcccgtcacccctggagagccggcctccatcctcctgcaggtctagtcagacgcctccagcatactgatgatacaatatgattgactgcagacgcaggcagtctacacactctgatcttagtttggtactacgtccgggccgtccggggtcccctggacgtggtcaggtcggcnggtggactcgaggctagtagtaatttacactagaaatcgagcgaaggtaggaggacggacgtagggtaagggttacgggtttaggggttttaactacgttcgtacgtagtacgacgtaaacgggttacccttaaacccgaacccgtacgtacccgtaaccgggttccggaaccgggtaacgggacgtacccggttacggtaaacgggtaacgttaaacgttaaaccggttaacggttggtaccgggtaactacgggacccttaaactccgttaactttccg

SEQ ID NO: 422130 - DNA, 565 bp, Homo sapiens
  misc_feature: GZ8MTXP01C5J1Y.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtactgacagaagccagggcagtctaccacactctgatcttagttgggtctaagtccgggcctccggggtccccctggactaggttcaggtggctggtggatcgaggcatagtatttacactagaaatcagcgaaggagtggaggcgtaggagggttacggtttaggggtttaattacgtgactagtacgacgtaaacggtacctaaaccgaaacccgtataccgaccgttcggaaccggaggaccacgccgtaggaagaacgttaaacgacgtggtacgctcgcttaacctcgttcgtg

SEQ ID NO: 422131 - DNA, 634 bp, Homo sapiens
  misc_feature: GZ8MTXP01BV9ZW.15.25.C03.1.454.CMB.2.raw
  modified_base (380)..(380): a, c, t, g, unknown or other
  modified_base (507)..(507): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacactatggattggtacctgcagaacgccagggcagtcctccacaactcctgattcttagtttcgggttactaacgtcggggcccgttccggggtcccctggtacgtaggttcaggtggctggtgatcgnggctatagtatttacacgtaagaaactgagacgaaggaggtagggaggcgttagggacgggttacgggtttggggtttactaacgtggtactagtcgacgtaacggtacctaaaccgaaaccccgtnttaccgaaccggttccgggaaccgggtaacgggaccgtaccggccgtaaggggtaaacgttaaacgtttaaaaccggaacgttcgggtcggtaacgttaccggacttaacccgtaagttcctttccg

SEQ ID NO: 422132 - DNA, 702 bp, Homo sapiens
  misc_feature: GZ8MTXP01BULNX.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagagccggcctccatcctcctgcaggtctagtcagacgcctccagcatactgatggatacaacttattggattggtacctgacagaacgccgaggcacgtcctaccaacaactcctagtacttcgtttagttttcgggttactaaacgttcccggggtcccgttccccgggggttccccctacggacgtacggggtttccagggttcgggactggtcgggtaactcggaagggtctaagttaagttaacttttaacaacgttaagaaaactcgaaggacgtaaagggtaggtaggggacgggtacgtagggtaagggttacgggtttagggggtttacttacgtgacgtagtacggacgtaacggtacctaaacccgaaaccccggtactacccgtacccgttccgggaaccggtacggggaccgtaccggccgtaacgggaacgttaaacgttaaacggaaccgttggtacgggtcctacggacccttacctaacttccgttaacg

SEQ ID NO: 422133 - DNA, 591 bp, Homo sapiens
  misc_feature: GZ8MTXP01COQJC.15.25.C03.1.454.CMB.2.raw
  modified_base (367)..(367): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaacttattggattggtacctgcagaagccagggcagtctccacaactcctgatcttagtttcgggttctaagtccggggcctccgggggtccccctggactaggttcaggtggcngtggatcgaggcaatagtatttacactagaaatcagcagagtgggaggcgtaggaggtacggtttaggggtttaattacgtggtctagtcgtactaacggtacctaaaccgaaaccccgtatacccgtaaccgttccgggaaccggaacgggaccgtacgccgtagggtaagttaaacgttaaacgaacgttggtacggctcggacttacctaattcgttaacg

SEQ ID NO: 422134 - DNA, 623 bp, Homo sapiens
  misc_feature: GZ8MTXP01CZR6F.15.25.C03.1.454.CMB.2.raw
  modified_base (362)..(362): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatgatacaatatggattggacctgacagaacgcagggcagtcctccacaactcctgatcttagtttgggttctaacgtccgggcctccggggtccccctggacgtggtcagtcggacnggtggactcgaggctatagtaatttacatagaaaatcgaagacgaaggaggtaggaggcgttagggtagggttaacggtttgggggtttaattacgtggtacagtggtacgtaacggttacctaaaccgaaaccccggtatacccgtaaacccggttccgggaaccgggaacggggaccaccgggaccgttaagggaacgttaaaacgttaaacggaaccgttgggtacggcgttcggaccgttaccgtaacttcgttccg

SEQ ID NO: 422135 - DNA, 674 bp, Homo sapiens
  misc_feature: GZ8MTXP01BFRS1.15.25.C03.1.454.CMB.2.raw
  modified_base (666)..(666): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactcctccctcgcccgtccaccccgtggagacgcccggcctccatcctcctgcaggtctagtcagacgccctccagcatactgagtggaataactaacttagttggtattcggtacctgacaaggaacgccgagggcacgtcctaccaactaacctcctagtacttcgtttagttttcgggtactaacggtccggggcccgttccggggtcccctaggacgtcggttacgaggtggcgtaaggtggactacggagtctaagttaagttaactttaacgaactaagaaatcgaagacgtaagggtagggtagggagggtacgttagggtaacgggttaacgggttttaggggtttaactttacgtggtactaggtacgaaccgtaacggttaccctaaacccgaaaccccgtactaccgtacccggttccgggaaccggacggaccgaccgttacgtaggaacgttaacgttaacgacgtgggacgcgtcgacacgtnttcgttcg

SEQ ID NO: 422136 - DNA, 550 bp, Homo sapiens
  misc_feature: GZ8MTXP01EQGTP.15.25.C03.1.454.CMB.2.raw
  modified_base (353)..(353): a, c, t, g, unknown or other
  modified_base (403)..(403): a, c, t, g, unknown or other
  modified_base (471)..(471): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccaggcagtctcacaactctgatctatttgggtctaagtcgggcctccggggtcccctgactaggttcagtggcngtgatcgaggcatagtatttacactagaaatcagcaagaggtaggacggngtaggtaggtacggtttaggggtttattacgtgactagtgacgtaacggttctaaaccgaaacccgtntaccgtaccgttcggccggaagggaccacggccgtaggaacgttaacgttaaacgactggtgctgacactaagttctcg

SEQ ID NO: 422137 - DNA, 610 bp, Homo sapiens
  misc_feature: GZ8MTXP01D67M4.15.25.C03.1.454.CMB.2.raw
  modified_base (365)..(365): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagagccggcctccatcctcctgcaggtctagtcagacgcctccagcatactgatggatactaaattagtggattggtacctgcaagaacgccgaggcagtctaccacaactctgatcttagtttggtactaagtccgggccctccgggtcccctgacgtaggtcagtgcnggtgatcgagcatatatttacactagaaatcgagagtagagtggaggcgtaggtaggttaggtttagggttaacttacgtgtactagtgaacgtaacggtactaaacccgaaacccgtacgtaccgtacccggttcgggaacccggaacgggttaccgaccggttaccgtaaacggtaacgttaaaacgtttaaaccgaaaccgttggtacggtcttacggaccttacctaacttcgtttaaccg

SEQ ID NO: 422138 - DNA, 555 bp, Homo sapiens
  misc_feature: GZ8MTXP01E5MBL.15.25.C03.1.454.CMB.2.raw
  modified_base (353)..(353): a, c, t, g, unknown or other
  modified_base (389)..(389): a, c, t, g, unknown or other
  modified_base (527)..(527): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagcccggcctccatctcctgcaggtctagtcagacgcctcagcatactgatggatacaatattggattggacctgcagaagccaggcagtctcacactctagatctagtttggtctaagtcgggcctccggggtcccctgacgtaggtcaggtggcngtggatcgagcatagtactttacactagaaatcagngagaggtggaggcgtgaggtagttggggtttattactgcagtgacgaaggtacctaaacaaaccccgtataccgtaccgttcgggccggaacgggacaccggaccgtagggtaagaaacgtttaaaacgaacgttggngggtctcggaccactaacgttcttaacg

SEQ ID NO: 422139 - DNA, 627 bp, Homo sapiens
  misc_feature: GZ8MTXP01AM4IX.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgacagaagccaggcagtcctaccacaactcctgattctagttttcgggttactaagtccggggcccgttccgggggtccccctggacgtaggttccaggtacggcgtaaggtggatcgagggcagtagtattttaacactaagaaatcgagacgaaggtaggtggacggtacgtaggtagggtacgggttttaggggtttacgttacgtgtacagtacgacgtaacgggtacctaacgtaaaccccgtctaccgtacccgttccgggaaccggacggggacgaccggaccgtaagggaacgttaacgttaaacgacgttgggtcggtcgtcggaccttaccgtaagttccgttccg

SEQ ID NO: 422140 - DNA, 607 bp, Homo sapiens
  misc_feature: GZ8MTXP01DJ5HP.15.25.C03.1.454.CMB.2.raw
  modified_base (597)..(597): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagcgagggcagtcctccaacaactcctgtatctttagtttgggttactaacgtcgggccgtccggggtccccctggacgtaggttcaggtcggctaaggtggatcgaggctaagttagtaattttacacttagaaaatcgagacgaaggtaggtgggaggcgtaggtaagggtacgggttttaggggtttaattacgtgtacgtagtgaaccgtaacggtacctaaacccgaaaccccgtataccgtacccgttccgggaaccggacgggaccgacgcgtaggaacgttaaacgttaaacgacgtggtcggctcgcacctnttcgttaacg

SEQ ID NO: 422141 - DNA, 578 bp, Homo sapiens
  misc_feature: GZ8MTXP01D0J8A.15.25.C03.1.454.CMB.2.raw
  modified_base (358)..(358): a, c, t, g, unknown or other
  modified_base (370)..(370): a, c, t, g, unknown or other
  modified_base (400)..(400): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctcgcccgtcacccctggagagccggcctccatctcctgcaggtctagtcagagcctccagcatactgatggatacaacttattggattggtacctgacagaagccgagggcacgtcctccacaacctcctgattcttagttttcgggtctaacgtcgggccgtccggggtccccctgacnggttcaggtgcnggtggatcgagctagtagttatttacatanaagtcagcagagtggaggcgtaggaggtaggtttgggtttattacgtgtcagtcgcgtaacggtccttaaacccaacccgtatacccgtaccgtcgggaaccgtacgggacacgttccgtaggaacgttaaacgttaaacgaacgtggacgtcgtcgaccttactaagttcgttaacg

SEQ ID NO: 422142 - DNA, 599 bp, Homo sapiens
  misc_feature: GZ8MTXP01EBIH2.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatcttctgcaggtctagtcagagcctccagcatactgatggatacaactattggattggtacctgcagaagccagggcagtctaccacaactcctgattcttagtttcgggttactaacgtccggggcctccggggtccccctggacgtaggttcaggtcgctggtggatcgaggcaagtagtatttacactagaaaatcaagcgaagaggtggaggcgtaggaggttacggtttaggggtttaattacgtggacaagtgacgtaaacggtacctaaacccgaaacccgtataccgtaccgtcggaaccggaaggaccgaccgacgtacggtaagttaaacgttaaacggaacgttggtacggcgttacgaccttacctaacttcgttaacg

SEQ ID NO: 422143 - DNA, 643 bp, Homo sapiens
  misc_feature: GZ8MTXP01DPQZE.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcaccctggagagccggcctccatctcctgcaggtctagtcagagcctccagcatactgatggatacaactattggattggtacctgacagaagcgaggcagtctccaacaactctgattcttagtttcgggttactaacgtccgggtccgtccggggtcccctggtactaggttcaggttcggctaagggtggactacgagggtctaagttaagtaacttttaacaacttaagaaaatcgaagtacgaaggtaggtagggaaggcgtagggtaacggggttacgggttttagggggttttaatttacgtaggtactaagttacggacgtaaacggtaccttaaacccgaaaccccggtataccgtacccgttccggggaaccggaacgggaccgaccgttaccgtaaggaagttaaacgttaaacgaacgtggtacggctcgacacctaattcgttcg

SEQ ID NO: 422144 - DNA, 700 bp, Homo sapiens
  misc_feature: GZ8MTXP01BFFXN.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctccagcatactgatggatacaacttgtggattggtacctgacaggaacgccgagggcagtctaccacaactctgatcttagtttgggttctaacgtccggccgttccggggtccccctggacgtaggttcaggtcggactggtggactacgaggtctaagttaagtaacttttaacgactaagtaaaatcgaagacgaagggaggttaggggagggtacgttaggggtaacggggttacgggttttaggggggttttaacgtttacggttaggtacgtagttacggtaaccgtaacgggttaactaaaccccgtaaaccccggtaaccttacccgtaacccggtttcccggggaacccgggaacggggaacccggaaccggacccggttaaggggtaaacgttaaacggttaaaaccgttaaccggttgggtacggtcttcggaccttaaccgtcgtttccgttccg

SEQ ID NO: 422145 - DNA, 664 bp, Homo sapiens
  misc_feature: GZ8MTXP01DXSVR.15.25.C03.1.454.CMB.2.raw
  modified_base (163)..(163): a, c, t, g, unknown or other
  modified_base (468)..(468): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactnagtctccactcctccctcgcccgtccacccgtggagacgcccgcctccatcctcctgcaggtctagtcagacgccctacagctatactagataggataactaacttagttaggattcggtacctgacgaagaagccgaggcagtcctacacaactctagtacttcttagtttcggttactaacgtccgggccgtcccggggtccccttaggactacggttcgaggtcgaccgtgggtacggtaatccggagggtactaagttaaacgtttaacttttaacaaacgttaaagaaaatccgaaacgngtaaaggaggtaggggaggtcgtagggtaagggttacgggtttaggggtttaacttacgtagacgtagtacgaacgtaaacggtacctaaacccgaaacccgtacgtaccgtacccgtcgggaaccggaacggacgaccgacgtaggaaacttaaacgttaaacgacgttggaggcgtcaccacctaattcgttcg

SEQ ID NO: 422146 - DNA, 642 bp, Homo sapiens
  misc_feature: GZ8MTXP01B6GHX.15.25.C03.1.454.CMB.2.raw
  modified_base (358)..(358): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagacgccggcctccatctcctgcaggtctagtcagacgcctccagcatactgatggatacaacttattggattggtacctgcagagccgaggcagtctcacaactctgatcttagtttggtactagtcgggccgtccggggtcccctgactggttcaggtgcnggtggatcgaggctatagtatttacgactagaaatcagtacgaaggaggtagggaaggtcgtagggaagggttacgggtttaggggtttaacttaacgtggtacctagttcgaacgtaaacggtacctaaacccgaaaccccgtacgtacccgtaaacccggttccgggaacccgggaacggggaaccgacccggttacccggtaagggtaaacgttaaacgttaaaaccggaaccgttgggtcggtccgttacggaccgttaaccctaacggttccgtttccg

SEQ ID NO: 422147 - DNA, 589 bp, Homo sapiens
  misc_feature: GZ8MTXP01E07W2.15.25.C03.1.454.CMB.2.raw
  modified_base (284)..(284): a, c, t, g, unknown or other
  modified_base (357)..(357): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagacgcctccagcatactgatggatacaatatgatgactgcagagccaggcagtccnccacactctgatcttagtttgggtactaacgtcgggcccgtccggggtccccctggactaggttcaggtggcnggtgatcgaggacaatagtatttacactaagaaatcgaagacgaaggaggtagggaaggcgtagggtaagggttacgggtttaggggttttaagttacgtaggtactagtacgacgtaaacggtacctaaacccgaaaccccgtactaccgaccgttcgggaaccgaagggaccacgccgtaggaagaacgttaaacgaacgtggtcgcgtcgaccaccgtaacttcgttcg

SEQ ID NO: 422148 - DNA, 600 bp, Homo sapiens
  misc_feature: GZ8MTXP01AV4C3.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcaccctggagagccggcctccatctcctgcaggtctagtcagagcctccagcatactgatggatacaactattggattggtacctgcagagccgaggcagtctccacactctgatctagtttggtactaagtcgggccgtccggggtcccctgacgaggttcagtgcaagtggatcgaggctatagtatttacactagaaatcagcgaggagtggaggcgtaggtagggttacgggtttaggggtttattacgtgtactagtacgacgtaaacggtacctaaaccgaaaccccgtactacccgtacccgttccgggaacccgggaacgggaccgaaccggttaccgtacgggaaacgttaaacgttaaaacggttaacgttggtacggcgtacgaccacctaacgttcgttaacg

SEQ ID NO: 422149 - DNA, 521 bp, Homo sapiens
  misc_feature: GZ8MTXP01DGWEA.15.25.C03.1.454.CMB.2.raw
  modified_base (380)..(380): a, c, t, g, unknown or other
  modified_base (382)..(382): a, c, t, g, unknown or other
  modified_base (384)..(384): a, c, t, g, unknown or other
  modified_base (389)..(389): a, c, t, g, unknown or other
  modified_base (393)..(393): a, c, t, g, unknown or other
  modified_base (417)..(417): a, c, t, g, unknown or other
  modified_base (420)..(420): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattgactgcagaagccaggcagtctccacaactctgatctattgggtctaagtcgggcctccggggtccccctgacaggttcagtggcaagtgatcagcatagatttacatagaaatanananagagngagngtgaggtagttaggttagttatgnagngacgacgtactaaccaaccgtactacgtaccgtcggcgacggacgacgacgtacgaagaacgttaaacgttaacgtaagtgtcgtcgcactaacgttcgtg

SEQ ID NO: 422150 - DNA, 583 bp, Homo sapiens
  misc_feature: GZ8MTXP01DEYWW.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagacgccggcctccatcctcctgcaggtctagtcagagcctccagcatactgatggatacaactatttggattgtacctgcagaagccagggcagtctccacaactcctgtattctatttggttctaagtcggcctccccgggtcctgacgagttcaagtgcagtggatcgaggctatagtatttacactagaatcagacaggagtagggaggcgtaggagggttacgggttagggggtttaattacgtgacgtagtgacgtaaggtacctaaccgtaaaccccgtagtcctaccgttccggaccggacgggtaccacggtacccgtaaggaacgttaacgttaaaacggtaacgtaggtcggtactcgacctaacgttcttaacccg

SEQ ID NO: 422151 - DNA, 607 bp, Homo sapiens
  misc_feature: GZ8MTXP01EI26U.15.25.C03.1.454.CMB.2.raw
  modified_base (381)..(381): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagagcccggcctccatctcctgcaggtctagtcagagccctcagcatactgatggataacaacttattggattggtacctgacaagaacgccagggcagtcctccaacaactctagtattcgttagtttgggtacttaacgtccggggccgttcccggggtcccctggacgtaggttcaggtggcnggtggatcgaggctaatagtatttacatagaaatcagacgaaggagtgggaggcgtaggtaagggtagggtttaggggtttacttacgtggactagtcgaacgtaacggttacctaaaacccgaaaccccgtatacccgtaccggttcgggaaccggtacgggaccgtaccgacgtaggaaacgttaacgttaaacgacgtggtacgctacgccactgttcgttcg

SEQ ID NO: 422152 - DNA, 607 bp, Homo sapiens
  misc_feature: GZ8MTXP01EMBDF.15.25.C03.1.454.CMB.2.raw
  modified_base (255)..(255): a, c, t, g, unknown or other
  modified_base (258)..(258): a, c, t, g, unknown or other
  modified_base (262)..(263): a, c, t, g, unknown or other
  modified_base (265)..(265): a, c, t, g, unknown or other
  modified_base (325)..(325): a, c, t, g, unknown or other
  modified_base (478)..(478): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagagcctccagcatactgatgatacatntgntgcnnanagcaggcagtctcacactctgatctatttgggtactaagtccgggcctccggggtccccngacgtaggttcaggtcggcaaggtggatcgagcagtagtatttacatagaaatcagcaaggagtggaggtcgtaggtaagggttacggtttaggggtttaattaacgtggactagtacgtaacgtaacggtacctaaacccgaaaccccggtntacccgtaacccggttccggggaacccgggaacgggaccgaaccggttaccggtaagggtaaacgttaaacggttaaaaccgttaacgttgggtacggtaaccttcgaccttaccctaagttcgttccg

SEQ ID NO: 422153 - DNA, 664 bp, Homo sapiens
  misc_feature: GZ8MTXP01CLZ0D.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactcctccctcgcccgtccaccccgtggacgacgcccggcctccatcctcctgcaggtctagtcagacgccctccagcatactgatgataactaattagttggattggacctgacagaacgccgaggcacgtccaccactaactctagtattcgtttagtttcgggttactaacggtccgggtcccgtccggggtccccctggacgtggttcaggtggactggtgatcgaggctaagttagtatttaacacgttaagaaactcgaagtagaaggtagggtgggaacggtcgttagggtaacgggttacgggttttaggggtttaattacgtgtacgtaagtacggtaaccgtaaacggtaccctaaaaccccgaaacccgtactaccccggtaccggttccgggaaccggaacgggaccgacggttaccgtaagggtaacgttaaacgttaaacggacgttggtcggtcctcgaccacctaacgttcgttaaccg

SEQ ID NO: 422154 - DNA, 837 bp, Homo sapiens
  misc_feature: GZ8MTXP01BWLIV.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctcgcccgtccacccgtggagacgcccggcctccatctcctgcaggtctagtcagacgcctccagcatactgatggactaactaacttagttggattcggtacctgacgaagaacggccgaggctacgtcctaccaaccaaccttcctagtactttacgtttaaggttttcggggtttacctaaacgggttccccggggtcccggttacccccgggggttcccccctacgggtaacggtacgggtttaccgtagggttcggggaccgtaaggggttcggaaacgttccgggaaagggtacctaaaggttaaacggtttaaactttttaaaccaaacgtttaaaggaaaaacttccgaacggaacgtaaagggtaaggggtttaggggaccgggttacggttaaggggttaacgggggtttaacggggttttttaaggggggtttttaacttaaccggtttagggtaacctaggtttacggaaaccgttaaaccgggttacctaaaaccccgtaaaccccgtcgttaccccgtaccccggttaccggggaacccgggaacgggttaaccgacccgggttacgttaacgggaaacgttaaaccgttaaacggacggtttcggacggtaaccgtcgaccgttacgtaacgttctttaaccgg

SEQ ID NO: 422155 - DNA, 554 bp, Homo sapiens
  misc_feature: GZ8MTXP01BGJ84.15.25.C03.1.454.CMB.2.raw
  modified_base (386)..(386): a, c, t, g, unknown or other
  modified_base (389)..(389): a, c, t, g, unknown or other
  modified_base (391)..(391): a, c, t, g, unknown or other
  modified_base (406)..(406): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagcccggcctccatctcctgcaggtctagtcagagcctccagcatactgatggatacaactattggattggtacctgcagaagccagggcagtctccacactctgatctatttggtactagtcgggcctccggggtcccctggactaggtcaggtggctggtcggatcgaggcatagtatttacataanaananagagagagaggaggngtgtaggtaggttagggttaggttacgtgtcgtagtagacgtacgtacgtaaccgaacccgtactaccgtaccgtcggccggacggacgacgcgtacggtaagttaacgttaacgttacgtaagtgtcgtcgacactaacgttcgtcg

SEQ ID NO: 422156 - DNA, 632 bp, Homo sapiens
  misc_feature: GZ8MTXP01B4TMD.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacactattggattggtacctgcagacgccgaggcagtctccacactctgtacttctttagtttcggttactaacgtccgggtcccgtccggggtccccctgacgtggttcaggtcggactgggtgatcgagtactagttatactttacattaaggaaactcgagacgaaggtaggtagggaggtacggtagggtaacgggttacgggtttggggtttaattacggtgtactagtcgtaaccgtaacggtacctaaaccgaacccgtcgtaccgtacccggttcgggaacccgggaggaccgtaccggttacgtaacgggtaacgttaaacgtttaaacgacgttggtacggtccgtacgaccttaactcgtttaacgttccg

SEQ ID NO: 422157 - DNA, 583 bp, Homo sapiens
  misc_feature: GZ8MTXP01BZO3I.15.25.C03.1.454.CMB.2.raw
  modified_base (366)..(366): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgacagaagccgagggcagtcctccacaactcctgatcttagtttgggttactaagtcgggcctccggggtccccctggacgaggttcaggtggcnggtggatcgaggcatagtatttacactagaaaatcaagcgaaggaggtgggaggcgtaggtaagggtacgggtttaggggtttattacgtgactagtgacgtaaggtacctaaaccgaaacccgtataccgtaccgttcgggccggacgggaccacggccgtagggaacgttaacgttaaacggacgtggtcggcgtcgaccacctaacttcgttcg

SEQ ID NO: 422158 - DNA, 576 bp, Homo sapiens
  misc_feature: GZ8MTXP01DNN65.15.25.C03.1.454.CMB.2.raw
  modified_base (368)..(368): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccaggcagtctaccacaactctgattcttagtttgggttactaacgtccgggccgttccggggtccccctggacgtaggttcaggtggcnggtgatcgaggcatagtatttacatagaaatcagacgaggaggtggaggcgtaggagggtacggtttggggtttattacgtgactagtgacgtaacggtctaaacccgaacccgtatccgtaccggttcgggaaccggacgggaccacggccgtaggaacgttaacgttaaacgaacgtggtacggcgtgaccttacctcgttcgtcg

SEQ ID NO: 422159 - DNA, 601 bp, Homo sapiens
  misc_feature: GZ8MTXP01DB9JR.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagagccggcctccatctcccgcaggtctagtcagagcctccagcatactgatggatacaactattggattggtacctgcagaagccaggcagtctccacaactcctgatctatttgggtctagtccgggcctccggggtccctgacaggttcagtggcagtggatcgaggcatagtatttacactagaaatcagcagagtggagcgtgaggtacgttaggggttattacgtgctagtgacgtaacggtactaaccgaaaccccgtatacccgtacccgttccggggacccggaaacggggaccgaccggtacccgttagggtaaacggtaacgtttaaaaaccggaccgttaggttaacggggccttaacggaccctaaccgttaacttccgttaacggttttccc

SEQ ID NO: 422160 - DNA, 553 bp, Homo sapiens
  misc_feature: GZ8MTXP01CU2QQ.15.25.C03.1.454.CMB.2.raw
  modified_base (356)..(356): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgacagaagccagggcagtctccacaactctgatcttattgggtctaagtcgggcctccggggtcccctggacaggttcaggtgcnggtgatcgaggcaatagtatttacactagaaatcagcagagtggaggctgaggtacggtttaggggtttattacgtgcgagttacggacaaggtacctaaaccgaaacccgtatccgaaccgttcgggaaccggacgggaccacgccgtaggacgttaagttaaacgacgtggtacggctgccacctaattcgttcg

SEQ ID NO: 422161 - DNA, 583 bp, Homo sapiens
  misc_feature: GZ8MTXP01CSCGU.15.25.C03.1.454.CMB.2.raw
  modified_base (356)..(356): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctccagcatactgatggatacaactattggattggtacctgcagaagccgaggcagtctccacactctgatcttagtttgggtctaagtcgggcctccggggtcccctgactggttcaggtgcngtggatcgaggcagtagtatttacactagaaatcagcagagtggaggacgtggaggtacggtttaggggtttattacgtgtctagtgacgtaacggtcctaaccgaaaccccgtataccgaccgttccgggccggaacgggttaccgaccggcccgttagggaacgttaaacgtttaaaccggaacgttcggtacgtcgtacggaccttaccgtaacttcgttaacg

SEQ ID NO: 422162 - DNA, 635 bp, Homo sapiens
  misc_feature: GZ8MTXP01BKMAH.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagcccggcctccatctcctgcaggtctagtcagagcctccagcatactgatggatacaacttattggattcggtacctgacaagaacgccgagggcagtcctaccacactcctgattcttagtttgggtctaacgtccgggcctccggggtcccctggactaggttcaggtcggctaaggtggatcgaggtctaatagtatttacactagaaaatcgagacgaaggtaggtagggacggtcgtagggtaagggttacgggttttagggggttttaacgttacggttggactagttacggacgtaaccggttacctaaaacccgaaccccgtacgtaccgtaacccgggttccgggaaccggaacggggacctaccggaccgttagggaacgttaacgttaaacggacgttggacggctggaccactaacgttcgttcg

SEQ ID NO: 422163 - DNA, 615 bp, Homo sapiens
  misc_feature: GZ8MTXP01AF4YR.15.25.C03.1.454.CMB.2.raw
  modified_base (367)..(367): a, c, t, g, unknown or other
  modified_base (393)..(393): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagacgccggcctccatctcctgcaggtctagtcagacgcctccagcatactgatggatacaacttagttggattggtacctgacaagagccgagggcagtcctccacactctgatcttagtttgggtctaagtccgggcctccggggtcccctggacgtaggtcaggtggcnggtgatcagctatagtatttacatanaaatcagcgagaggtggaggcgtaggtagggtacgggttttggggtttaattacgtggtactagttcgaacgtaacggtacctaaacccgaaaccccgtagttacccgtaaccggttccggggaacccggaacgggacccgtaccggttaccgttaagggaaacgttaacgttaaaacggttacgtgggtcggtctacggaccttaccgtaacttcgttccg

SEQ ID NO: 422164 - DNA, 664 bp, Homo sapiens
  misc_feature: GZ8MTXP01BRZWO.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctccagcatactgatggatacaacttagttggattggtacctgacagaagccgagggcacgtccaccacaactcctgtatcttagtttcgggttactaagtccggggcccgttcccgggggtcccctggacgtaggttcaggtcgggacaagggtggatcgaggctaatagtactttacaactagaaaatcgaagtcgaaggaggtagggaggtcgtaggggtaagggttacgggtttaggggtttaattacgtagtaccgtaagtacggaaccgtaacggtaccctaaacccgaaaaccccgtgtacccgtacccggttccgggaacccggtaaggggaccctaccgggttaccgttaagggtaaacgttaaaccgtttaaacggacgttaacgggtacgtcgtacggacttaaccttcgttaactttccg

SEQ ID NO: 422165 - DNA, 677 bp, Homo sapiens
  misc_feature: GZ8MTXP01D5DJV.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagacgcccggcctccatcctcctgcaggtctagtcagacgcctccagcatactgatggaatactaacttattggattcggtacctgacaagaacgccgagggcacgtcctaccaacaacctctgtatctttagtttcgggtactaacggtccggtccgtccggggtccctcggacgtacggttcaggtcggacgtaaggtgaacgtccgaaggtactaaagttaagttaaacttttaacaacgttaaagtaaaaacgtcgaagacgtaaagggtagggtaggggaggtcggtaggggtaagggttacgggttttaggggtttaagttacgtggtactagtacggtaacgtaaacggttacctaaacccgaaacccgtatacccgtaccggttccgggaaccggaacgggaccgacggttacggtaacggtaagttaaacgttaaacgacgttggtacggtctacgaccactaacgttcgtcg

SEQ ID NO: 422166 - DNA, 668 bp, Homo sapiens
  misc_feature: GZ8MTXP01A9L98.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatcctcctgcaggtctagtcagagcctccagcatactgatggatacaacttattggattggtacctgacagaacgccgagggcagtcctaccaacaactcctagtatttcgttagttttcggggttacttaacggtccggggtcccgttccggggtcccctaggacgtaggttcgaggtgggctaaggtggatcgaggtctagttagtattttacaacttagaaatcgaagacgtaaggtaggtgggaggtacgttaggagggttacgggtttagggggtttaattacgtggtacgtagttcggaacgtaacggttacctaaacccgaaaccccgtacgttacccgtacccggttccgggaaccggtaacgggaccgaccggttccgttaagggaacgttaaacgtttaaacggaaccgttggtacggtccgtacggaccttacctaacgttccgtttccg

SEQ ID NO: 422167 - DNA, 606 bp, Homo sapiens
  misc_feature: GZ8MTXP01BPOB1.15.25.C03.1.454.CMB.2.raw
  modified_base (380)..(380): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagagcctccagcatactgatggatacaacttagttggattcggtacctgcaagaacgccgagggcagtcctccaacaactcctgattctttagtttcgggttactaagtccgggccgtccggggtccccctaggacgtaggttcagtcgggcnggtgatcgaggtcagtagtatttacactaagaaatcagcgaaggagtggaggacgtaggagggtacggtttggggtttatacgttgctagtgacgtaacggttacctaaacccgaaacccgtatacccgtaccgttcgggaacccggagggttaccgaaccggccgtaaggaacgttaaacgtttaaacgaccgtgtcggcgtacgccaccgtaagttccgttccg

SEQ ID NO: 422168 - DNA, 708 bp, Homo sapiens
  misc_feature: GZ8MTXP01BSHY6.15.25.C03.1.454.CMB.2.raw
  modified_base (300)..(300): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagacgccggcctccatcctcctgcaggtctagtcagacgcctccagcatactgatggatacaacttattggattcggtacctgcaagaacgccgagggcagtccnccacactctgattcttagtttggtctaacgtccgggcccgtccggggtcccctggacgaggttcaggttcggcgtaaggtcggattccgagggtactaagttaggttaacttttacgaactaaggaaaactcgaagacgaaggtagggttagggacgggacgttagggggtaacgggttaacgggggttttagggggtttttaaactttaacgtggtaaccgtagttacggtaccgtaaacggggttaccccttaaaaccccgaaaacccccggtacgtaccccgtaaacccggtttcccgggaacccgggaacggggttaaccaaccgggaccgttaagggtaaacgttaaacgtttaaaccggaacgttgggcggtaacgtcgaccaccgtaacttccgtttaacg

SEQ ID NO: 422169 - DNA, 575 bp, Homo sapiens
  misc_feature: GZ8MTXP01D3ZIP.15.25.C03.1.454.CMB.2.raw
  modified_base (270)..(270): a, c, t, g, unknown or other
  modified_base (401)..(401): a, c, t, g, unknown or other
  modified_base (406)..(406): a, c, t, g, unknown or other
  modified_base (445)..(445): a, c, t, g, unknown or other
  modified_base (475)..(475): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactcctccctgccccgtccaccccgtggagacgcccggcctccatcctcctgcaggtctagtcagacgcctccagcatactgatgatacatatgatgtacngcagagcgaggcagtcctacactaactctgtattcttagtttgggtactacgtccgggccgtccgggtcccctaggacgtaggttcaggtcgactggtgatcgagctatagtatttacatagaaatcaganaaggngtggagtcgtaggaggttaggtttgggttactacgtganagtgacgacggtacctaaaccgaacccgtntacccgtaccgtccgggaacggacggaccgtacgttccggtaaggaacgttaacgttaaaccgacgttggagtctaacgcttacctcttaacgtttcccg

SEQ ID NO: 422170 - DNA, 651 bp, Homo sapiens
  misc_feature: GZ8MTXP01C8D6F.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcccgcaggtctagtcagacgcctcagcatactgatggatacaacttattggattggtacctgacaggaacgccgagggcagtcctaccacaactcctagattcttagttttggtacttaaggtccgggtacccgtccggggtcctacggacgtaggttcgaggtcggaactaggtggtatcgaggactaagttacgtaatttacactaagaaactcgagtacgaaggaggtagggaggtcgtagggtaagggttacggtttaggggtttaacttacggtgtacgtagttacggacgtaaacggtaccctaaaccgtaaaccccgtcgttacccgtacccggtaccgggaccggaacgggaccgacggtacccgttaggtaaacgtaacgttaaacggccgttaggtcgacgtcggacctaccttattccgttcgtttcc

SEQ ID NO: 422171 - DNA, 522 bp, Homo sapiens
  misc_feature: GZ8MTXP01AO9AO.15.25.C03.1.454.CMB.2.raw
  modified_base (506)..(506): a, c, t, g, unknown or other
  modified_base (517)..(517): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagagcctcagcatactgatggatacaactattggattggacctgcagaagccagggcagtctaccacaactcctgatcttatttgggtctaagtcgggcctccggggtccccctggactaggttcagtggcaagtgatcaggcatagtatttacactagaaatcagcaggagtaggaggacgtgaggtagtttggggttaattacgtgcagtgacgaaggtactaaccgaaacccgtatccgaccttcggcgagggacacgcgtagaagagttaacgangtgctgcactnttctg

SEQ ID NO: 422172 - DNA, 621 bp, Homo sapiens
  misc_feature: GZ8MTXP01EZEKM.15.25.C03.1.454.CMB.2.raw
  modified_base (367)..(367): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaacttattggattggtacctgacagaacgccgagggcagtcctaccacaactcctgatcttagtttgggtctaagtccgggcccgtccggggtcccctgacgtaggtcaggtgcnggtgatcgaggctagtagtatttacactagaaatgagcgagaggtaggaggtcgtaggagggttacggtttaggggtttacttacgtggactagtcgacgtaacggttacctaaacccgaaacccgtatacccgtaccggttccggggaacccggtaacggggaccacggttacccgtagggtaacgttaaacgttaaaccggttaacggttggtacggtcgttacgaccgttaacctaacgttcgtttaaccg

SEQ ID NO: 422173 - DNA, 696 bp, Homo sapiens
  misc_feature: GZ8MTXP01B8ZT6.15.25.C03.1.454.CMB.2.raw
  modified_base (607)..(607): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtggggatattgtgatgactcagtctccactctccctgcccgtcaccccgtggagacgcccggcctccatctcctgcaggtctagtcagacgcctccagcatactgatggatactaacttattggattcggtacctgacagaacgccgagggcagtcctaccacaactctgtatcgtttagtttcggggtactaacgtccggggtcccgtccgggggttccccctaggtacgtaggggtttccgaagggttcgggacctaaggggtacgggtaacgttaccgggaagggtacctaaagttaagggttaaacctttttaacaaacgttaaaggaaaacttacgaaggacgaaagggtaacgggtgggaacgggtcgttagggtaaggggttacgggttttagggggttttaacttaacggttggtactagtaggaacgtaacggtaccttaaaccgaaccccgtntaccgtaccggtccggccggagggttaccacggaccgtagggattaaacgttaaacgacgtggtcggtctcgccttactcgttctaacg

SEQ ID NO: 422174 - DNA, 677 bp, Homo sapiens
  misc_feature: GZ8MTXP01CAU9O.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatcctcctgcaggtctagtcagacgcctcagcatactgatggataacaattattggattggtacctgacagaagccgagggcagtcctaccacaactctgatcttagtttggttactaacgtccgggcccgtccggggtccccctggacgtaggttcaggtggactggtggatcgaggctaagtagtacttttaacaactaagaaaatcgaagacgaaaggtagggtagggagggtacgttagggtaaggggttacgggttttagggggttttaattacggtagtaccgtaaggttacggaaccgtaaacggtacccttaaacccgaaaccccgtacgttacccgtacccggttccgggtaacccgggaacggggaacccgaccggttacccggtaaagggtaacgttaaaacgttaaaaccggaacgtggtacggtcgtacggacccttaaccgttaacttcgttccg

SEQ ID NO: 422175 - DNA, 616 bp, Homo sapiens
  misc_feature: GZ8MTXP01CEG6W.15.25.C03.1.454.CMB.2.raw
  modified_base (290)..(290): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagcccggcctccatctcctgcaggtctagtcagagcctccagcatactgatggatacaactatggattggtacctgcagaagcgaggcagtccnccacaactctgatcttagtttgggttactagtccgggccgtccggggtccccctggacgtaggttcaggtgggctggtggactcgaggactatagtactttacactaagaaaactcgagacgaggaggtgggaggtcgtagggtagggttacgggtttggggtttaatacgtgacgtaagtggaccgtaacggtacctaaacccgaaaccccgtagtacccgtacccggttcgggaaccggaacgggttaccaccggccgtaagggaagttaaacgtttaaaacggacgttggtacggtctacgaccacctaacgttcgttaaccg

SEQ ID NO: 422176 - DNA, 716 bp, Homo sapiens
  misc_feature: GZ8MTXP01CS1RR.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgacagaagccgagggcagtcctaccacaactcctgattcgtttaagtttcgggttactaacgtccggggtcccgttccgggggtcccccctggaccgtagggtttccaggttcgggactaaggtgggtaatcgaaggggctaaagttacggttaactttttaaccgaacgttaaaggtaaaaacttcgaaacggacgaaaggtaagggttagggaagggtcgttagggtaaggggttaccggggtttttagggggttttaagtttacggtaggtaccgtaagttacggaaccgtaaacgggttaccctaaacccgaaaaccccgtacgtacccgtacccgttaccggggaacccggaagggacccgaacggccgtaagggaagttaaacgtttaaaacggaccgttgggtacggtcgtacggaccttaaccgtaacttccgttcg

SEQ ID NO: 422177 - DNA, 564 bp, Homo sapiens
  misc_feature: GZ8MTXP01DZIHT.15.25.C03.1.454.CMB.2.raw
  modified_base (350)..(350): a, c, t, g, unknown or other
  modified_base (363)..(363): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagacgcctccagcatactgatggatacaactgttgattggtacctgcagaagccagggcagtcctccacaactctgatcttagtttgggtactaagtccgggcctccgggggtcccctggacnggttcaggtggcnggtggatcgaggctatagtatttacacttagaaactcagcgagagtggagcgtaggaggtacgttggggtttattacgtgctagtcgacgtaacgtctaaaccgaaacccgtataccgtaccgttccggccggaacgggaccacggccgtaggaagttaacgttaaacgacgtggtacgtcgtcgcacctaacttcgttcg

SEQ ID NO: 422178 - DNA, 612 bp, Homo sapiens
  misc_feature: GZ8MTXP01EMCNF.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgccccgtcacccctggagagcccggcctccatctcctgcaggtctagtcagagcctccagcatactgatggatacaactatggattggtacctgacagaagccagggcagtcctaccacaactcctgtatcttagtttgggttacttaagtcgggcccgtccggggtccccctggacaggttcagtgggcaaggtggatcgaggtctagtagtactttacactagaaatcagcgaagaggtggaggacgtaggtagggtacggtttggggtttaacttacgtgactagtagacgtaaagggttacctaaaccgaaaccccgtactacccgtaaccgttccgggaaccggaacgggaccaccggttaccgtaggtaacgttaacgttaaaacgaaccgtggtcggcttacggaccttaccgtaacttcgttcg

SEQ ID NO: 422179 - DNA, 612 bp, Homo sapiens
  misc_feature: GZ8MTXP01BCVXI.15.25.C03.1.454.CMB.2.raw
  modified_base (295)..(295): a, c, t, g, unknown or other
  modified_base (409)..(409): a, c, t, g, unknown or other
tcagtctacgtagccacgaccggtgctcgatttagtagtgtagatttgggtttgggtgatcaggactcctcagttcaccttctcacaatgaggctccctgctcagctcctggggctgctaatgctctgggtctctggatccagtggggatattgtgatgactcagtatccactctccctgccccgtcacccctggagacgccggcctccatcctcctgcaggtctagtcagacgcctccagcatactgatggatacaactattggattggtacctgcagaagccgagggcagtcnccacaactcctgatcttagtttggttctaagtcgggcctccccggggtcctgacagtcaagtgcagtgatcgagcatagtatttacactagaaatcagacgagtaggtggaggngtaggtagggttacggtttagggggtttattacgtgtacgtagtcgaacgtaacggtacctaaacccgtaaaccccgtacgtacccgtacccggttaaccgggaaccggaacgggtaacccgaccggtaccgtaacgggaacgttaaacggttaaaaccgtaacgtcggtaacggactacggttacctaaccgttaacgtccg

SEQ ID NO: 422180 - DNA, 657 bp, Homo sapiens
  misc_feature: GZ8MTXP01CGMGP.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtgggatattgtgatgactcagtatccactctccctgcccgtccacccctggagacgccgcctccatctcctgctaggtctagtcagacgccctccagcaatactgataggaataactaactagttggattggtacctgacaaggaacgcgagggcacgtccaccaactaactcctagactttacgtttagtttcgggttactaacggtccggggtcccgttcccccggggtccctaggacgtacggttcaagggttggcgtagtagatacgaggtctaatagttatttacaatagaaatcgagacgaggaggtagggaggtacgtaggtagggttacgggtttaggggggtttaattacgtgacgtagtacggactaaacggtaacctaaaccctaaaccccgtactaccgtacccggttaacgggaccggaacgggtaaccacggtaacgtgggaaacgttaacgttaaaacgtaacgtaggtcgacgtaccgactaacccgttaagtttcc

SEQ ID NO: 422181 - DNA, 587 bp, Homo sapiens
  misc_feature: GZ8MTXP01AK23J.15.25.C03.1.454.CMB.2.raw
  modified_base (367)..(367): a, c, t, g, unknown or other
  modified_base (499)..(499): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaacttattggattggtactgacagaacgccgagggcagtctaccacaactctgattcttagtttgggtactaagtccggccgtccggggtcccctggactaggttcaggtggacnggtgacgtcgaggactagttagtactttacacttaggaaaatcgaagacgaaggtagtagggaggacgtagggaggtacggtttggggttaattacgtgactagtcgacgtaagtacctaaccaaacccgtntaccgtaccgtcgggccggaaggttaccgacgcgtaggaagttaacgttaaacgacgtggtcggcgtcgaccgaactcttcgttaacg

SEQ ID NO: 422182 - DNA, 586 bp, Homo sapiens
  misc_feature: GZ8MTXP01C98SS.15.25.C03.1.454.CMB.2.raw
  modified_base (424)..(424): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagacgccggcctccatcctcctgcaggtctagtcagagccctccagcatactgatggatacaactatttggattggtacctgcagaagccgagggcagtctccacaactcctagtacttctagttttgggttactaacgtccggggcccgttcccccgggggtccctggacgtacggttcaaggttggcaggtggaatcgaggcatagtattttacactagaatcaagnagagtaggaggcgtaggaggtacggtttaggggggtttattacgtgcagtcgacgtaacggtactaaccgaaaccccgtatccaccgttccggaccgagggaccacggaccgtagggaacgttaattaaacgaacgtgtcggactcgacctaacaacgttcg

SEQ ID NO: 422183 - DNA, 559 bp, Homo sapiens
  misc_feature: GZ8MTXP01AC4SO.15.25.C03.1.454.CMB.2.raw
  modified_base (343)..(343): a, c, t, g, unknown or other
  modified_base (398)..(398): a, c, t, g, unknown or other
  modified_base (471)..(471): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctccagcatactgatggatacaactattggattggtacctgcagaagccgaggcagtctccacaactcctgatcttagtttgggtctaagtcggccgtccggggtcccccngacgaggttcaggtgctggtgatcgaggctatagtatttacactagaaatcaganaggagtggagcgtggaggtacgtttggggtttattacgtgcagttgactaaggtacctaaccgaaaccccgtntaccgtacccgttcggccggaacgggacaccggccgttagggaagttaacgttaaacgacgtgtggctacgcttacctaattcgttcg

SEQ ID NO: 422184 - DNA, 614 bp, Homo sapiens
  misc_feature: GZ8MTXP01EXF02.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcaccccgtggacgagcccggcctccatcctcctgcaggtctagtcagacgcctcagcatactgatgatacaactagttggattgtactgacgagacgccgagggcacgtctaccaactaactcctgtaattctttaagttttcgggttactaacggtccgggcccgttcccggggtcccctgacgtggttcaggtgactggtgatcgaggctagtagttactttacatagaaatcagacgagagtggaggtcgtaggtaggttacggtttagggtttattacgtggactagtacgacgtaacggtaccaaccgtaaccctagtacccgtaccggttccgggaaccggacggaccgaccggttccgtaagggtaacaaaccgtttaaaggaaccgtgggtacgcgtcgaccttacgtaacttcggttccg

SEQ ID NO: 422185 - DNA, 604 bp, Homo sapiens
  misc_feature: GZ8MTXP01CH8ZA.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctcagcatactgatggatacaatattggattggtactgcagaacgccagggcagtcctaccacaacctctagattcttagtttgggttactaagtccggggccgttccggggtcccctgactagtattcgaagtggcgaggtggatcgaggctaagttagtattttacaacgtaagaaatcagacgaaggtaggtgggaggcgtaggtagggttacggtttaggggggtttaattacgtgactagtcgacgtaacggtacctaaccgaaaccccgtataccgtaccgttccgggacggacgggaccgacgaccgtaggaacgttaacgttaaacggaacgtgggtaacgtctacgacctaaccttcgttccg

SEQ ID NO: 422186 - DNA, 714 bp, Homo sapiens
  misc_feature: GZ8MTXP01ACCHZ.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagacgcctcagcatactgatggatacaacttagttggattggtacctgacaagaacgccgagggcagtcctaccacactcctgacttcttagtttcgggtactaacggtccggggcccgttccgggggtccccctggacgtagggttcgaggtcgggactggtgggatcggaggtctaagttagttaaacttttacaacttaaggaaaactcgaagacgaagggtaggtagggaggtcggttagggtaacggggttacgggtttttagggggttttaacgtttaacggtggtacctaaggttacggtaacgtaaacgggttacccttaaaaccccgaaaccccggtacgttacccgtacccggttccggggaacccgggaacggggaccgacccggttaccggtaagggtaaacggttaacgttaaaaccgggttacggttcgggtacggtccgttacggacccgttaacccgttcgttccgttccg

SEQ ID NO: 422187 - DNA, 684 bp, Homo sapiens
  misc_feature: GZ8MTXP01DS2A2.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccgcctccatctcctgcaggtctagtcagacgcctccagcatactgatggatacaacttagttggattggtacctgacagaacgccgagggcagtcctacaacaactcctgattcgttagtttgggtactagtccgggtccgtccggggtcccctgacgtggttcaggtcggactaaggtggaatccgaaggtctaaattaagttaacttttaacaacgttaagaaaaatcgaaggacaaggtagggtagggaaggcgttagggaacgggttacggggttttaggggttttaatttacgtaggtactagtacgacgtaaacggttacctaaaacccgtaaaccccgtagtacccgtaacccgttccggggaaccggaaacgggaccgaaccggttaccgtaagggtaaacgttaaacgtttaaaacccgaaaggtttcggacgggtaaccttacggaccttaacccgttaagttcccgtttaacg

SEQ ID NO: 422188 - DNA, 681 bp, Homo sapiens
  misc_feature: GZ8MTXP01BGQKO.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagacgccggcctccatcctcccgcaggtctagtcagacgcctcagcatactgatggataacaactagtttggattggtacctgacaggaacgccgagggcagtcctaccaacaactcctagattcgttagttttcggtactaagtccgggcctccgggggtccctgacgtaggttcaggtggactaggtggatcgaggactagtacgtaattttacactagaaaatcgagacgtaggaggttacgggagggtcgtagggtacggggttacgggtttaggggtttaacttacggttaggcgtaagtacgtaacgtaaacggttaccgtaaacccgaaaccccggtactcccgtaaacccggttccgggacccgggaacgggaaccgttaccggtacccggttaacgggtaaaggtaaacttaaaaccgggttacgttagggtcggtacgtaaccggacgtacccgttacgttccgtttcgtttcccg

SEQ ID NO: 422189 - DNA, 560 bp, Homo sapiens
  misc_feature: GZ8MTXP01EKPZ8.15.25.C03.1.454.CMB.2.raw
  modified_base (403)..(403): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatcctcccgcaggtctagtcagagcctccagcatactgatggatacaactattggattggtacctgacagaacgccagggcagtcctaccacaactcctagatctagtttggttctaagtccgggcctccggggtcctcgactaggtcagtgcagtggatcgaggcagtagtatttacactagaaatcagcagagnggagcgtagagggtacggtttaggggtttattacgtgctagtgacgtaaggtacctaaaccgaaaccccgtatcctaccgtcggccggaaggacacgccgttaggaagtaacgttaaacgacgttaggtggctcgacaccttattcgttgttaaccc

SEQ ID NO: 422190 - DNA, 551 bp, Homo sapiens
  misc_feature: GZ8MTXP01AHEF8.15.25.C03.1.454.CMB.2.raw
  modified_base (287)..(287): a, c, t, g, unknown or other
  modified_base (354)..(354): a, c, t, g, unknown or other
  modified_base (392)..(392): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagacgcctccagcatactgatggatacatattggattggtacctgcagagcaggcagtcnccacactctgatctagtttggtctaagtccgggcctccggggtcccctggacgtaggtccagtggcnggtggatcgaggctatagtatttacactagaaatcagnagagtaggagcgtgagggtacgtttggggttattacgtgctagtgacgtaagtactaaccaaccgtctacctaccgttcgggaaccgaaggaccacggttccgtaggaacgttaacgttaaacgaacttggtacggcgtggtaccaccgtcttcgttcg

SEQ ID NO: 422191 - DNA, 610 bp, Homo sapiens
  misc_feature: GZ8MTXP01BU2EO.15.25.C03.1.454.CMB.2.raw
tcagtctacgtagccacgaccggtgctcgatttagtagtgtagatttgggtttggggtgatcaggattcctcagttcaccttctcacaatgaggctccctgctcagctcctggggctgctaatgctctgggtctctggatccagtggggatattgtgatgactcagtatccactctccctgcccgtcacccctggagagccggcctccatctcctgcaggtctagtcagagcctccagcatactgatggatacaactattggattggtacctgcagaagccaggcagtctccacaactcctgattcttagtttgggttctaacgtccggggtcccgtcccccgggggtccctggactagggttcaaggttgggcgtaggtgggactcgagggtcaattagtattttaacactagaaatcagacaggagtgggaggcgtaggtagggtacggtttaggggggtttattacgtgacagtcgacgtaaggtacctaaaccgaaaccccgacttaccgacccgttcgggaccggagggaccgacgtacccggtaggaacgttaacgttaaaaccggaaccgtggtggaccgtcggacctaaccgttcgtttccg

SEQ ID NO: 422192 - DNA, 556 bp, Homo sapiens
  misc_feature: GZ8MTXP01CF7X1.15.25.C03.1.454.CMB.2.raw
  modified_base (489)..(489): a, c, t, g, unknown or other
  modified_base (552)..(552): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagagccggcctccatctcctgcaggtctagtcagagcctccagcatactgatggatacaactattggattggtacctgcagaagccagggcagtctccacaactcctgattctagtttcgggttactaacgtccggggccttcccccgggggtccctggacgtggttcaaggtcggcaggtggatcgaggcaatagtatttacactagaatcagacagagtggagcgtggagggtacggtttggggggtttattacgtgactagtgacgtaacggtacctaaccaaaccccgtntccgaccgttcggccgagggaccacgccgtggagacgttaacgaactgtcgctcgctaaccgngttc

SEQ ID NO: 422193 - DNA, 641 bp, Homo sapiens
  misc_feature: GZ8MTXP01DPBRV.15.25.C03.1.454.CMB.2.raw
  modified_base (378)..(378): a, c, t, g, unknown or other
  modified_base (443)..(443): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtagggatattgtgatgactcagtctccactcctccctgcccgtcacccctggagagccggcctccatctcctgcaggtctagtcagacgcctccagcatactgatggaatacaacttagttggattcggtacctgacaggaacgccagggcagtctaccacaactcctgattcttagtttcgggtactaacgtccggggccgtccggggtcccctggactggttcaggtcggcgnggtggactcgaggtctaattagtaactttaacactaaggaaatcgagagaggtaagtgggaaggngtagggaagggttacgggtttaggggttttaattacgtggtacagttacgaacgtaaacggtacctaaaacccgtaaaccccgtacttacccgtacccggttaccgggaaccggaacggacggaccgaccgtaggtaacgttaaacgttaaaacggttaacgtgggtacgaacgtcgaccttaactcgttccgttccg

SEQ ID NO: 422194 - DNA, 571 bp, Homo sapiens
  misc_feature: GZ8MTXP01CUOIJ.15.25.C03.1.454.CMB.2.raw
  modified_base (269)..(269): a, c, t, g, unknown or other
  modified_base (290)..(290): a, c, t, g, unknown or other
  modified_base (325)..(325): a, c, t, g, unknown or other
  modified_base (329)..(329): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggacgagcccggcctccatctcccgcaggtctagtcagagcctccagcatactgatgatacaatattgattggacngacagagcaggcagtctccanactctgatctatttggtctagcggcctcgggtccngacnggtcagtgacagtggactcgaaagcaatagtatttacatagaaatcagcagaggtggaggctaggaaggttacggtttagggggtttaacttacggtagacgtaagtggaacgtaaacggtaccctaaaccgaaaacccccgtataccgaacccgttccgggaccgaacggggacttaccggccgagggtaaagtacgttaaaacgcttaggtcgacgtcgaccctacacttcttcgtttcc

SEQ ID NO: 422195 - DNA, 584 bp, Homo sapiens
  misc_feature: GZ8MTXP01EL3DR.15.25.C03.1.454.CMB.2.raw
  modified_base (361)..(361): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctccagcatactgatggatacaactattggattggtacctgcaaggaagccgagggcagtctccacaactctgtatcttagtttggtctaagtcggcctccgggtcccctgactaggttcaggtcgacngtggatcgaggctaagtagttatttacactagaaatcgagcaggtagtggagtgtaggaggtacggtttggggtttattacgtggtactagtgaacgtaacggttacctaaaccgaaacccgtatacccgtacccgttccgggaaccgaagggccctacggttaccgtaggaacgttaaagttaaacgaacgttggtcgcgtcgccttactaacgttcttccg

SEQ ID NO: 422196 - DNA, 699 bp, Homo sapiens
  misc_feature: GZ8MTXP01DYR1P.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatcagtgggatatgtgatgactcagtatccactctccctgcccgtcacccgtggagacgccgcctcatctcctgcaggtctagtcagacgccctcagcatactgatggatactaactagttggattcggtacctgacaaggaacgccgagggcacgtcctaccaactaactcctagactttacgtagttttcggtacctaacggtcccgggtccccgttccccgggggtccctaggtaccgtacggtttaccgaagggttcggcgtaggttagggacttacgaagggtctaaagttacgttatttaacaactagtaaactcgagacgaggtaggtcgggaggtacgtagggtaaggggttacgggtttaggggggttttaacttacggtcgacgtagtacggtacgtaaacgggttaaccctaaacccgtaaaccccgtactacccgtaaccgggttaaccgggaccggaacgggtaccgaccggtacccggtaagggaaacgttaaacgttaaaaccggtcgttagggtcgggttctacggaccctaacgttaacttccg

SEQ ID NO: 422197 - DNA, 686 bp, Homo sapiens
  misc_feature: GZ8MTXP01ACTBV.15.25.C03.1.454.CMB.2.raw
  modified_base (353)..(353): a, c, t, g, unknown or other
tcagtctacgtagccacgaccggtgctcgatttagtagtgtagatttgggtttgggtgatcaggactcctcagttcaccttctcacaatgaggctccctgctcagctcctggggctgctaatgctctgggtctctggatccagtggggatattgtgatgactcagtatccactctccctgcccgtcacccctggagacgccggcctccatctcctgcaggtctagtcagagcctcagcatactgatggatacaactatttggattggacctgacagaagccagggcagtctaccacaactcctgtattcttagtttgggttctaacgtccgggtcccgtccccgggggtcccnggacctagggttcaaggttgggctaggtgggactacgagggtctaagttaacgtatttttaacaacgtagtaaacttccgaaggaccgtaaggaggttagggaggtacgtagggtaacggggttacgggttttaggggggggtttaacttacggtagtaccgtagttcggaaccgtaacggttaccctaaacccgtaaaccccggtacttaaccccgtacccggttaaccgggacccggttaacggggacccaaccggtacccgtaagggttaaacgttaacgttaaacggaaccgtggttaacggcgtacggacctaaccgttaacgttccg

SEQ ID NO: 422198 - DNA, 608 bp, Homo sapiens
  misc_feature: GZ8MTXP01ECUN7.15.25.C03.1.454.CMB.2.raw
  modified_base (290)..(290): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtcnccacactctgatcttagtttgggtactagcggcctccggggtccccctgacaggttcagtggcaaggtggatcaggcatagtatttacatagaaatcagcaggagtggaggctaggaggtacggtttggggttaattacgtggtactaagtgacgaaggttacctaaaccgaaaccccgtagttaccgtacccgtttcggggaacccggaaggggacccaaccgggttacccgtaaggggtaagttaaaccgtttaaaaacggaaccggttgggtacgggtcgttacgggacccgttaaccttaacggttcctttcgg

SEQ ID NO: 422199 - DNA, 646 bp, Homo sapiens
  misc_feature: GZ8MTXP01D17S5.15.25.C03.1.454.CMB.2.raw
  modified_base (244)..(244): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagagccggcctccatctcctgcaggtctagtcagagcctccagcatacngatggatacaatattggattggacctgcagaagccaggcagtctccaacaactctgattctagtttggttactaagtcgggcctccccggggtccctgacgtaggttcaaggtgcagtgggatcgaggtcaagttagtattttaacgacttagaaactcgaagacgaaggagtagggaggtcgtagggaagggttacgggttttaggggggtttaattacgtggtactagtacgacgtaaagggtaccctaaaccgtaaaaccccgtattacccgtaaccccggttccgggacccggaaacgggggaccttaaaccgggacccgttaaggggaaacgttaaacgtttaaaacggaacgttcgggtaacgggtccgtacggaccctaacccgttaagttcccg

SEQ ID NO: 422200 - DNA, 730 bp, Homo sapiens
  misc_feature: GZ8MTXP01CTBG8.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagacgccggcctccatctcctgcaggtctagtcagagcctccagcatactgatggataactaacttagttggattcggtacctgacgaagaacgccgagggcagtcctaccacaacctcctagacttcgtttagtttcgggttactacgtccggggtccgttcccgggggtccccctaggacgtaggtttcgagggttcgggccgtaaggtgggactacgagggtactaagttacgttaaacttttaaccaagttaacgaaaagtccaaggacgaaggaaggttgggaggtcgtaggtaggggttacgggttttagggggtttaacttacgtaggtacgtacgtacggtaccgtaaacggtacccgttaaaccccaaaaccccggtaccgtacccgtaccccggttacccgggaacccgggtaacggggaacccgtaccggttaccggtacgggtaacgttaaacggttaaaacccggaacggtttcgggacggtaaccgtacggaccgttaacccttcggttaaccctttccgg

SEQ ID NO: 422201 - DNA, 586 bp, Homo sapiens
  misc_feature: GZ8MTXP01AC00S.15.25.C03.1.454.CMB.2.raw
  modified_base (244)..(244): a, c, t, g, unknown or other
  modified_base (258)..(258): a, c, t, g, unknown or other
  modified_base (287)..(287): a, c, t, g, unknown or other
  modified_base (360)..(360): a, c, t, g, unknown or other
  modified_base (409)..(409): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagacgcctcagcatacngatggatacacttntggattggtactgcagagccaggcagtcncacactctgactcttagtttcggtctaagtcgggccttccggggtcccctggactaggttcagtcgctaaggngatcgaggctaagtacgtatttacatagaaatcagcaggagtggacggntaggaggtaggtttagggttattacgtggctagtcgacgtacggtacctaacccgaaacccgtcgtaccgtaccggttccgggaaccggaacgggaccgacggaccgtaagggtaacgttaacgttaaacccggttaagttcggcggtccttacggaccttaactcgttcgtttccg

SEQ ID NO: 422202 - DNA, 546 bp, Homo sapiens
  misc_feature: GZ8MTXP01DQL5V.15.25.C03.1.454.CMB.2.raw
  modified_base (258)..(258): a, c, t, g, unknown or other
  modified_base (404)..(404): a, c, t, g, unknown or other
  modified_base (433)..(433): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtgggatattgtgatgactcagtatccactctccctgcccgtcacccctggagacgccggcctccatctcctgcaggtctagtcagacgcctcagcatactgatggatacaactnttgattggacctgcagagccgaggcagtctccaacaactctgattcttagtttggtctaagtccgggcctcccggggtccctagacgtggttcaagtggcaggtgatcgaggcatagtatttacatagaatcagcagagtggacgngtaggtagttagggtttaggggttatagngagagtgacgtaacgtaccaacctaacctactaccgtacgtcggacggacggacacggacgtaaggaacgttaaacgttaacggtaatggtcgctcgacctaacgttcgttcg

SEQ ID NO: 422203 - DNA, 663 bp, Homo sapiens
  misc_feature: GZ8MTXP01CZ7KR.15.25.C03.1.454.CMB.2.raw
  modified_base (240)..(240): a, c, t, g, unknown or other
  modified_base (381)..(381): a, c, t, g, unknown or other
tcagtctacgtagccacgaccggtgctcgatttagtagtgtagatttgggttgggggatcaggactcctcagttcaccttctcacaatgaggctccctgctcagctcctggggctgctaatgctctgggtctctggatccagtggggatattgtgatgactcagtctccactcctccctcgcccgtcacccctggagacgccggcctccatctcctgcaggtctagtcagacgcctccancatactagatggaatactaattagttggattggtactgacaagaacgcgaggcacgtcaccacaactctagtatctttagtttggttactaacggtccgggccgttccggggtcccctaggacgtaggttcaggtcggacnggtggatacgacgggactaagttacgtaacttttaacaacgtaaagaaactcgaagacgaaggtaggtaggacggtcgtaggtagggttacggtttagggtttagttacgtggtactagtacggaaccgtaacggtacctaaacccgaaaccccgtacgttaccccgaaccggttccggggaaccggtaaccgggaaccgtacggacccggtaggtaaacgttaaacggttaaaacgacgttaacgggtacgcctacggaccttaccgtaacttccgtttcg

SEQ ID NO: 422204 - DNA, 628 bp, Homo sapiens
  misc_feature: GZ8MTXP01DUH20.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagagcctccagcatactgatggatacaacttagttggattcggtacctgacagaagccgaggcagtcctaccacaactctgtatcgttagtttgggtctaacgtccggggccttccggggtcccctgacgtaggttcaggtcgggcaaggtcgatacgaggctaattagtaactttacgaattagaaaactcgaagagtaaggaggtagggacggtacgtagggtaggtagggtttggggtttaattcgtggacctagttcgacgtaacgggtaccctaaaccgtaaaccccgtattacccgtacccggttcccgggaacccgggtaagggacccgtaccggttaccgtaagggtaacgttaacgttaaacggacgtggtacgctacgcaactcttcgttc

SEQ ID NO: 422205 - DNA, 743 bp, Homo sapiens
  misc_feature: GZ8MTXP01AGJOT.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagacgccggcctccatcctcctgcaggtctagtcagacgcctcagcatactgatggatactaactgttggattggtacctgacagaacgccgaggcagtcctaccaactactctagtactttcgttagttttcgggttactaacggtcccggggtcccgttcccccggggtccctaggaccgtagggtttcaagggttcggcgtagggtcggactaccggagggtactaaagtttaacgttactttttaaccgaagttaacgtaaacgttccgaaggtaccggtaaagggtacgggttaggggaacgggtccgtttaagggggtaaaggggtttacggggttttaggggggggtttttaacttacggttcgaccgttagtacggtaaccgtaaaccgggttacccttaaacccgaaaccccgtacgttacccgtaccggttccgggaccgggttaacgggaccaccggtaccggtagggttaaacgttaaacgtttaaaccggaagttcggtaacgggtcacggttacctaaccgttaacgtttcccg

SEQ ID NO: 422206 - DNA, 621 bp, Homo sapiens
  misc_feature: GZ8MTXP01ERQ4X.15.25.C03.1.454.CMB.2.raw
  modified_base (246)..(246): a, c, t, g, unknown or other
  modified_base (368)..(368): a, c, t, g, unknown or other
  modified_base (409)..(409): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagacgccggcctccatctcctgcaggtctagtcagacgcctccagcatacngatggatacaactagttggattggtacctgcagaagccagggcagtcctccacactcctgtatctagtttgggtctaacgtccggggcctccggggtccccctggacgaggttcaggtgcgnggtgatcgaggctagtagtatttaacactagaaatcaaganaaggaggtggaaggcgtaggtagggtacggtttaggggtttaattacgttaggtctaagtggtacgtaaacgggttacctaaacccgtaaaccccggtacttacccgtacccgttccggggaaccggaacgggaccgaccggttacccgtagggtaacgttaaagttaaacccgaagttggtcggaactggaccttaccgtaattccgttcg

SEQ ID NO: 422207 - DNA, 607 bp, Homo sapiens
  misc_feature: GZ8MTXP01BKWCF.15.25.C03.1.454.CMB.2.raw
tcagtctacgtagccacgaccggtgctcgatttagtagtgtagatttgggtttgggggatcaggactcctcagttcaccttctcacaatgaggctccctactcagctcctggggctgctaatgctctgggtctctggatccagtggggatattgtgatgactcagtctccactctccctgccccgtcacccctggagacgccggcctccatctcctgcaggtctagtcagagcctccagcatactgatggatacaactattggattggtacctgcagaagccagggcagtctccacaactcctgatctatttggttctaagtcgggcctccggggtcctgacaggttcagtgcagtgatcgaggcatagatttacactagaaatcagcagagtggaggtcgtggtagggtacggttggggtttattacggtgacgtagtcggtacgtaacgggtacctaaccgaaaaccccgatacccgtacccggttccgggacccgggaacggggaaccgaccgggtcccgttagggtaaacggtaacgttaaaaccggaacgttcggttcggggcttaacggccgtaaccgttacttccgttaacggtttcccc

SEQ ID NO: 422208 - DNA, 641 bp, Homo sapiens
  misc_feature: GZ8MTXP01DXAK4.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagacgccggcctccatctcctgcaggtctagtcagacgccctcagcatactgatggaataacaacttattggattcggtacctgacgaaggaacgccgagggcacgtcctaccaacaacctctagtacttcgtttagtttcggttactaacggtccgggtccgtccggggtcccctaggacgtaggtcaggtgctggtcgatcgagactagtagtactttacactaagaaatcagacgagaggtaggagcgtagggtaagggttacggttttaggggtttaacttacgtagtctaagtacgtaacgtaacggtacctaaacccgaaacccgtactacccgtaccggttccgggaaccggacgggaccacggccgtaaagggtaaacgttaaacgtttaaaccggaagtttgggacgtaacgtcgacccttactcgttaacgtttcg

SEQ ID NO: 422209 - DNA, 652 bp, Homo sapiens
  misc_feature: GZ8MTXP01D7L18.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctcgcccgtcacccctggagagccggcctccatctcctgcaggtctagtcagacgcctccagcatactgatggatactaacttagttggattcggtacctgcaagacgccgagggcagtcctaccactaactcctagtacttctttaagtttcgggttactaacggtcccggggtcccgttcccgggggttccccctaggacgtagggtttccaggtcggcaagggtggactccgaggtctaagttagtaacttttacattagaaaatcgagcgaaggaggtgggacggtagttaggagggtttacgggtttaggggtttacttaacgtgtactagtgaacgtaaacggttacctaaaacccgaaacccgtattacccgaccggttcgggaacccggtaagggaccgacggccgtaagggaacgttaacgttaaacgttacgtggtaggcttcgaccttacctaattcgttccg

SEQ ID NO: 422210 - DNA, 603 bp, Homo sapiens
  misc_feature: GZ8MTXP01A83MS.15.25.C03.1.454.CMB.2.raw
  modified_base (347)..(347): a, c, t, g, unknown or other
  modified_base (359)..(359): a, c, t, g, unknown or other
tcagtctacgtagccacgaccggtgctcgatttagtagtgtagatttgggtttggggtgatcaggactcctcagttcaccttctcacaacgaggctccctgctcagctcctggggctgctaatgctctgggtctctggatccagtggggatattgtgatgactcagtatccactctccctgcccgtcacccctggagagccggcctccatctcctgcaggtctagtcagagcctccagcatactgatggatacaactattggattggtacctgcagagccagggcagtctccacaactcctgatcttagtttgggtctaacgtcgggcctccggggtcccctggacnggttcagtggcngtggatcgagcatagtatttacatagaatcgagacgagaggtagggaggcgtggtagggtacgggtttaggggtttattacgtgtcgtagtcgacgtaacggtactaacccgaaaccccgtacgtaccgtacccggttccgggaacccggtaacggggaccgaccggccggtagggtaacggttaaacgttaaaccggaagttcgggttacggcgttacggcccttaacctaacgttcgtttcg

SEQ ID NO: 422211 - DNA, 655 bp, Homo sapiens
  misc_feature: GZ8MTXP01DYBPK.15.25.C03.1.454.CMB.2.raw
  modified_base (378)..(378): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtggggatattgtgatgactcagtctccactctccctgcccgtcaccctggagagccgcctcatctcctgcaggtctagtcagacgcctcagcatactgatggataacaacttagttggattggtacctgacaagaagccgagggcagtcctaccaacaactcctagattcttagttttgggtactaacgtccggggccgtccggggtcccctaggacgtaggttcaggtgacgnggtgggatcgaggactaattagttaacttttaacaacttaaaggaaaactcgaagacgaaggagggttagggaacgggtcgtagggtaaggggttagggtttaggggtttaattaacgtgtacgtagtacgacgtaaacggtacctaaacccgaaacccgtactacccgtaaccggtcgggaacccggaacgggaccgaccggaccgtagggtaaacgttaaacgttaaaaccgaacgttggtacggtaacgtacgtaccaccgtaacttcgttccg

SEQ ID NO: 422212 - DNA, 620 bp, Homo sapiens
  misc_feature: GZ8MTXP01DAUYE.15.25.C03.1.454.CMB.2.raw
  modified_base (305)..(305): a, c, t, g, unknown or other
  modified_base (373)..(373): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagcccggcctccatctcctgcaggtctagtcagacgcctccagcatactgatgatacaactattggattggtacctgcagaagccgagggcagtcctctaacaactccngattcttaagtttgggttactaacgtccgggccgttcccggggtcccctggacgtggttcaggtggcngtgatcgagcatagtatttacactagaaatcgagtacgagaggtggagcgtaggtagggtacggtttaggggtttacttaacgtgactagtcgtacgtaacggtacctaaaccccgaaacccgtactacccgtaccgttccgggaaccggtacgggaccgtaccggccgtaaggaacgttaaaacgttaaacggttaaccgttgggtacggtcgttacggaccgttacctaacgttccgtttaaccg

SEQ ID NO: 422213 - DNA, 533 bp, Homo sapiens
  misc_feature: GZ8MTXP01DTMIU.15.25.C03.1.454.CMB.2.raw
  modified_base (338)..(338): a, c, t, g, unknown or other
  modified_base (342)..(342): a, c, t, g, unknown or other
  modified_base (352)..(352): a, c, t, g, unknown or other
  modified_base (450)..(450): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctccagcatactgatggatacaactatgattggtacctgcagaagccagggcagtctccacaactcctgatcttatttgggtctaagtcggcctcggggtcccccngacnggtcagtgcngtgatcgagcatagtatttacactagaaatcagtcagagtggaggctaggaggtacgttggggtttattacgtgcatgacaggtctaacgaacccgtntccgaccttcggccgtaacggctacgcgtaggaattaagttaaacgacgtggtagtctcggacttaccgtaagttcgttaacg

SEQ ID NO: 422214 - DNA, 658 bp, Homo sapiens
  misc_feature: GZ8MTXP01A128N.15.25.C03.1.454.CMB.2.raw
  modified_base (293)..(293): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcaccctggagacgccggcctccatctcctgcaggtctagtcagacgcctcagcatactgatggatacaactatggattggactgcagagcaggcagtctcacaactcngatcttagtttcgggtactacgtccgggtccgtaccggggtcccctggacgtaggttccgaggttcggctaaggtcgggatccgagggactagtacgttactttaacatagtaaaactcagacgaaggtaggtacgggacggtacgttaggtaacgggtttacgggttttagggtttaactacggtgtcgtacgtacgtaacgtaacggttaccctaaacccgtaaccccgtacgtacccgtaacccggttaccgggaacccgggtaacgggacccgtaccggttaccggtaaaggtaaacgttaaacgttaaaccgttacggtcggtacggtaacctcgacccttactaaccgttcgttaaccg

SEQ ID NO: 422215 - DNA, 560 bp, Homo sapiens
  misc_feature: GZ8MTXP01AJNJZ.15.25.C03.1.454.CMB.2.raw
  modified_base (388)..(388): a, c, t, g, unknown or other
  modified_base (400)..(400): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctccagcatactgatggatacactatgattggtacctgcagagccaggcagtctcacactctgatctatttgggtctaagtcggccgtccggggtcccctgacgtaggttcagtggcaagtggatcgaggcatagtatttacactagaaatcgagngaggagtggagngtaggaggttagggtttaggttacgttagtgatagtacgtacgtacggtacctaaaccgaacccgtactaccgtaccgtccggaacggacggaccgaccgaccgtaggaacgttaacgttaacgttacgtggtcgtcgtcgaccacctaagttcgttccg

SEQ ID NO: 422216 - DNA, 627 bp, Homo sapiens
  misc_feature: GZ8MTXP01C5EMI.15.25.C03.1.454.CMB.2.raw
  modified_base (618)..(618): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctcgcccgtcacccctggagacgccggcctccatctcctgcaggtctagtcagacgcctccagcatactgatggatacaattagtgattcggtactgacaagaacgcgaggcacgtcctaccacaacctcctgtattcgtttagtttcggggttacttaacggtccggggccgttcccgggggtccccctaggacgtgggttcaggtcgggcaaggtgatcgagctaatagtatttacataagaaatcaagagaggtaggtggaggcgtagggtagggttacgggtttaggggtttaattacgtggactagtcggaacgtaaacggtacctaaaccgaaacccgtactaccgtaacccggttccgggaaccgggaacggaccgaccggaccgtaggaacgttaaacgttaacgaacgttggtacgctacgacttaccgtnttccgttcg

SEQ ID NO: 422217 - DNA, 615 bp, Homo sapiens
  misc_feature: GZ8MTXP01CDX89.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagagccggcctccatctcctgcaggtctagtcagagcctccagcatactgatggatacaactatttggattggtacctgcagagcagggcagtctcacactctgatctagtttggttctaagtcggcctccccggggtccctgacgtggttcaaggtgcagtgatcaggcatagtatttacactagaaatcagacaggaggtggaggcgtaggtagggtacggtttaggggggtttattacgtgtactagtcggaccgtaaacggttacctaaacccgaaaccccggtactacccgtaacccggttccggggacccggttaacggggacccgaaccggtcccgtagggttaacggttaaacgttaaaccggtaaaccgttgggtcggtacgttaccggacctaaccgttaacgtttcccg

SEQ ID NO: 422218 - DNA, 646 bp, Homo sapiens
  misc_feature: GZ8MTXP01DJGV7.15.25.C03.1.454.CMB.2.raw
  modified_base (291)..(291): a, c, t, g, unknown or other
  modified_base (360)..(360): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagagcccggcctccatctcctgcaggtctagtcagacgcctccagcatactgatggatacaattattggattggtacctgcagaagcaggcagtcnccacactctgatcttagtttcggtctaacgtccgggccgtccggggtcccctgactggttcagtcggcnggtgactcgaggactagtagtactttacactaagtaaaatcgaagcgaaggtagggtgggacgggacgtagggtaagggttacgggttttagggggttttaactttacgtggtactagtacggaacgtaaacggttacctaaacccgaaaccccgtattacccgtaccggttccgggaacccggaacgggaaccgaccggttcccgttaaaggggtaacgttaaaacgtttaaaacggttaacgttggtacgggtccttacggaccttaccgtaacttcgtttccg

SEQ ID NO: 422219 - DNA, 640 bp, Homo sapiens
  misc_feature: GZ8MTXP01AWQMN.15.25.C03.1.454.CMB.2.raw
  modified_base (372)..(372): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagcccggcctccatctcctgcaggtctagtcagagcctccagcatactgatggatacaacttattggattggtacctgacagaacgccgtagggcagtcctaccacaactcctgtatcttagtttgggtctaagtccggggtccgtccggggtcccctggactaggtcaggtggcngtggatcaggcatagtatttacatagaaatcgagcgaaggagtggaggtcgtagggagggttagggtttagggggtttacttaacgtgtacgtagttacggacgtaaacggtacctaaacccgaaacccccgtagtaccccgtaaccggtttccggggaacccgggtaacggggaacccgaccgggttacccgtaaggggtaaacgttaaacgtttaaaaccgaacgttgggtacggtaactcggacttaaccctcgttaaccgttcg

SEQ ID NO: 422220 - DNA, 553 bp, Homo sapiens
  misc_feature: GZ8MTXP01EBJSE.15.25.C03.1.454.CMB.2.raw
  modified_base (338)..(338): a, c, t, g, unknown or other
  modified_base (354)..(354): a, c, t, g, unknown or other
  modified_base (386)..(386): a, c, t, g, unknown or other
  modified_base (390)..(390): a, c, t, g, unknown or other
  modified_base (402)..(402): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctccagcatactgatggatacaactatggattggtacctgcagagccagggcagtctccacaactctgatcttatttgggtctaagtcgggcctccggggtccccngactaggttcagtgcnggtgatcgagcatagtatttacatagaaactnaganagagtaggaggngtagaggtaggttagggtttaggttagtgtgtagtagacgacgtacgtaaccaacccgtactacgtaccgtccggaaccggacggacgacgacgtacggtaagttaacgttaaacgttaacgtaagtggcgtcgacactaacgttcgttcg

SEQ ID NO: 422221 - DNA, 613 bp, Homo sapiens
  misc_feature: GZ8MTXP01CM5FE.15.25.C03.1.454.CMB.2.raw
  modified_base (362)..(362): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatggattggtacctgcagaagccagggcagtcctaccacaacctcctgatcttatttgggttactaagtcgggcctccggggtccccctgactggttcaggtggcnggtggatcgaggcattagtattttacactagaaatcagcgaggagtggaggcgtaggagggtacggtttaggggtttattaacgtggacagtgacgaacggttacctaaacccgaaaccccgtattacccgtaacccgttccggggaacccgggtaaggggacccgtaaccgggcccgtaaggggtaacgttaaacgtttaaaaccgacgttgggtacgggtcctaggacccaaccctaattccgttaacg

SEQ ID NO: 422222 - DNA, 559 bp, Homo sapiens
  misc_feature: GZ8MTXP01BFPYN.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccgcctccatctcctgcaggtctagtcagagcctccagcatactgatggatacaactatggattggtacctgcagaagccaggcagtctccacactcctgatctagtttgggtctaagtcgggccgtccggggtccccctgacaggttcaggtggcaagtggatcgaggctatagtatttacactagaaatcagcagagtggagcgtaggagggtacgtttggggttacttagtgcagtgcgaacggtacctaaccgaaacccgtataccgtaacccgttccgggaaccggaacgggaccacgccgtaggaagttaacgttaaacgaacgtggtcggaactcgaccacctaagttcgttcg

SEQ ID NO: 422223 - DNA, 666 bp, Homo sapiens
  misc_feature: GZ8MTXP01BC1Z5.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagacgcccggcctccatcctcctgcaggtctagtcagacgcctccagcatactgatggatacaattgttggattcggtactgcagacgccgaggcacgtcctaccactaacctcctagtacttctttagttttcgggtactaacgtccggggtcccgtccggggtccccctaggtacgtagggtttcaggtcggcgtaaggtgggactacgaggtactaagttacgttaacttttaacacgttaagaaaactcgaagagaaggtaggtagggaggtacgtagggtaacggggttacgggttttagggggtttaattacgtggtacgtagtacgtacgtaacggttacctaaacccgtaaacccgtactacccgtaccggttccgggaaccggaacgggaccgaccggttaccgtacggtaacgttaacgttaaacgacgtggtcgcgtcgccttacctaacttcgttaacg

SEQ ID NO: 422224 - DNA, 605 bp, Homo sapiens
  misc_feature: GZ8MTXP01DWTDF.15.25.C03.1.454.CMB.2.raw
  modified_base (345)..(345): a, c, t, g, unknown or other
  modified_base (360)..(360): a, c, t, g, unknown or other
  modified_base (364)..(364): a, c, t, g, unknown or other
tcagtctacgtagccacgaccggtgctcgatttagtagtgtagatttgggtttgggggatcaggactccctcagttcaccttctcacaatgaggctccctgctcagctcctggggctgctaatgctctgggtctctggatccagtggggatattgtgatgactcagtctccactcctccctgcccgtcacccctggagagcccggcctccatctcctgcaggtctagtcagagcctcagcatactgatggatacaatagttggattggtactgcagaagccagggcagtcctacacaactctgtatcttagtttgggttactacgtcgggccgtccggggtcccngacaggttcagtgcngtgntacgagctagtagtatttacactagtaaaatcagtacgaaggtagtagggaggagtagggaagggttaacggtttggggtttaattacgtgtactagtcgacgtaaggtacctaaacccgtaaacccgtctacccgtaccgttcgggaacccgggacgggaccgtaccgttccgtaagggtacgttaaacgtttaaacggaacttgggtacggtctacgaccttactaacttcgttaaccg

SEQ ID NO: 422225 - DNA, 567 bp, Homo sapiens
  misc_feature: GZ8MTXP01BL0NE.15.25.C03.1.454.CMB.2.raw
  modified_base (254)..(254): a, c, t, g, unknown or other
  modified_base (261)..(261): a, c, t, g, unknown or other
  modified_base (277)..(277): a, c, t, g, unknown or other
  modified_base (328)..(328): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcaccctggagagccggcctccatcctcctgcaggtctagtcagagcctccagcatactgatgatacatntgatgcngcagagcaggcagtcncacactctgatcttagtttggtactaagtcggcctccggggtcccctgacnggtcagtgcaaggtgatcgaggctagtagtatttacactagaaatcgagacgagaggtggaacgcgtagggtaacggttagggtttaggggtttaattacgtgtacgtagtcgaacgtaacggtacctaaacccgaaacccgtgtaccgtaccgttccgggaaccggaacgggacaccggccgtaaggtaagttaaacgttaaccggaacgttggagtctcgacacgtaacttcgttcg

SEQ ID NO: 422226 - DNA, 646 bp, Homo sapiens
  misc_feature: GZ8MTXP01CNFA7.15.25.C03.1.454.CMB.2.raw
  modified_base (296)..(296): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcaccccgtggagacgccggcctccatcctcctgcaggtctagtcagacgcctccagcatactgatggatacaactattggattggtacctgcagaagccgagggcagtcnccacaactcctgattctagtttggtactaagtccgggtcctcccccgggggtcctagacgtaggttccgaaggttgggctaggtggactcgaggactatacgttatttacactagaatcagacagagtggagcgtaggaggtacggtttggggggtttattacgtgacagttcggacgtaacgggtacctaacccgtaaaccccgtacgttacccgtaacccggttaaccggggacccggaaacggggtacccaaccgggtacccggttagggttaaacggttaacttaaaaccgggtaaccgttgggtaacgggtaccgttacggaccgtaacccttaacgtttcccgg

SEQ ID NO: 422227 - DNA, 631 bp, Homo sapiens
  misc_feature: GZ8MTXP01AOP18.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagagccggcctccatctcctgcaggtctagtcagagcctccagcatactgatggatacaactattggattggtacctgcagaagccagggcagtctccacaactcctgatctagtttgggttactaagtccgggcctccccggggtcctgacaggtcaagtgcagtgatcgaggcatacgtatttacactagaaatcagtcgagaggtggagcgtaggaggtacggtttggggggtttattacgtgacgtaagtgtacgaaacgggtacctaaacccgtaaaccccgtacgttacccgtaaaccggttcccggggaccccgggaaagggggtaacccgaccgggtaacccggttagggaaacggttaaacgtttaaaacccggaaaccgttgggtaaccgggtccgttacgggaccctaacccgttaagtttcccg

SEQ ID NO: 422228 - DNA, 656 bp, Homo sapiens
  misc_feature: GZ8MTXP01COW5C.15.25.C03.1.454.CMB.2.raw
  modified_base (418)..(418): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagacgccggcctccatctcctgcaggtctagtcagagccctcagcatactgatggaatacaattagtggattcggtacctgacagagccgaggcagtcctaccactaactcctgattcgttagtttgggttactaacgtccggggcccgtccggggtccccctggacgtggttcaggttgggctaaggtggaactcgaggactagtagtacttttacactaanaaatcgaagcgaaggtaggtcgggaggtcgtaggtaagggttacgggtttaggggtttaacttacggtgtactaagtacgtacgtaaacggttacctaaacccgaaacccgtagtacccgtaccggttccggggaaccggtaacgggaccgtaccggttaccgtaacgggtaacgttaaacgttaaaacggaccgttgggtacggtcctacggtaccttaccgtaacgttccgtttcg

SEQ ID NO: 422229 - DNA, 655 bp, Homo sapiens
  misc_feature: GZ8MTXP01BBGZL.15.25.C03.1.454.CMB.2.raw
  modified_base (436)..(436): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctccagcatactgatggatacaactattggattggtacctgcagaacgccagggcagtcctccacaactctgattcttagtttggtactaacgtcgggccgtccggggtccccctaggacgtaggtcaggtcggcaaggtggactcgaggtctaagtagttaactttacaactaagaaaatcgaagcgaaggtaggtgggaggngtagggtaacgggttacgggtttaggggtttaattacgttagtacgtagtgaacgtaaacggttacctaaacccgaaaccccgtacgtacccgtaacccggttccgggaacccggtaacgggacccgtaccggaccgtaagggtaaacgttaaacgttaaaaccggaacggtttaacggcgggtccttacggacccttaaccgtaacgttccgtttccg

SEQ ID NO: 422230 - DNA, 631 bp, Homo sapiens
  misc_feature: GZ8MTXP01B9B6H.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcaccctggagacgccgcctccatctcctgcgtagtctagtcagacgcctccagcatactgatggatactaatagttggattcggtacctgacagacgcgaggcacgtcctccaacactcctagattcgttagtttggttactaacggtccggtccgttccccggggtcctggtacgtacggttcaagggtcgcgtagtcgggatcgaggctaagttagtactttaacacgtagaaactcgaagacgaagggtaggtcgggaaggtcgtagggtagggttacgggttttaggggggtttacttacgtgactagtcgacgtaacggtaccctaaaccgtaaaccccgtgtcccgtaccgtcgggaccggacgggtaccacggtacgtaggaacgttaacgttaaaccggaacgtggttaacgcgtacgacctaacgttaagtttccg

SEQ ID NO: 422231 - DNA, 623 bp, Homo sapiens
  misc_feature: GZ8MTXP01B0B4P.15.25.C03.1.454.CMB.2.raw
  modified_base (436)..(436): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtgggatattgtgatgactcagtctccactcctccctcgccccgtccaccccgtggagacgcccggcctccatcctcctgcaggtctagtcagacgcctcagcatactgatggactacaacttattggattcggtacctgacaagaacgccgaggcacgtcctaccactaactcctagtacttcgttagtttcgggtactaacggtccgggtcccgtccgggtcccctggactaggtcaggtgctggtgactcgagctagttagtatttacactaagaaatcgaagcgaaggnggtaggacggtcgtagggtaacgggttagggtttagggtttaacttacgtggacctaggtacgaaccgtaacggtacctaaacccgtaaacccgtctaccgtaccggtcggaaccggtaacggacgaccgttcgtaaggaacgttaaacgttaacgacgtggtacgctacgcttactaacgttcgtg

SEQ ID NO: 422232 - DNA, 685 bp, Homo sapiens
  misc_feature: GZ8MTXP01AR03L.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctccagcatattgatggaatacaacttagttggattcggtacctgacaagaacgccgagggcacgtcctaccaacaacttcctagtacttcttagttttcgggttactaacgtccggggccgttccgggggtcccctaggacgtaggtttcaggtcggcaaggtggaatcgaggctaattagtatttaacactaagaaaactcaagagaaggtaggtgggaggcgtagggagggttacggtttaggggttaattacgtgacctagtacgacgtaaacggttacctaaacccgtaaaccccgtacgttacccgtaaccggttaccggggaacccggaaacggggaaccgtaccggaccgggttaaaggtaaacggttaaaacgtttaaaaccggaaccggttaaggggttaccgggaacttacgggacccttaaaccgtaactttcggtttccg

SEQ ID NO: 422233 - DNA, 637 bp, Homo sapiens
  misc_feature: GZ8MTXP01EVGFE.15.25.C03.1.454.CMB.2.raw
  modified_base (367)..(367): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccgcctccatctcctgcaggtctagtcagagcctccagcatactgatggatacaacttattggattggtacctgcaagaagccgagggcagtcctccacaactcctgtatcttagtttgggtactaagtccggggccgtccggggtccccctgactaggttcagtggcngtggatcgaggctaagtagttatttacactagaaaactcgagacaaggagtgggaaggcgtagggaagggttacgggtttgggggtttaattaacgttggctaagtcgtaacgtaaaggttacctaaacccaaacccggtatacccgtaaccgttcccggggaaccggtaacggggaaccgaccggttaccggtaaggggtaacttaaaacgttaaaaccggaaccgttgggtaacggtccgttacggaccaccgtaacttcggtttccg

SEQ ID NO: 422234 - DNA, 594 bp, Homo sapiens
  misc_feature: GZ8MTXP01DMQ3H.15.25.C03.1.454.CMB.2.raw
  modified_base (341)..(341): a, c, t, g, unknown or other
  modified_base (351)..(351): a, c, t, g, unknown or other
  modified_base (399)..(399): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctccagcatactgatgatacatatgatggtactgcagagcagggcagtctaccacaactcctgattcttaagtttgggttactaagtcggcctccggggtcccctgacngttcagtgcngtggatcaggcagtatatttacactagaaatcagcaggagtggacggntggaaggtacggtttaggggtttattacgttggactagtgacgtaacggtacctaaaccgtaaaccccgtagtaccgtaaccgttccgggaaccggacgggaccgtaccggttccgttaagggaacgttaaacgttaaaccggttaaccgttgggttaacggcgttacggaccttacccgtaagttccgtttccg

SEQ ID NO: 422235 - DNA, 648 bp, Homo sapiens
  misc_feature: GZ8MTXP01BK1KU.15.25.C03.1.454.CMB.2.raw
  modified_base (234)..(234): a, c, t, g, unknown or other
  modified_base (247)..(247): a, c, t, g, unknown or other
  modified_base (382)..(382): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagacgccggcctccatcctcctgcaggtctagtcagacncctccagcatacngatggaatacaacttatggattcggtctgcagaacgcgaggcagtcctaccacactctgtacttcttagtttgggttactacgtccgggtcccgtcccgggggtcccctggtacgtggttacgaggtacggacgnggtgagtcgaaggtactaattagtactttaacaactaagaaaatcgagagaaggtaggtggacggcgtaggtagggttacgggtttagggttattacgtgacgagttacgaccgtaacgtaccgtaaaccgtaaaccccgtcgtaccctaccggttccgggaacccggtaagggaccgaccggttaccgtaagggtaaacgttaaaccgttaaacggttaacgttggtcggtaacttaccggaccgttaacctcgtttccgttccg

SEQ ID NO: 422236 - DNA, 653 bp, Homo sapiens
  misc_feature: GZ8MTXP01AS7R9.15.25.C03.1.454.CMB.2.raw
  modified_base (343)..(343): a, c, t, g, unknown or other
  modified_base (360)..(360): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatcctcctgcaggtctagtcagacgcctccagcatactgatgatacaacttagtggattggtactgacagaacgccaggcagtctaccacactcagtactcttgtttggtctacgtcggccgtccgggtcccccnggacgtagtcagtgcgngtgatcgagctagtagttatttacactaagaaaactcgaagacgaaggtaggtgggacgggagttagggtacgggttacgggttttaggggtttaactttacggtgtaccgtagtacggtaaccgtaaacgggttaccctaaacccgaaaccccgtagtacccgtaacccggttccggggaaccggtaacggggaccgtaacccggttcggtaaagggtaaacgttaaacgtttaaaaccgggacgttcgggtacggtcttaaccggaccttaccgtaacgtttcccgtttcg

SEQ ID NO: 422237 - DNA, 626 bp, Homo sapiens
  misc_feature: GZ8MTXP01AYHQC.15.25.C03.1.454.CMB.2.raw
  modified_base (334)..(334): a, c, t, g, unknown or other
  modified_base (340)..(340): a, c, t, g, unknown or other
  modified_base (343)..(343): a, c, t, g, unknown or other
  modified_base (347)..(347): a, c, t, g, unknown or other
  modified_base (378)..(378): a, c, t, g, unknown or other
  modified_base (390)..(390): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagagcctcagcatactgatgatacaactattggattggtacctgcagaagccgaggcagtctcacactctgatctatttggtctagtcggctccggggtccctgacngtcagngcngtgntcaggcatagtatttacactagaaatcgagnaaggagtagggnggacgtagggtaaggtacgggtttaggggtttaattacgtaggtacgtagttaggaccgtaaacggttaccgtaaacccgaaaccccggtaactacccgtacccgttccggggaaccggaacggggacccgaccggttcccggttaaagggaacgttaaaaccggttaaacggttaaccggttaacgggtacgggtcccttacggtacccaaacccgtcgtttaacccgtttccgg

SEQ ID NO: 422238 - DNA, 645 bp, Homo sapiens
  misc_feature: GZ8MTXP01BVMP9.15.25.C03.1.454.CMB.2.raw
  modified_base (298)..(298): a, c, t, g, unknown or other
  modified_base (367)..(367): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagcccggcctccatctcctgcaggtctagtcagacgcctccagcatactgatggatacatattggatggtactgcagacgcaggcagtccaccacaactccngtatcttagtttcgggttactaagtccgggccgtcccgggggtcccctgacgtaggttcaaggtcggcnggtggatcgaggctaatagtatttacactagaaatcagcaaggaggtaggaggtctaggaaggttacgggtttaggggtttattaacgttggatacgtgtacgaaacggttaccaaaacccgtaaaccccgtgtacccgtaacccggttccgggaaccggaacggggaccctaaccgggttcccggaaaggggtaacgttaaacggtttaaaaaccggaaccggttaagggttacgggccttaccgggaccgttaacccgttaagttcccgtttccgg

SEQ ID NO: 422239 - DNA, 540 bp, Homo sapiens
  misc_feature: GZ8MTXP01BN5E3.15.25.C03.1.454.CMB.2.raw
  modified_base (293)..(293): a, c, t, g, unknown or other
  modified_base (356)..(356): a, c, t, g, unknown or other
  modified_base (408)..(408): a, c, t, g, unknown or other
  modified_base (473)..(473): a, c, t, g, unknown or other
  modified_base (478)..(478): a, c, t, g, unknown or other
  modified_base (492)..(492): a, c, t, g, unknown or other
  modified_base (528)..(528): a, c, t, g, unknown or other
  modified_base (534)..(534): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctcccctgccccgtcacccctggagagccggcctccatctcctgcaggtctagtcagacgcctccagcatactgatggaatacaactatggattggtacctgcagacgccgaggcagtcnccacacgtctgatcttagtttgggtactaagtccggggccctaccgggggttccccctggacnggtttcaggtggcaagtgggatcgagcatagtatttacactagaaatcgagntagagtggagcgtgaggtacggtttgggttatacgtgcatgacgaaggtcctaaaccgaaccccntaccnccgtcggaaccggnggacacgcgtaggacgttattaacggactggagcgncacctnttcgtg

SEQ ID NO: 422240 - DNA, 629 bp, Homo sapiens
  misc_feature: GZ8MTXP01BYAE8.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatcctcccgcaggtctagtcagacgcctccagcatactgatggatacaactatttggattggtacctgacaagaacgccgagggcagtcctaccaacaacctcctagtacttcgttagttttcgggttactaacgtccggggtcccgtccgggggtccctagacgtaggtcaggtgacaggtgatcgaggctatagtatttacactagaaatcgagacaggagtgggagcgtaggagggtacggtttaggggtttattaggtgcgtagtcgaacgtaacggtacctaaaccgaaaccccgtacttccgtaaccgttccgggaccggaacggggtacaccggtaccgttagggaaacgtaaacgttaaaaccggacgttcggttcggcgtaacggacccacgttacgttccgttcgtttccc

SEQ ID NO: 422241 - DNA, 587 bp, Homo sapiens
  misc_feature: GZ8MTXP01CCDA5.15.25.C03.1.454.CMB.2.raw
  modified_base (490)..(490): a, c, t, g, unknown or other
tcagtctacgtagccacgaccggtgctcgatttagtagtgtagatttgggtttgggggatcaggactcctcagttcaccttctcacaatgaggttccctgctcagctcctggggctgctaatgctctgggtctctggatccagtggggatattgtgatgactcagtctccactctccctgccccgtcacccctggagagccggcctccatctcctgcaggtctagtcagagcctccagcatactgatggatacaacttatttggattggtacctgcagaagccgagggcagtctaccacaactcctgatcttagtttcgggtactaacgtccgggcccgtccgggggtccctcggacgtaggttcaggtggactaggtggatcgaggcagtagtatttacactagaaatcagcaggaggtgggaggcgtaggtagggtacggtttaggggtttattacggtgtcagtgacgaggtaccaaccgaacccgntccgaccgtcgggaccggaacggacgacggccgttagggtaaacgtaagttaaaccgcgttcggtggtctcgcaaccttcttaacgttcgtttaacc

SEQ ID NO: 422242 - DNA, 548 bp, Homo sapiens
  misc_feature: GZ8MTXP01EYCK8.15.25.C03.1.454.CMB.2.raw
  modified_base (337)..(337): a, c, t, g, unknown or other
  modified_base (341)..(341): a, c, t, g, unknown or other
  modified_base (351)..(351): a, c, t, g, unknown or other
  modified_base (397)..(397): a, c, t, g, unknown or other
  modified_base (448)..(448): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagcccggcctccatctcctgcaggtctagtcagagcctcagcatactgatggatacaactatggattggtacctgcagaagccagggcagtctaccacaactcctgatctatttgggtctaatcgggctccggggtccccngacnggtcagtgcngtggatcgagctatagtatttacactagaaatcagcagagtggagngtgaggtacgttgggttattactgactatcgcaggtactaaccgaaccctntccacccgttcggaacccgagggttaccacggccgtaggaacgttaacgttaaaccggaccgttggacggtcctacggaccttaaccgtcttcggttccg

SEQ ID NO: 422243 - DNA, 602 bp, Homo sapiens
  misc_feature: GZ8MTXP01BMVW7.15.25.C03.1.454.CMB.2.raw
  modified_base (366)..(366): a, c, t, g, unknown or other
  modified_base (405)..(405): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagacgcccggcctccatctcctgcaggtctagtcagagcctccagcatactgatggatacaactattggattcggtacctgacagaacgccgagggcagtcctacacaactctgatcttagtttggtctaaggtccggccgtccggggtcccctggactggtcaggtcgcnggtgatcgagtactagtagtatttacactagaaatcagnaggagtggaggagtagggacggttaggtttaggggtttacttacgtgacgtatacggacgtaacggtacctaaacccgaacccgtacgtaccgtaccgttccgggaacggaacggacgtaccgccggttaagggaacttaaacgttaaaacggcgtgggtcgtccgttacgaccttaccgtaacttccgtttaaccg

SEQ ID NO: 422244 - DNA, 562 bp, Homo sapiens
  misc_feature: GZ8MTXP01ADXLJ.15.25.C03.1.454.CMB.2.raw
  modified_base (298)..(298): a, c, t, g, unknown or other
  modified_base (342)..(342): a, c, t, g, unknown or other
  modified_base (354)..(354): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagagcctccagcatactgatggatacaactattggattggtactgcagaagccaggcagtctccacactcngatcttagtttgggtctaagtcgggcctccggggtcccctgacnggttcagtggcngtgatcgagcatagtatttacactagaaatcagcgagaggtggaggcgtaggagggtacggtttaggggtttattacgtgtcgagttagacgtaacggtacctaaaccgaaaccccgtatacccgaccgttcgggaaccggacgggacaccggccgtagggaacgttaacgttaaacgacgtggtcggctcggaccacctgttccttg

SEQ ID NO: 422245 - DNA, 601 bp, Homo sapiens
  misc_feature: GZ8MTXP01C7GX7.15.25.C03.1.454.CMB.2.raw
  modified_base (244)..(244): a, c, t, g, unknown or other
  modified_base (418)..(418): a, c, t, g, unknown or other
  modified_base (452)..(452): a, c, t, g, unknown or other
  modified_base (483)..(483): a, c, t, g, unknown or other
  modified_base (555)..(555): a, c, t, g, unknown or other
  modified_base (563)..(563): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatcctcccgcaggtctagtcagagcctcagcatacngatggatacaactattggattggtacctgacagaagccgagggcagtcctaccaacaactcctagattctttaagttttcgggtactaagtccgggtacccgtccggggtccctggacgtaggttcgaggtggacaggtggatcgaggctaatagtatttacatagaaatcagnagagtgagctggaggtaggttagggttactaggngtacatgactaacggtccaacgaaacccgtntccgaaccgttccgggaccggaacggaaccttaccggaccgttagggtaaacgtaaacgtttaaaaccgggngttacggnggtactaacggacctacccgttatcttcggtttaaccc

SEQ ID NO: 422246 - DNA, 631 bp, Homo sapiens
  misc_feature: GZ8MTXP01DY3PA.15.25.C03.1.454.CMB.2.raw
  modified_base (376)..(376): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgccccgtcacccctggagagcccggcctccatctcctgcaggtctagtcagagccctccagcatactgatggatacaacttattggattggtacctgcgagaacgccgagggcagtcctaccactaactcctgtattctttagtttggttactaacgtccggggcctccggggtcccctgactaggtcagtcggcnggtgactcgaggactagtagtactttacactagaaatcagacgaagaggtggaggcgtagggagggttacggtttaggggtttattacgtgtactagtcgaacgtaacggttacctaaaccgaaaccccgtatacccgtaccggttccgggaaccggtacgggaccaccgggttccgtaagggtaacgttaaacgttaaaaccgggaacgttgggtacggtcgtacggtacccgttaccgttaacttcgtttccg

SEQ ID NO: 422247 - DNA, 627 bp, Homo sapiens
  misc_feature: GZ8MTXP01CMU86.15.25.C03.1.454.CMB.2.raw
  modified_base (245)..(245): a, c, t, g, unknown or other
  modified_base (558)..(558): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggacgcgccgcctccatctcctgcaggtctagtcagacgccctcagcatacngatggatactaattagttggattcggtacctgacaagaacgcgaggcacgtccaccacaactctgtattcttagtttcgggtactaacggtccgggtcccgtccggggtcccctaggacgtaggttcgaggttcggactgggtggactacggaggtactaagttaagttaactttaacaagttaaaggaaaactcgaacgacgtaaggtaggtaggggaacggtcgttaggggtaacggttacggggttttaggggtttaacttacggtgtacgtagttacgaaccgtaacggtacctaaaccgaaacccgtntaccgtaccgtcggaacgacggcgacgcgtaggattaacgttaacgagtggtgctgcactcttcgttcg

SEQ ID NO: 422248 - DNA, 666 bp, Homo sapiens
  misc_feature: GZ8MTXP01EIAV5.15.25.C03.1.454.CMB.2.raw
  modified_base (385)..(385): a, c, t, g, unknown or other
  modified_base (435)..(435): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtcctccactcctccctcgcccgtccaccccgtggacgacgcccggcctccatcctcctgcaggtctagtcagacgcctccagcatactgatgatacaacttattggattggtacctgacaagaacgccgaggcagtcctaccaacactctgtattcttagtttgggtactaacggtccgggcccgtccggggtccccctggacgtaggttcaggtcgggntaaggtgaactcgaggtactaagttagttaactttaacaataaagaaaancaagacgaaaggtaggtagggacggtacggtagggtaacgggttaacgggtttaggggttttaagttacgtgtacgtagtacgaacgtaaacggttaacctaaaccgaaacccgtactacccgtaccggtccgggaaccggaacgggaccgtacggttaccggtaagggtaaacgttaaacgttaaacggttaacgtggtacggtcgtacgaccttaaccttcgttcgttg

SEQ ID NO: 422249 - DNA, 717 bp, Homo sapiens
  misc_feature: GZ8MTXP01C6MB0.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctccagcaatactgatggaatactaacttagttgattcggtacctgacaagacgcgaggcagtcctaccacactctagacttcttagtttcggttactaacggtccggggtacccgttcccggggtccccctaggacgtagggtttaccagggttcgggactggggtagggtaacttaccgggaacgggtactaagttacggttaaactttttaacaacgttaaggtaaaacttcgaagacgaaggtagggtagggagggtcgttaggggtaaggggttaacggggttttagggggttttaactttacggtcggtacgtagtacgaacgtaacggttaacctaaacccgaaaccccgtactacccggtaccgttaccgggaacccgggaacggaccgaccggaccgttaagggtaacgttaaacggttaaaccgttaaccggttggtacggtcgtacggtacccttaacgtaacttccgtttccg

SEQ ID NO: 422250 - DNA, 626 bp, Homo sapiens
  misc_feature: GZ8MTXP01EX9SJ.15.25.C03.1.454.CMB.2.raw
  modified_base (404)..(404): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgcccggcctccatctcctgcaggtctagtcagacgcctccagcatactgatggatactaacttagtgattggtacctgacagaacgccgaggcagtcctaccacactctgatcttagtttggtactacgtccgggccgtccggggtcccctgactaggtcaggtgcaaggtgatcgaggctagtagtatttacataagaaatcagnaggacgtgggagcgtaggtagggtacggtttaggggtttattacgtgactagtacgacgtaaacggttccaaacccgaaaccccgtatacccgtaacccggttcgggaacccgggtaacgggaccgtaccggacccggttagggaaacggttaaacgttaaaccgggttaaccgtttgggcgggttaacccgtaccgtaccttaccgttaacgtttccgtcg

SEQ ID NO: 422251 - DNA, 653 bp, Homo sapiens
  misc_feature: GZ8MTXP01BVJWU.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcaccctggagagccgcctcatctctgcaggtctagtcagacgcctcagcatactgatggatacaacttatggattgtacctgacgagaacgcaggctacgtcctacaacaactctagtatcttagtttcggtactaacggtccgggtccgtccggggtcccctagacgtaggtcaggtgggactggtgactacgaaggtctaagttagttaactttaacgaactaagtaaaacgtcaagtacgaaggtaggtaggacggtagtagggtaagggttacgggttttaggggttttaattacggttagtaccgtaggttcgtaaccgtaaacggtaaccctaaacccgtaaaccccgtacgtaccgtaaccggttcccgggaacgggtaacggaccgacggttaccgtaacggtaagttaaacgttaaacgacgttaagggtacgcgtcgaccttactaacttcgtttccg

SEQ ID NO: 422252 - DNA, 561 bp, Homo sapiens
  misc_feature: GZ8MTXP01AYQHP.15.25.C03.1.454.CMB.2.raw
  modified_base (393)..(393): a, c, t, g, unknown or other
  modified_base (445)..(445): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagacgccggcctccatctcctgcaggtctagtcagacgcctccagcatactgatggatacaactattggattggtacctgacagaagccagggcagtctccacactcctagattctagtttggttactaagtccgggtcctcccccggggtcctagactaggttcaaggtcgcagtggatcgagtcattagtatttanactagaaatcagctagagtggagtcgagtggtacgttgggggtttactagtngatgacgtagtaccgtaaccaaacccgactaccgtaccgttccggcggacggacgaccgacgtacgacgttaagttaaacgtaaacgtcgtggcgcgactaaccgttcgttaaccg

SEQ ID NO: 422253 - DNA, 585 bp, Homo sapiens
  misc_feature: GZ8MTXP01CR6Q5.15.25.C03.1.454.CMB.2.raw
  modified_base (283)..(283): a, c, t, g, unknown or other
  modified_base (315)..(315): a, c, t, g, unknown or other
  modified_base (322)..(322): a, c, t, g, unknown or other
  modified_base (379)..(379): a, c, t, g, unknown or other
  modified_base (413)..(413): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtggggatattgtgatgactcagtctccactcctcctgcccgtcaccctggagacgccgcctccatctcctgctaggtctagtcagacgcctacagcaatactgataggaactaactaacttagttggaattcggtaccngaccaagacgcgaggcagtcaccaactactcngtacttntttagttggtactaggtccgggccgtccggggtcccctaggactggtcgagtcggangtgactgagactatagttactttacataagaaanacgagagagagtaggaggagtaggtaggtaggtttagggtttaggttagtagtagagtgacgtaacggtacctaaaccgaacccacgaccgtaccgtccggaacggacggacgacgccgtagtaagttaacgttaacgttacgtaagtcgcgtcgacactaacgttcgttcg

SEQ ID NO: 422254 - DNA, 612 bp, Homo sapiens
  misc_feature: GZ8MTXP01CW0SZ.15.25.C03.1.454.CMB.2.raw
  modified_base (410)..(410): a, c, t, g, unknown or other
  modified_base (415)..(415): a, c, t, g, unknown or other
  modified_base (418)..(418): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgttgactcagtctccactctccctgcccgtcacccctggagacgccggcctccatcctcctgcaggtctagtcagacgcctcagcatactgatggaatacaactattggattggtacctgacagaacgccagggcagtccaccaactaacgtcctagtacttctttagttttcgggtactaaggtccgggccgttccgggggtcctggacgtaggttcaggtcggacaggtgatcgagcatagtactttacatanaaatnagnagagaggagcgtaggaggtacggttaggggtttattacggtgtacgtagtacgacgtaacggtaacctaaccgaaaccccgtatacccgtaccgtaccgggccggaacgggaccgaccggtaccgttagggtaaacgtaacgtttaaaacgacgttcggtcggtactcgacctaccgttattcgttcgttaacc

SEQ ID NO: 422255 - DNA, 627 bp, Homo sapiens
  misc_feature: GZ8MTXP01EDMSI.15.25.C03.1.454.CMB.2.raw
  modified_base (261)..(261): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcaccccgtggagacgccggcctccatcctcctgcaggtctagtcagacgcctccagcatactgatggatacaactntgatggtactgcagagcgaggcagtctccacaactcctagatcttagtttgggtactaacgtcggggcccgtccggggtcccctagacgtaggttccaggtcgacgtgggtgaactcgaggactaagtagttaattttacaacgttaagaaatcgagacgaaggtagtagggagtacgtaggtaacggggttacggtttacggggtttaattacgtgtagtagtcgtaagtaacggtactaaacccgtaaacccgtcttacccgtaccgttacgggccggtaaacgggaccgaccggttccgtaaaggtaacgttaaacgttaaacgttacgtggtacggtctcgacttacctaacgttcgttccg

SEQ ID NO: 422256 - DNA, 573 bp, Homo sapiens
  misc_feature: GZ8MTXP01AN69F.15.25.C03.1.454.CMB.2.raw
  modified_base (263)..(263): a, c, t, g, unknown or other
  modified_base (394)..(394): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcagcatactgatggatacatatgatgtacngcagagccaggcagtctccacactcctgatctagtttgggtactaagtcgggccgtccggggtccccctggactaggttcaggtggcaaggtgggatcgaggtcaagtagtactttacactagaaatcagnaaggagtggagcgtgaggtaggttagggttaggttagtgtcgagtagacgaacgtacgtaaccgtaaacccgtaccgtaccgtaccgttccggtaaccggaacgggaccgacgccgtacggtaacgttaacgttaaacgttaacgtaacgtaggtcgtcgtacactaacgttcgttccg

SEQ ID NO: 422257 - DNA, 649 bp, Homo sapiens
  misc_feature: GZ8MTXP01DT2FO.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcaccccgtggagagcccggcctccatctcctgcaggtctagtcagacgcctccagcaatactgatggaatactaactagttggattggtacctgacagaacgcgaggcagtcctaccacaactctagacttcgttagtttggtactaacggtccgggccgtccggggtccccctggacgtaggttcaggtcggacgtaagggtgtacgtcgagggtactaagttacgttaacttttaacactaagaaaactcgaagacgaaggtaggtaggaggtcgtagggtaggttacgggtttagggtttaacttacgtgtactagtagacgaacggtacctaaaccgaacccgtataccgtaccggttccgggaaccgacgggaccacggaccgtaagggtaacgttaaacgttaaaccggacgttcgggtacggtcgttcggaccttaccgtaacgttccgttaaccg

SEQ ID NO: 422258 - DNA, 625 bp, Homo sapiens
  misc_feature: GZ8MTXP01EKKM2.15.25.C03.1.454.CMB.2.raw
  modified_base (401)..(401): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagagccgcctccatctcctgcaggtctagtcagacgcctcagcatactgatggatactaactatggattggtacctgacagacgcaggcagtctcaacactctgtatcttagtttcggttactacgtccgggccgtccggggtccccaggtacgaggttcaggtcggctaaggtgatcgaggctaatagttaactttacaactaanaaaagcgtaagagaaggaggttagggagtcgtagggtagggtagggtttaggggtttacttaagtcggtactagtcgaacgtaacggtacctaaaccgaaacccgtagtacccgtacccggttccgggaaccggtaacggaccgacggttaccgtagggtaaacttaaagtttaaaccgaacgttggacggtaacgtcgaccgaacgttcgttaaccgtttccg

SEQ ID NO: 422259 - DNA, 574 bp, Homo sapiens
  misc_feature: GZ8MTXP01C7QZS.15.25.C03.1.454.CMB.2.raw
  modified_base (197)..(197): a, c, t, g, unknown or other
  modified_base (216)..(216): a, c, t, g, unknown or other
  modified_base (480)..(480): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagngccggcctccatctcccgnaggtctagtcagagcctccagcatactgatggatacaactattggattggtacctgacagagccagggcagtctccacaactctgatctagtttggtactagtcggccgtccggggtcctgacgtaggttcgagtggctagtggatcgaagggtcagtagtatttacgactagaaatcagcaggagtggagtcgtaggaggtacggttaggggtttatacggtgtacgtatacgacgtaaacggtacctaaccgaaaccccgtntacccgtaccgttccggaccggaacggacgacgtaccgttggaaacgtaacttaaacggacttggtcggactcgacctacactcttcgttaacc

SEQ ID NO: 422260 - DNA, 613 bp, Homo sapiens
  misc_feature: GZ8MTXP01B0OH3.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtggggatattgtgatgactcagtctccactcctccctgcccgtcacccctggagagcccggcctccatctcctgcaggtctagtcagacgcctccagcatactgatggatacaacttattggattggtacctgacagaagccgagggcagtcctccacaacctcctgatcttagttttcgggttactaagtccggggtcccgtccggggtcccctggacgtggttccaggtcgggacaaggtgggatcgagggctagtagtattttacatagaaaatcagacaggagtggaggctaggaggtacggtttaggggtttattacgtgactagtcgacgtaacggttacctaaaccgaaaccccgtactacccgtaccggttccgggaacccggaacgggaccgaaccggccgtaagggaacgttaacgttaaacgaacgtgtacggctcgcttaccgtaacttcgtttccg

SEQ ID NO: 422261 - DNA, 622 bp, Homo sapiens
  misc_feature: GZ8MTXP01ADLR1.15.25.C03.1.454.CMB.2.raw
  modified_base (298)..(298): a, c, t, g, unknown or other
  modified_base (350)..(350): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtgggatattgtgatgactcagtatccactctccctgcccgtcacccgtggagacgccggcctccatctcctgcaggtctagtcagacgcctcagcatactgatggaataacaactatttggatttcggtacctgcagaacgccgagggcagtcnccacaactctgattctagtttggtactaacgtccgggcctccccggggtccngactaggtcaagtgcagtggatcgagctaatagtactttacactagaatcagcgaggaggtggaggtcgtagggtaagggttacggtttaggggggtttactacggtgacgtaagtcggacgtaaacggttaccctaaacccgtaaaccccggtactacccgtacccggttccgggacccgggaacgggaccaccgggtccggttagggacggttacgttaacggaacccgtaagttcggtacggtacgttcgtaaccgttaaccgttaacg

SEQ ID NO: 422262 - DNA, 540 bp, Homo sapiens
  misc_feature: GZ8MTXP01A75LA.15.25.C03.1.454.CMB.2.raw
  modified_base (256)..(256): a, c, t, g, unknown or other
  modified_base (286)..(286): a, c, t, g, unknown or other
  modified_base (336)..(336): a, c, t, g, unknown or other
  modified_base (355)..(355): a, c, t, g, unknown or other
  modified_base (393)..(393): a, c, t, g, unknown or other
  modified_base (532)..(532): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcagcatactgatggatacaactnttggattggtacctgcagagcaggcagtcnccacactctgatctagtttgggtactaagtccgggcctccggggtccccnggactaggttcagtcggcnggtggatcgagcatagtatttacatagaaatcagcagngtcggagcgtaggaggtacggtttgggttatacgtggacagtgacgaggtacctaaaccgaacccgtataccgtaccgttcgggaaccgaggaccacgccgtaggaacttaacgttaacgacgttggcggctgccactnttccgttg

SEQ ID NO: 422263 - DNA, 642 bp, Homo sapiens
  misc_feature: GZ8MTXP01D1KZT.15.25.C03.1.454.CMB.2.raw
  modified_base (246)..(246): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccaggtggggatattgtgatgactcagtctccactctccctgcccgtcacccgtggagacgccgcctccatcctcctgcaggtctagtcagacgcctcagcatacngatgatacaactattggattggtacctgacaagaacgccgaaggcagtctaccaacaactctagtattcgttagtttcggttactacggtccgggcccgtccccggggtcctaggacgtggttacaagggtcgcgtagtggactcgaaggactaagttaagtaattttaacaacgttaagaaaactcgaagacgaggtaggtgggagtcgtagggtaaggttacggttttagggggtttaattacgtgactagtacgacgtaaacggtacctaaaccgaaaccccgtacgtacccgaccggttaacggaccgggaagggaccaccggtccgtaaggaaacgttaaacgttaaaacgtaacgtggtaacggctacggacctaaccgttaagtttccg

SEQ ID NO: 422264 - DNA, 551 bp, Homo sapiens
  misc_feature: GZ8MTXP01CVTKJ.15.25.C03.1.454.CMB.2.raw
  modified_base (357)..(357): a, c, t, g, unknown or other
  modified_base (394)..(394): a, c, t, g, unknown or other
  modified_base (406)..(406): a, c, t, g, unknown or other
  modified_base (437)..(437): a, c, t, g, unknown or other
tcagtctacgtagccacgaccggtgctcgatttagtagtgtagatttgggtttggggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactcctgatctattgggttcaagtcgggcctccggggtccccctgacaggttcagtgggcngtggatacaggcatagtatttacatagaaatacaganagagtggagggngtgaggtaggttagggttaggttactgcagngagaagtactaaccaaaccctactactaccgtcggaacggacggacgacgacgtacggtaagttaacgttaaacgttaaacgtaagtacggtcgtcgacacctaacgttcgtcg

SEQ ID NO: 422265 - DNA, 629 bp, Homo sapiens
  misc_feature: GZ8MTXP01AOJ9T.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcaccctggagacgccggcctccatctcctgcaggtctagtcagacgcctccagcatactgatgatacattagtggattggactgacagaagccgagggctacgtcctccaactaacctccgtagtacttcgtttagttttcgggtactaacgtccggggcccgttccggggtccccctggacgtaggttcaggtgcgtgtggatcgaggactagtaagttactttacactaagaaatcgaagcgagtaggtgggacggcgtagggtagggttacggtttaggggtttaacttacgtgtacgtacgttacgacgtaacggttaccctaaacccgtaaaccccgtgttacccgtaacccggttcgggaaccggaacggaccgcgttaccgtaaggtaacgttaacgttaaacgacgtggtacgcgtcacttactaacttcgttcg

SEQ ID NO: 422266 - DNA, 551 bp, Homo sapiens
  misc_feature: GZ8MTXP01DGSJA.15.25.C03.1.454.CMB.2.raw
  modified_base (277)..(277): a, c, t, g, unknown or other
  modified_base (389)..(389): a, c, t, g, unknown or other
  modified_base (394)..(394): a, c, t, g, unknown or other
  modified_base (399)..(399): a, c, t, g, unknown or other
tcagtctacgtagccacgaccggtgctcgatttagtagtgtagatttgggtttgggtgatcaggactcctcagttcaccttctcacaatgaggctccctgctcagctcctggggctgctaatgctctgggtctctggatccagtggggatattgtgatgactcagtatccactctccctgcccgtcacccctggagacgccggcctccatctcctgcaggtctagtcagagcctcagcatactgatggatacaactattggattggacctgcagaanccagggcagtctccacaactcctgattctagtttggttctaagtcgggcctcccggggtccctgacaggttcaagtggcagtggatcagcatagatttacatgaaatcaganagagnggagngtgaggtaggttaggggttagttatagagagtgtacgaacggtacgtaaccgtaaacccgtaacctacctaccgtaaccggaccggacggacgaccgaccgtacgagaacgttaacgtaacgtagtcggcgtacgactaaccgttaacgtcg

SEQ ID NO: 422267 - DNA, 597 bp, Homo sapiens
  misc_feature: GZ8MTXP01DQC24.15.25.C03.1.454.CMB.2.raw
  modified_base (256)..(256): a, c, t, g, unknown or other
  modified_base (266)..(266): a, c, t, g, unknown or other
  modified_base (336)..(336): a, c, t, g, unknown or other
  modified_base (408)..(408): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctccagcatactgatggatacatntgatggtacngcagagcgaggcagtctcacaactctgattcttagtttcgggtactaacgtcgggcctccggggtccccnggacaggttcaggtgcaaggtgatcgaggactatacgtatttacgactagaaacacagagagagtaggaggngtagtaggtaggttagggtttaggttacgtagtacgtacgtagtacgtaacgtaacgtaaaccgaaacccgtaacgtaccgtaccgttaccggtaaccggaacgggacgaccgaccgtacggtaagttaacgttaaacgttaaccgtaaggtacggtaacgtacgacgttaccgtaacgttcgtttccg

SEQ ID NO: 422268 - DNA, 643 bp, Homo sapiens
  misc_feature: GZ8MTXP01BEHFN.15.25.C03.1.454.CMB.2.raw
  modified_base (529)..(529): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtggggatattgtgatgactcagtctccactcctccctgcccgtcacccctggagacgcccggcctccatcctcctgcaggtctagtcagacgcctccagcatactgatggatacaacttagttggattcggtacctgcagaacgccgaggctagtctaccactaactctagtatcgtttaagtttcgggttactaacgtcggggcccgttcccggggtccccctaggacgtggttcaggttcgggactaaggtggactcgaggtactagtagtacttttacactaggaaactcgaagtcgaaggaggtggaggacgtaggtacgggtagggtttagggtttactacgtggtacagtgacgtaacggtcctaaaccgaaccccgtntacccgtaaccggttccgggaacggaacggttacgacccggttaccgtaagggtaacgttaaacgttaaaccggacgttcggacggtcctacggtcaccgttaacttccgttcg

SEQ ID NO: 422269 - DNA, 632 bp, Homo sapiens
  misc_feature: GZ8MTXP01EZWQL.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgccccgtcacccctggagacgccggcctccatcctcctgcaggtctagtcagacgcctccagcatactgatggatacaactattggattggtacctgcagaagccgaggcagtctaccacaactctgattcttagtttggtactaagtccgggtcctccccggggtccctagacgtaggttccaaggtcggctaggtggatcgaggcaattagtattttacgactagaaatcaagtacgaaggtaggtgggaggtcgtagggtacgggttacgggttttagggggggtttactttacgtgactagtcgacgtaaacggtaccctaaacccgaaaccccgtactaccgtaacccgttccgggaccggaacggggaccaccggtaccgtaggaaacgttaaacgttaaaacggaacgttcggtaacggctacgacctaacccgttaacgttccg

SEQ ID NO: 422270 - DNA, 604 bp, Homo sapiens
  misc_feature: GZ8MTXP01EKW0B.15.25.C03.1.454.CMB.2.raw
  modified_base (245)..(245): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagcccggcctccatcctcccgcaggtctagtcagagcctccagcatacngatggataacaacttattggattggtacctgcagagccgaggcagtctaccacaactctgatcttatttgggttactaagtccgggcctccggggtccctgactaggtcagtggacagtggatcgaggcaatagattttaccatagaaaatcagacgagagtggaggcgtggaggtacggttaggggtttacttaagtgtactagttagacgtaaaggtacctaacccgaaaaccccgtatacccgtaccgttccggacccggaaagggaccgaccggaccggttaaggtaaacggtaaactttaaaacggaacgttcggttgggacttcggacctaccttacttcgttcgtttaaccc

SEQ ID NO: 422271 - DNA, 610 bp, Homo sapiens
  misc_feature: GZ8MTXP01B9RND.15.25.C03.1.454.CMB.2.raw
  modified_base (216)..(216): a, c, t, g, unknown or other
  modified_base (396)..(396): a, c, t, g, unknown or other
  modified_base (414)..(414): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcccgnaggtctagtcagagcctcagcatactgatggatacaactattggattggtacctgacagaaagccgagggcagtcctccacaactcctagattcttagtttggttactaagtccgggtccgtccggggtcctcgactaggttcgagtggacagtggatcgaggcatagtatttacactanaaatcagcagagtagggngctaggaggtacggttaggggtttattacggtagtcgtattcggaacgtaacgggtacctaaccgaaaccccgtactacccgtacccgttccgggacccggaacgggaacaccggtacccggaggtaaaggtaactttaaaacggacgttcggtaaggtacgttcggaccctacgttacttccgttaacgtttccc

SEQ ID NO: 422272 - DNA, 663 bp, Homo sapiens
  misc_feature: GZ8MTXP01DM0GZ.15.25.C03.1.454.CMB.2.raw
  modified_base (378)..(378): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagacgcctaccagcatactgatggaatactaactagttggattcggtacctgacaagacgccgaggcagtcctaccactaactctgtatcgttagtttgggttactaagtccgggccgttaccggggtcccctaggactggtcaggtgacnggtcgagtcgaggctaatacgttaactttacaactaagaaatcgagacgaaggtaggtgggaaggcgtaggtaagggtacggttttaggggtttaattacgtgacgtagtacggtaccgtaaacggtaccttaaaaccgaaaccccgtagtaccccgtacccggttaccggggaaccggtaacgggaaccgtaaccgttacccggtaagggtaaacgttaaacgtttaaaaccgggacgtttaaggcggtaacctacggacccttacctaacgttccgtttaacg

SEQ ID NO: 422273 - DNA, 652 bp, Homo sapiens
  misc_feature: GZ8MTXP01C6NOE.15.25.C03.1.454.CMB.2.raw
  modified_base (245)..(245): a, c, t, g, unknown or other
  modified_base (372)..(372): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagagcccggcctccatctcctgcaggtctagtcagagcctccagcatacngatggatactaattattggattcggactgcaagacgcgaggcagtccaccactaactctgattcgtttagtttggttactagtccggggtccgtccggggtcccctaggacgtggttcaggtggacnggtgactcgaggctaattagttaactttaacagtaaagaaatcgaagacgaaggaggtagggaggacgttagggtaacgggttagggttttaggggttttaacttcggtgtacgtaagtcgtaaccgaacggttacctaaaacccgaaccccgtacgtacccgaacccggttccggggaaccggtaacgggaacctacggaccggtaaagggtaacgttaaaacgttaaacggttaacgttcgggtcgcgtacggaccttaacccgtgttaacctttccg

SEQ ID NO: 422274 - DNA, 727 bp, Homo sapiens
  misc_feature: GZ8MTXP01AXHZI.15.25.C03.1.454.CMB.2.raw
  modified_base (303)..(303): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagacgcccggcctccatcctcctgctaggtctagtcagagcctccagcatactgatggaatacaacttagttggattggtacctgacagaacgccgagggcacgtccnccactaacctctagtattctttagtttcgggttactacggtccgggtcccgtccggggtcccctaggacgtaggttcaggtggctggtggaatcgaggtctaagtagttactttaacactaagaaaatcgaaggacgaaggtaggtagggacggtcgtagggtaaggggttacgggttttagggggtttaacttcggtaggtacctaaggtcggtaaccgtaacggttaacccgtaaaccccgtaaaccccgtcttaccccgtaccccgggtttcccggggaacccgggtaacgggggacccgtaaaccccgggttaccggttaaacggggtaaaacgttaaaacggtttaaaaccggttacggtttaacgggtccgggtaacgttaccggacccgttacccttaacgtttccgtttaacccgg

SEQ ID NO: 422275 - DNA, 622 bp, Homo sapiens
  misc_feature: GZ8MTXP01D35ZA.15.25.C03.1.454.CMB.2.raw
  modified_base (553)..(553): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcaccccgtggagacgccggcctccatctcctgcaggtctagtcagacgcctccagcatactgatggatacaacttatggattggtacctgcaagaacgccagggcagtcctaccaactaactctgtactttcgtttagtttcgggttactaacgttccggggcccgttccgggggtcccctaggtacgtagggtttccaggttcgggacgtaagggtgggactacgaggtactaagtaagttaacttttaacgaataagaaaatcgaagagaaggtaggtagggaggtcgtaggtaagggttagggtttagggtttaacttaacgtggtacagtaggacgtaacggtacctaaacccgaaacccgtntaccgtaccgtcggaacgacggacacgcgtaggacgaagttaacgacgtgtagctgcactaattcgtcg

SEQ ID NO: 422276 - DNA, 561 bp, Homo sapiens
  misc_feature: GZ8MTXP01D64Z4.15.25.C03.1.454.CMB.2.raw
  modified_base (466)..(466): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccgagggcagtctccacaactcctgattcttaagtttgggttactaagtccggggcctccggggtccccctggactggtcagtggcaaggtgatcgaggcatagtatttacatagaaatcagcagagtggagcagaggtacgttgggtttatacgtgctagtgacaaggtcctaaacgaaaccccgtntaccaccgttcggaaccggaagggacctacgaccgttagggaacttaacgttaaaacgaacgttggtggtctacggacaccgtaagttcttaacg

SEQ ID NO: 422277 - DNA, 589 bp, Homo sapiens
  misc_feature: GZ8MTXP01A180T.15.25.C03.1.454.CMB.2.raw
  modified_base (297)..(297): a, c, t, g, unknown or other
  modified_base (371)..(371): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagacgcctcagcatactgatggaatacaacttagttggattcggtacctgacagaacgcgagggcagtcnccacactctagattcttagtttgggtactaagtccgggcccgttccggggtcccctggactggttcaggtggcngtggatcgaggcagtagtatttacatagaaatcagcgaggaggtgggaggcgtaggtacgggttacggtttaggggtttacttacgtgctagtcgacgtaacggtacctaaaccgaacccgtactaccgtaccgttcgggaaccggacgggacctaccggccgtagggaacgttaacgttaaacggacgtgtcgggctcgacgttacctgttcgttcg

SEQ ID NO: 422278 - DNA, 607 bp, Homo sapiens
  misc_feature: GZ8MTXP01DW20K.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaatattggattggtactgcagagcaggcagtcacacaactctgtatcttagtttggtactaacgtccgggccgtccggggtcccctggacgtaggttcaggtcggctggtggatcgaggctaagttacgtattttaacacttaagaaatcgagacgaaggaggtagggaggtcgtagggtagggttaacgggtttggggttttaattacgtggtactagtagacgtaacggtacctaaaccgaaacccgtactccgtaaccgttcggggaaccgtagggaccacggacgtaggtaacgttaaacgttaaaccggaacgttgggtaggtcctaggaccttacctaagttcttaacg

SEQ ID NO: 422279 - DNA, 693 bp, Homo sapiens
  misc_feature: GZ8MTXP01B1MR1.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagacgcccggcctccatcctcctgcaggtctagtcagacgccctccagcatactgatggaactactaactagtttggattcggtacctgacaagaacgccgagggctacgtcctacccaactaaccttcctagtactttcgtttagttttcgggttacctaacggtcccgggggtccccgttccccccgggggtccctaggtaccgtacgggttcgaacgggttggcgtaggtggactcgaggtctaattacgtatttacgacttagaaatcgagacgaaggtggtagggagtcgtagggtacgggttacgggttttagggggggtttacttacgttgacgtagtcgtacgtaaacggtacctaaacccgtaaaccccgtacgtacccgtaccggttccgggaccggaacgggggaccaccggtaccggtagggttaaacgttaacggttaaacccgtaagtcggtaacgggtctacggaccctaacttaacgttccg

SEQ ID NO: 422280 - DNA, 663 bp, Homo sapiens
  misc_feature: GZ8MTXP01D7011.15.25.C03.1.454.CMB.2.raw
  modified_base (245)..(245): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgccccgtcacccctggagacgccggcctccatctcctgcagtctagtcagacgcctcagcatacngatggatacaactattggattggacctgcagaacgccagggcagtctaccacaactctgtactttcttagtttggttacctaaggtcccggggtcccgtccccgggggtccctagacgtaggttcgaaggttcgcgtagtggatcgaggtactagttagtatttacactagaatacagacgagaggtgggaggtcgtagggagggttacgggtttaggggggtttaacttacgtgacgtagtaggtacgaacgggttaacctaacccgtaaaccccgtacgttacccgtaacccggtttcgggaacccgggttaacgggggacccttaacccgggaccgtttaacggggaaacgttaaacgtttaaaaccgggaaccttagggtcgtaccgtacgaccctaaccgttaacgtttcccg

SEQ ID NO: 422281 - DNA, 592 bp, Homo sapiens
  misc_feature: GZ8MTXP01EOQK8.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagcccggcctccatctcctgcaggtctagtcagagcctccagcatactgatggatacaactattggattggtacctgcagaagccagggcagtctccacaactctgatcttagttttgggtctaagtcgggcccgtccggggtccccctggacaggttcagtggcaaggtggatcgaggctatagtattttacgactagaaaatcagcaagaggtggaggctaggagggtaggtttaggggtttattacgtaggactagtagacgtaacggttacctaaaccgaaaccccggtattacccgaacccgtttccgggaaccggtaacggggaccaccggccgtagggaagttaacgttaaacgaacgttggacggtctcgacacctcgttcgttccg

SEQ ID NO: 422282 - DNA, 568 bp, Homo sapiens
  misc_feature: GZ8MTXP01DSIOB.15.25.C03.1.454.CMB.2.raw
  modified_base (211)..(211): a, c, t, g, unknown or other
  modified_base (286)..(286): a, c, t, g, unknown or other
  modified_base (350)..(350): a, c, t, g, unknown or other
  modified_base (463)..(463): a, c, t, g, unknown or other
tcagtctacgtagccacgaccggtgctcgatttagtagtgtagatttgggtttgggggatcaggactcctcagttcaccttctcacaatgaggctccctgcccagctcctggggctgctaatgctctgggtctctggatccagtggggatattgtgatgactcagtctccactctccctgcccgtcacccctggagagccggcctcatccnctgcagtctagtcagacgcctcagcatactgatgatacatattggatgacctgacagagccgaggcagtctccanactctgatctagtttggctagccggctcggtcctgactagtcagtgcagtgatcaggcatagtntttacatagaaatcagacgagtaggtggagcgtaggtaggtacggtttaggggtttaccttagggttcggactaagttcgaccgaaacgggttcctaaaccgaaaaccccggnttaccgaaccgttcgggacggaacgggacacggaccgttaggaaagtaacgttaaaacgcgttaggtaacggcttaaggcccaacccgtttcttccgttcgttcc

SEQ ID NO: 422283 - DNA, 576 bp, Homo sapiens
  misc_feature: GZ8MTXP01BNLE6.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatcctcccgcaggtctagtcagagcctccagcatactgatggatacaactattgattggtacctgcagagccagggcagtctccacactcctgatctatttggtctagtcggcctccggggtcctgacaggttcgagtggcagtggatcgaggcatagtatttacactagaaatcagcagagtggagtcgtaggaggtacggttagggtttattacgtgtctagtgacgtaacggtcctaaccgaaaccccggtatcccgtacccgttccgggacccggaacggggaccaccggacccgttggtaaacgtaacgttaaacggaaccgttgggtaaggtcgtcggacctacccttatccgttcgtttccc

SEQ ID NO: 422284 - DNA, 729 bp, Homo sapiens
  misc_feature: GZ8MTXP01D0IYO.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactctccctgcccgtcacccctggagacgccggcctccatctcctgcaggtctagtcagacgcctcagcatactgatggatacaatagttggattcggtacctgcagaacgccgaggcacgtcctaccaactaaccttcctgtattaccgtttagttttcgggttacttaacggtccggggtcccgttccccgggggtccccctaggaactagggtttccaaggttcgggacctaagggttgggaacttaccgaaggtacctaagttaacgttaacttttaacaactaaggaaaactcgaagacgtaaggtaggtagggacggtagtagggtaagggttacgggttttaggggtttaattaacgtgtaacgtacgttacgaaccgtaaaccgggttacctaaaaccccgtaaaacccccggtacgttaccccgtaacccggtttcccggggaacccgggtaaacgggaccgtaaacccggttcccgtaaaggggtaacgttaaacgttaaaaccggttaccgtaaggtcggcttcggaccttaccgtaacttcgtttccg

SEQ ID NO: 422285 - DNA, 602 bp, Homo sapiens
  misc_feature: GZ8MTXP01E15VA.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcaccccgtggagagccggcctccatcctcctgcaggtctagtcagagcctccagcatactgatggatacaactatttggattggtacctgcagaagccgagggcagtctccacaactcctgatctagtttgggttctaacgtccggggccgtcccccgggggtccctgactaggttcaaggtggcagtggatcgagcatagtatttacactagaaatcagcaggagtgggaggctagggtagggtacggtttaggggggtttatacgtgcagtcgaccgtaaacggtacctaaacccaaaacccccggtactcccgtacccgttccggggccggaacggggaccaccggtcccgtagggaacgttaaacgttaaaccggtaacgtcggtcggcctcgacctaacccgttaattccg

SEQ ID NO: 422286 - DNA, 620 bp, Homo sapiens
  misc_feature: GZ8MTXP01A65D5.15.25.C03.1.454.CMB.2.raw
  modified_base (250)..(250): a, c, t, g, unknown or other
  modified_base (303)..(303): a, c, t, g, unknown or other
  modified_base (311)..(311): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgccccgtcaccccgtggacgacgcccggcctccatctcctgcaggtctagtcagacgcctccagcatacngatggatactaacttagtggtattggtacctgacaaggacgcgaggcagtccncacactcntattcttagtttcggtactacggtccggtccgtccggggtcccctaggacgtaggtcaggtcgacgtggtcgggactaggacggtactaagttacgttaatttaccgaattaaacgaaaactcgaagagtaagggaggtgggacggtgtagggtagggttacgggttttgggttactagtgactagtgaacgtaacgtaccaaaccgtaacccgtattaccgtaccgtccgggaacgaacgggcaaccgttcgtaaaggaacgttaaacgttacgagttgacggtcacgaccttacgtcttcgttaacg

SEQ ID NO: 422287 - DNA, 689 bp, Homo sapiens
  misc_feature: GZ8MTXP01BNYGR.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcaccctggagagccggcctccatctcctgcaggtctagtcagagcctccagcatactgatggataacaacttagttggattggtacctgcagaacgccgagggcagtcctccactaactcctaggtacttcgtttaagttttcggggtaccttaacggtcccggggtccccgttcccgggggttcccccctaggtacgtacgggtttaccaggttcgggactaagggtagggtaactcgaagggtacctaagttaacgttaactttttaacaacgttaagaaaattcgaagacgtaaagggaggttagggaggtacgttagggtaacgggttaacgggttttaggggtttaactttacgtaggtacctagtacgacgtaaacggttacctaaacccgtaaacccgtatacccgtaccgtcgggaacgacgggacctacggaccgtaggtaacgttaacgttaaacggttaaccgtggtacgtcgacgccactaacgttcgttcg

SEQ ID NO: 422288 - DNA, 593 bp, Homo sapiens
  misc_feature: GZ8MTXP01EXV3Y.15.25.C03.1.454.CMB.2.raw
  modified_base (263)..(263): a, c, t, g, unknown or other
  modified_base (420)..(420): a, c, t, g, unknown or other
  modified_base (572)..(572): a, c, t, g, unknown or other
  modified_base (579)..(579): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctcgcccgtcacccctggacgacgcccggcctccatcctcctgcaggtctagtcagacgcctcagcatactgatgatacaacttntggattcgtacctgcagacgcgaggcagtcctaccacaactcctgtacttctttagtttcgggtactaacgtccgggtaccgtccgggtcccctaggtacgtaggtcaggtcggcgtaaggtggatcgaggtactaattagtactttaacagtaaanaactgagagaaggtaggtaggagagtaggtaggttaggtttaggttatcgtagatagtacgacgtaacgtaaccaaccgtaaccgtacgtaccgtaccggtcggaacggacgacgacgttacgaaggtaaacgttaaacgttaacgagtcgngtcgacncttactcgttctcg

SEQ ID NO: 422289 - DNA, 643 bp, Homo sapiens
  misc_feature: GZ8MTXP01AKU57.15.25.C03.1.454.CMB.2.raw
  modified_base (306)..(306): a, c, t, g, unknown or other
  modified_base (385)..(385): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagacgccggcctccatctcctgcaggtctagtcagacgcctccagcatactgatggatacaactagttgattcggtactgcagacgccagggcagtctccacaactcctanatcgttagtttcgggttactaacgtccgggtaccgtccccggggtccctaggacgtaggtcaaggtcgtcaggtgatcnggtacatagtatttacgatagaatacgagacgaggtaggtagggagtcgtagggtaacgggttacgggtttaggggggttttattaacggtgacgtagtcggacgtaacggtacctaacccgtaaacccggtactaccgtaccccggttccgggacgggaacgggacccgttacggtaccggtaacgggaaagttaacgttaaaaccggtaacggttaggtcggtaccgtacgttaccgtaacccgttaacgtttccg

SEQ ID NO: 422290 - DNA, 599 bp, Homo sapiens
  misc_feature: GZ8MTXP01BK2CK.15.25.C03.1.454.CMB.2.raw
  modified_base (306)..(306): a, c, t, g, unknown or other
  modified_base (354)..(354): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagacggcctccatcctcccgcaggtctagtcagagcctccagcatactgatggaatactaactatttggattggtacctgacagaacgccgagggcagtctccacactcngatctagtttggtctagtcggcctcgggtcctgactggtcaggtgacngtgatcgaggtcatagtattttacactagaaatcagcgagaggtaggaggcgtaggaggtacgggtttagggtttattacggtgtctagtacgacgtaacggtacctaaccgaaaccccgtactacccgtacccgttccgggaccggaacgggacgaccggtaccgttagggtaaacgtaacgttaaaacggttacgttcgggtcggtcgtaacggtacctaccttagttccgttaacgtttccc

SEQ ID NO: 422291 - DNA, 651 bp, Homo sapiens
  misc_feature: GZ8MTXP01A18WZ.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagacgcccggcctccatcctcccgcaggtcctagtcagacgcctcagcatactgatggatacaacttagtttggattcggtacctgacaagaacgccgagggcagtcctaccacaactctgactcttagtttggtactagtccgggccgttccggggtcctgactaggtcaggtcgacaggtggactcgaggctagttacgtatttacactaagaaactcgagacgagtaggtagggacggtcgttagggtaacgggttacgggtttagggggttttaacttacgggtaggtaccgtaagtcggtaacgtaaaccggttacccgtaaacccgtaaaccccgtcgtacccgtacccgttaccgggacccgggaacggtaacccgacggtccgttaggtaacgtaacgttaaacgttacgttcggtaacgctcgacctacgttacttcgttcgttccc

SEQ ID NO: 422292 - DNA, 690 bp, Homo sapiens
  misc_feature: GZ8MTXP01CRE7Q.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagacgccgcctccatctcctgcaggtctagtcagacgcctcagcatactgatggatacaattatggattgacctgacgagaacgcgaggcagtcctaccactaactctagatttctttagttcgggttactaacggtccgggtcccgtcccggggtcccctaggacgtgggttcaggtcgggactaaggtggaacttacgaaggtactaagttaacgtaacttttaacgaacttaaaggaaaactcgaagaacgtaaggtaacgggtagggacgggtacgtaggggttaaccgggttacgggttttagggggtttaacttacgtaggaccgtaagtaaacggtaaaccggtacctaaacccgtaaaacccgtcgttaacccgtaccggttaccgggaaccgggaaacgggtaccgaaccggtcgttagggtaaacgtaacgttaaacggttcgttcggttaacgacgttcgaccacttacttcgttcgtttaacc

SEQ ID NO: 422293 - DNA, 840 bp, Homo sapiens
  misc_feature: GZ8MTXP01DQD2Z.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtctccactctccctgcccgtcaccccgtggagacgccggcctccatcctcctgcaggtctagtcagacgccctaccagactatactgatggaataacaactagtttggagtttggtaacctgacagaacgccgagggcacgtcctacccaactaacctcctagtactttcgttaggttttcgggtttaccgtaaacgtcccgggggtcccccgtttccccccggggggttaccccttagggtaaccgtacgggtttaccgaacgggttacgggcggttaagggtacgggtaacgttaaccggaacggggtaccttaaacggtttaaagtttaaaccgttttttaaaccaaaccgtttaaaagggtaaaaaacttaccggaaaggtaacggtaaaggggtagggttaagggggaacgggttacgggtaaggggtaaacggggtttaacgggggtttttaagggggggtttttaaactttacggttacggtaccgtaaggttaccggtaaccgtaacggttaaaccccgtaaacccgtaaacccccgttagtacccgtaacccggtaaccgggacccggacgggtaacccgaccggtaccgtaacgggttaaacgttaacgttaaaaccggtaacgttacggtcgtcgtccgacccgtaaccgttaacgtttcccg

SEQ ID NO: 422294 - DNA, 658 bp, Homo sapiens
  misc_feature: GZ8MTXP01BJQH1.15.25.C03.1.454.CMB.2.raw
  modified_base (236)..(236): a, c, t, g, unknown or other
  modified_base (391)..(391): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactcctccctgccccgtccaccccgtggagacgcccgcctccatcctcctgcaggtctagtcagacncctcagcatactgatggaataacaattagttggtattcggtacctgacgaagacgccgaggcagtccaccactaactcgtagatttcttagtttgggtactaacgtccggggtcccgtccggggtcccctagtacgtacggttcgagtcgggacnggtggactcgaggtctaagtattactttaacacgttaagaaatcaagagaagggtggtacgggaggtagtagggtaaggttacggtttaggggtttatacgttgatacgtagacgtaacgtaccgtaaacccgaacccgtacgtaccgtaccggttccgggaacgggaacggaccgtacgaccggttacggaaacggttaaacgttaaaaccggttaagttcgggacggtaaccgttacgacccgttaactcggtttccccgtttcg

SEQ ID NO: 422295 - DNA, 653 bp, Homo sapiens
  misc_feature: GZ8MTXP01B6CZP.15.25.C03.1.454.CMB.2.raw
  modified_base (353)..(353): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcaccctggagacgccggcctccatctcctgcaggtctagtcagacgcctcagcatactgatgatactaacttagttgattcggtactgacagaacgcgaggcagtccacacactctagtacttcgtttagtttcggtactacgtccgggtccgttccggggtccccnggtacgtgggtttaccagggttcggaccgtaagggtggtactacggacggtactaagttaaggttaacttttacacgttaaaggtaaaactccgaagtacgtaaggtacgggtagggtacggtacgttagggtaagggttaacggtttagggtttactacgtcgactagtacgaacgtaacggtacctaaacccgaaccgtctaccgtacccggtcggaacggtacggccgtacgcggtaagaacgttaaagttaaccggagttcggacgtcgtacctacgaccttaagttcctttaacg

SEQ ID NO: 422296 - DNA, 700 bp, Homo sapiens
  misc_feature: GZ8MTXP01C0A8Y.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagacgccggcctccatcctcccgcaggtctagtcagacgcctccagcatactgatggatactaactattggattggtacctgacagaacgccgagggcagtctaccacaactcctagactctttagtttgggtacttaacgtccggggtccgttccgggggtccctacggtacgtaggttcgaggtggaccgtaaggtcggatcgaacgggtctaagttaagttaacttttaacgaacgttaagaaaactcgtaagacgaaggaggttagggagggtacgtagggtaagggttacgggtttacggggtttaacttaacggttggacgtagtacggaaccgtaaacggtaccgtaaccgtaaaaccccgacgttacccgtacccggttaccggggaccggaacggggtaacccgaccggtaccgttagggtaaaacgtaacgttaaaaccggacgttcgggtaaggtaccgtcggaacctaccggttacttccgttaacgtttccc

SEQ ID NO: 422297 - DNA, 636 bp, Homo sapiens
  misc_feature: GZ8MTXP01A24EI.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgcccggcctccatcctcccgcaggtctagtcagacgcctcagcatactgatggatacaactattggattggtacctgcagacgccgaggcagtcaccacactctagatcttagtttgggtctaacgtccggccgtccggggtcctgactaggtcagtcggacagtgatcgaggctagtagtattttaacacttagaaatcgagacgaggtaggtagggaagggtcgtagggtaacgggtacgggtttaggggtttaattaacggtggtactagttacgacgtaaacggtaccttaaacccgaaaccccgtactaccgtacccgttccgggacccggtaacgggaaccgaccggtcccgttaaggaaacgtaaacgttaaaccggttacgttcggtaaggtcctaacgaccgtaacccttagttccttcggtttaaccc

SEQ ID NO: 422298 - DNA, 601 bp, Homo sapiens
  misc_feature: GZ8MTXP01BFRH9.15.25.C03.1.454.CMB.2.raw
  modified_base (341)..(341): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagagcctccagcatactgatggatacaacttattggattggtacctgcagaagccaggcagtcctcacactctgatcttatttggtctaagtcgggccgttccggggtcccccngacgtaggttcaggtgctggtgatcgaggtctatagtactttaacactaagaaatcagacaaggtaggtgggaggtcgtaggagggtacggtttaggggtttacttacggttgcgtagtacgtacgtaacggttacctaaacccgaaaccccgtctaccctaaccggttccgggaacccggagggttaccaacggttccgtagggaacgttaaagttaaacggacgttggtcggaactggaccttacgtaacgttcgtcg

SEQ ID NO: 422299 - DNA, 795 bp, Homo sapiens
  misc_feature: GZ8MTXP01D7OYB.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctggtctctggatccagtgggatattgtgatgactcagtcctccactcctccctcgccccgtccaccccgtggacgacgcccggcctccacttcctcctgcgaggttctagtacagacgccctccagactatactagagtaggaactaactaacttagttggtattcggtacctagacaacggaacgccgaggactacgtccaccaacctaaccttcgtagttacttacgttttaaggttttcgggttaccttaaccggtcccggggtaccccggttcccgggggttaccccctaggtaacggttacggttacgtacgggtcgggacgtgggtacggtaacgtaccggagggtacttaaagttaacgtttaaacttttaaccgaacgttaaaggtaaaacctacggaaacggtaaggtaaggggttagggtacggggtacgggttacggttaaggggttaacggggttttaacgggtttttagggtttaacttacggtacgtacgtacggtaaccgtaaccgtaaaccgttaacccgtaaaaccccgtaacccgtacgttacccggtacccgggtccgggaaccggtaacggaccgtaccggttacggtaaaggtaaacgttaaacgttaacgacgtcggtacgccgtacaccgttacttcgttcgttcg

SEQ ID NO: 422300 - DNA, 675 bp, Homo sapiens
  misc_feature: GZ8MTXP01CBATA.15.25.C03.1.454.CMB.2.raw
  modified_base (386)..(386): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcagcatactgatggatacaacttattggattcggtacctgcaggaacgccgagggccagtcctaccacaactcctagtacttctttagtttcgggttactaacgtccggggtccgttcccggggtccccctaggacgtaggttcaggtggacnggtggactcgaggcattagtactttaacactaagaaactcgagcgaaggtaggtgggacggcgttaggtagggttacgggtttaggggttttaacttacgtgtacgtagtacgaaccgtaaacggtaccgtaaacccgtaaaccccgtacgtacccgttacccggttccgggaacccgggaacgggaccgtaccggttacccggttaaaggggaacgttaaaaccggttaaaacggttacggtttcgggacggtcgttaccggaccttaaccgtccgtttaacttcccg

SEQ ID NO: 422301 - DNA, 684 bp, Homo sapiens
  misc_feature: GZ8MTXP01BYD3F.15.25.C03.1.454.CMB.2.raw
  modified_base (245)..(245): a, c, t, g, unknown or other
tcagtctacgtagccacgaccggtgctcgatttagtagtgtagatttgggtttgggggatcaggactcctcagttcaccttctcacaatgaggctccctgctcagcttctggggctgctaatgctctgggtctctggatccagtggggatattgtgatgactcagtctccactctccctcgcccgtcacccctggagagccggcctccatctcctgcaggtctagtcagacgcctccagcatacngatggatacaactattggattggtacctgacagacgccgagggcagtcctaccactaactcctagtattacgtttagttttcgggtacttaacggtcccggggtccccggttccggggtccccctagacgtagggttcaggttcggactggtggactacgaggactagttagtacttttacaactaagtaaaactcgaagacgaagggtggtagggacgggtacgttaggggtaacgggttacgggttttagggggtttaacttacgtaggtacgtagtacgtaccgtaaacggttacccgtaaacccgaaaccccgtctacccgtacccgttcgggaacccggtacgggaccgaccggttacgtacggaaacgttaacgttaaaccggttaacgtcgggtacggtccgtacgcccttaccggtaacttcgtttaaccg

SEQ ID NO: 422302 - DNA, 631 bp, Homo sapiens
  misc_feature: GZ8MTXP01CN7U1.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgccccgtcacccctggagagccggcctccatctcctgcaggtctagtcagacgcctccagcatactgatggatacaactattggattggtacctgcagagccagggcagtctccacaactcctgattctagtttggtctaacgtcgggcctccccggggtcctgacgtggttcaaggttggcaggtgatcgaggctatagtatttacactagaatcgagacaggagtagggaggtcgtagggtagggttacgggttttagggggggttttactttacgtcgtacgtagtcgacgtaacggtaccctaaacccgtaaaccccgtacgtacccgtacccggttaaccgggacccggacggggtaacccgaccggtacccgtagggaaacgttaacggttaaaaccgtaacggttggtaacggtcgttacggaccctaaccgttaactttcccg

SEQ ID NO: 422303 - DNA, 594 bp, Homo sapiens
  misc_feature: GZ8MTXP01DYKAA.15.25.C03.1.454.CMB.2.raw
  modified_base (415)..(415): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagagccggcctccatctcctgcaggtctagtcagagcctccagcatactgatggatacaactattggattggtacctgacagaacgccgagggcagtctccacaactctgtatctttagtttggttactacgtccgggcctccggggtcccctggactaggttcaggtcggctaaggtgatcgagggctaagtagtactttacacttaagaaaatcgagnaaggtaggtggaggcgtaggagggtacggtttaggggtttatacgtggactagtcgaacgtaacggtacctaaacccgaaacccgtctacccgtaccgttcggggaacccggaagggaccacggccgtagggaagttaacgttaaacgacgtggacggcgtcgcacctaagttcgttcg

SEQ ID NO: 422304 - DNA, 645 bp, Homo sapiens
  misc_feature: GZ8MTXP01B6F2I.15.25.C03.1.454.CMB.2.raw
  modified_base (243)..(243): a, c, t, g, unknown or other
  modified_base (624)..(624): a, c, t, g, unknown or other
tcagtctacgtagccacgaccggtgctcgatttagtagtgtagatttgggttgggggatcaggactcctcagttcaccttctcacaatgaggctccctgctcagctcctggggctgctaatgctctggtctctggatccagtgggatattgtgatgactcagtctccactcctccctcgccccgtccaccccgtggacgacgcccggcctccatcctcctgcaggtctagtcagacgcctcancatactgatggaatactaattagttggattcggtactgacgagaacgcgaggcacgtccaccaacactctagtattcgttagtttggttactacggtccggtccgtcccgggtccctacggtacgtcggtttcgaggtacgacgtaaggtgtaactcgaggtactaagttaacgttaactttaacaactaagtaaatcgaaagagtaaggtaggtggacggtagtagggtacggttagggtttagggtttatacgtagacgtagtacgtaacgtaaccggtacctaaacccggaaccctacgttcccgtaccggtcgggaacccggaacggttacgaccgttacgtaagggtaacttaacggttaacgagttcggacgtcncgacttactaacgttcgttcc

SEQ ID NO: 422305 - DNA, 639 bp, Homo sapiens
  misc_feature: GZ8MTXP01BJG1D.15.25.C03.1.454.CMB.2.raw
  modified_base (334)..(334): a, c, t, g, unknown or other
  modified_base (350)..(350): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcagcatactgatggatacaacttattggattggtacctgcagaagccaggcagtctcacactctgatctatttggtctaagtcgggcctcggggtcccccngacaggttcagtggcngtgatcgaggctatagtatttacatagaaaatcagacgaaggaggtagggaggcgtagggtaagggttacggggttttagggggtttaatttaacgtggtacctagttacggaaccgtaaacgggttaccctaaaacccgtaaacccccgtattaccccgtaacccggtttcccggggaaccggtaacgggttaacccgaccggttacccgtaagggaacgttaaacgttaaaccggacggttaacggtcgggtcctacggtacccttaccgtaactttccgttaaccg

SEQ ID NO: 422306 - DNA, 589 bp, Homo sapiens
  misc_feature: GZ8MTXP01BWA8K.15.25.C03.1.454.CMB.2.raw
  modified_base (481)..(481): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccgaggcagtctcacaactctgatctagtttgggtctagtcggcctccggggtcccctgactagggttcaggtggctaaggtgggatcgaggctatagtatttacactagaaaatcgagacgaaggagtgggagcgtaggagggttacgtttggggtttaacttacgtgctagtggacaaggtaccttaaccgaaaccccgtntaccgtaaccgttccgggaaccgaacggggacccaaccggccgttagggaacgttaacgttaaaaccggagttgggtacgggtctacgccgttactaacttcgtttcg

SEQ ID NO: 422307 - DNA, 709 bp, Homo sapiens
  misc_feature: GZ8MTXP01ERYO8.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactctccctgcccgtcacccctggagacgcccggcctccatcctcctgcaggtctagtcagagcctccagcatactgatggatacaactatggattggtacctgcgaagacgccgaggctagtcctccactaactccgtgtactcgtttagttttcgggtaccttaacgtccggggtcccgttccgggggtcccccctggtacgtaggttccgaggtcggactggtagggacttacggaggtactaaagttacgttaaacttttaaccgaacgttaaagaaaacgttacgaacggtacgtaaagggagggttacggggtagggtaccggttagggtacgggttaacggggtttaggggttttaaggttacgtggtaccgtaagttacgtaaccgtaacgggttaccctaaacccgaaacccgtacgtaccgtacccggttacgggcccggtaagggaccaccgggttaccgtagggtaaagttaaccgttaaacgaacgttggtacgggccttcgaccgttacctaacgttccgtttccg

SEQ ID NO: 422308 - DNA, 655 bp, Homo sapiens
  misc_feature: GZ8MTXP01C1YQ2.15.25.C03.1.454.CMB.2.raw
  modified_base (415)..(415): a, c, t, g, unknown or other
tcagtctacgtagccacgaccggtgctcgatttagtagtgtagatttgggttggggtgatcaggactcctcagttcaccttctcacaatgaggctccctgctcagctcctggggctgctaatgctctgggtctctggatccagtggggatattgtgatgactcagtatccactctccctgcccgtcacccctggagacgcccggcctccatctcctgcaggtctagtcagacgccctccagcatactgatggaatacaactattggattggtacctgcagaagccgagggcagtctaccacaactcctgatttctagtttggttactaacgtcgggtacccgtccccggggtcctggacagggttcaaggtggcgtagtgggatcgaggctatagtatttacactagaatcaganagtagtggagtcgtaggtagggttacggtttaggggggtttacttacgtagtacgtagttgaccgtaacgggtacctaaacccgtaaaccccggtaacttaccggtaaacccggttaaccggggaaccgggttaaccgggggtaaccaaccgggtacccgtaagggttaaacgttaaacggttaaaaccggtaaccgtggttaacgggacctacggttaccgtaaccttaacggtttccg

SEQ ID NO: 422309 - DNA, 612 bp, Homo sapiens
  misc_feature: GZ8MTXP01C0YKU.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctcgcccgtcacccctggagacgccggcctccatctcccgcaggtctagtcagacgcctcagcatactgatggatacactattggattggacctgcagagccgaggcagtctccacactctgatctagtttggtctagtccggccgtccgggtccctgactaggtcagtggacagtggatcgaggcagtagtactttacactagaaatcgagacgagaggtggaaggcgtaggtaggtacggtttacggggtttattacggtgtactagtacgtacgtaaacggtccgtaaaccgaaaccccgtattaccgtacccgttaccgggaccggtaacgggtaccgttaccgggtccgttaagggtaacgtaacggtttaaaaccggacgttacggtcgggcttaacggcctaccgttacttaaccgttcgtttaacc

SEQ ID NO: 422310 - DNA, 644 bp, Homo sapiens
  misc_feature: GZ8MTXP01AT3QW.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagacgcctcagcatactgatggatacaacttattggattcggtacctgacaaggacgccgagggctacgtcctaccactaacctcctagtattcgtttagtttgggtactaacggtccgggcccgtccggggtcccctggacgtggttcgaggtcgggacgaaggtgggactacgacgggtctaagttagtactttacacgtaaagaaaatcgaagagaaggtaggtacgggacggtacggttagggtaaaggggttacgggtttagggggttttaaacttgttacggacctacggttagaacgtaacgggtacctaaaccgaaacccgtactaccgtaccgtccggaacggacggccgacgcgtagaagttaacgttaaacgacgtggtacggctcgacttacctaagttcgttcg

SEQ ID NO: 422311 - DNA, 586 bp, Homo sapiens
  misc_feature: GZ8MTXP01BCB1V.15.25.C03.1.454.CMB.2.raw
  modified_base (475)..(475): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatcctcccgcaggtctagtcagagcctccagcatactgatggatacaactattggattggtacctgcagaagccgagggcagtctccacaactcctgatctagtttggtctagtccggccgtccggggtcctgacaggttcagtgacagtgatcaggctatagtatttacactagaaatcagcaggagtagggaggcgtaggagggtacggttaggggtttattacggtgactagtcgacgtaaggttacctaaccgtaaaccccgtntacccgtaccgttccgggccggaacgggacgacggtcccgttagggaaacgtaacgttaaaacggacgttaggtcggacgttcggacctaccgttacgttccgttcgttcc

SEQ ID NO: 422312 - DNA, 658 bp, Homo sapiens
  misc_feature: GZ8MTXP01D9K85.15.25.C03.1.454.CMB.2.raw
  modified_base (230)..(230): a, c, t, g, unknown or other
  modified_base (531)..(531): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcaccctggagacgccggcctccatctcctgcaggtctagtcagngcctcagcatactgatggatacaactattggattggtacctgacagacgcgaggcagtcctacacaactcctgtatcttagtttggttactaacgtccggggtccgtcccggggtccccctaggtacgtaggttcgaggtcgggactgggtgacgtcgaggtacagttaagttacttttaacgactaagaaactcaagactaaggaggtaggacggtacgtagggtaacgggttacggttttaggggtttaacttacgtgtactaagtacgacgtaacggtacctaaacccgaaacccgtntacccgtacccggttacggggaacccgggtacgggaaccggtaccggttaccggtaagggtaaacgttaaacgttaaacggaaacgtttgggacgtcgtcggtaccaccgttaacgttccgtttccg

SEQ ID NO: 422313 - DNA, 613 bp, Homo sapiens
  misc_feature: GZ8MTXP01CUUUD.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagagcatccagcatactgatggatacaactattggattggtacctgacagaagcaggcagtctccacaactctgattctagtttggtctaacgtccgggtccgttccccggggtcctaggacgtaggttccaaggtggcaggtgatcgaggctataagtatttacactagaaatcgagacgaagaggtaggaggtcgtaggtaagggtacgggtttaggggggtttaattaacggttgacgtagtacgtacgaacgttaccctaaaccgaaaccccgtattacccgtacccgttaaccggggcccgaagggtaccgacggtaccgtagggaaacgttaacgttaaaacgtaacgtcggtaacggtcgtacactaaccgttgttccg

SEQ ID NO: 422314 - DNA, 632 bp, Homo sapiens
  misc_feature: GZ8MTXP01AOGCT.15.25.C03.1.454.CMB.2.raw
  modified_base (516)..(516): a, c, t, g, unknown or other
  modified_base (521)..(521): a, c, t, g, unknown or other
  modified_base (554)..(554): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccaggtggggatattgtgatgactcagtactccactctccctgcccgtcaccccgtggagacgccggcctccatcctcctgcaggtctagtcagacgcctccagcatactgatgatactaactgttggattcggtacctgacagacgccgagggcctagtcctaccaactaactcctgtactttcgttagtttcgggttactaacggtccggggtacccgttcccccgggggtcctaggtaaccgtaggttccgaaaggttcgggctagggtacggatcggaaggctaagttacgttaatttacaacgtagaaactcgagacgtaggaggtggaaggtcgtagggtagggttacggtttggggggttaacttacgngtacngtacgacgtaacggtaccctaaaccaacccgtnacccgtcggtcggaccggaggacacggtcaaggagttaacgttaacgaacgttgcgtcgtacgactaaccttgttccg

SEQ ID NO: 422315 - DNA, 673 bp, Homo sapiens
  misc_feature: GZ8MTXP01D1DJV.15.25.C03.1.454.CMB.2.raw
  modified_base (438)..(438): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcaccctggagagccgcctccatctcctgcaggtctagtcagacgcctccagcatactgatggatacaactattggattggtacctgcagaacgccgagggacagtcctccacaactctagtatcttagtttgggttacttaacgtccggggaccgtcccgggggtcccctggacgtacggttcgaggttgggacgtaaggtgggtaactcgagggctaagttaacgtaattttaacaacgttaaagtaaaancgaagacgaaggtaagggtgggaaggtcgtagggtagggttaacggggttttagggggtttaattaacgtgtacgtagtacgtacgtaaacggttacctaaacccgtaaaccccgtacgtacccgtaccggttccgggaaccgggtaacggggaccgtaccggttccgtaaggggtaacgttaaacgttaaacggacgttggtacggtcgttcggaccttaactcttcgtttccg

SEQ ID NO: 422316 - DNA, 702 bp, Homo sapiens
  misc_feature: GZ8MTXP01BILI3.15.25.C03.1.454.CMB.2.raw
  modified_base (267)..(267): a, c, t, g, unknown or other
  modified_base (279)..(279): a, c, t, g, unknown or other
  modified_base (678)..(678): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctcgcccgtccaccccgtggagacgcccggcctccatcctcctgcaggtctagtcagacgcctcagctatactgataggatacaacttntggatcggtacngacagacgcgaggcagtcaccactactctagtacttacttagtttcgggtacttaacggtcccgggggtccccgttcccgggggtcccctacggtacgtacgggttacgacgggttcgggaccgtaagggttcggaacgtcgaaacgggtactaaagtttaaacgtttaaactttttaaacccgaaagttaaacggtaaaaactcgaaaggtaccgtaaaggggtacgggttaggggtaacgggtccgttagggggtaacgggtttacggggttttaggggtttaacgttacgtcggtaacgtagttacgaccgtaaaggtaaccctaaacccgaaacccgtctacccgtaccgtcgggcgggtaacggcaccggagtacggaattaaacgttaaccgngtcgtgcacgacacctgtttctcg

SEQ ID NO: 422317 - DNA, 612 bp, Homo sapiens
  misc_feature: GZ8MTXP01DBFKS.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtggggatattgtgatgactcagtctccactctccctgcccgtcacccctggagacgccggcctccatctcctgcaggtctagtcagacgcctccagcatactgatggatacaattgtggattggactgacagaacgcgaggctagtcctcaacactctgacttcttagtttcgggttactaagtccgggccgttccgggtcccctggacgtacggttcgagtgggactggtgggaactcgacgggactagtagttaactttacaagttagaaatcagacgagtaggtggacggcgtaggaggtacgggttttggggttaattcgttggacagtacggacgtaacggtaccttaaaccgaaccccgtatcccgtaccggttccgggaaccggacgggaccgtaccgacgtaggggaaacttaacgttaaacgttcgtaaggcgtcgtagacttaccgtaattcggttcc

SEQ ID NO: 422318 - DNA, 674 bp, Homo sapiens
  misc_feature: GZ8MTXP01AT1GX.15.25.C03.1.454.CMB.2.raw
  modified_base (257)..(257): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagacgcctccagcatactgatgatacaatnttggattggtacctgcagagccagggcagtcctaccacaactctgtatcttaagtttgggttactaacggtccggggtcccgttcccgggggtacccctaggtacgtagggttcccgaagggttcgggacgtaagggtcggtaacttaccggaaggggtcctaaagttaacggttaaacttttaacgaacgttaagaaaaacttcgaaggtacagggaggttgggaggtcggtagggtaagggttacgggttttaggggtttaacttacgtaggtacctagtagtaaccgtaacggtacctaaacccgaaccccgtatacccgtaaccgtcgggaaccggtaacgggaccaccggaccgtaggaacgttaacgttaaacgacgtggtacgtcgacgtacttacctaagttcgttccg

SEQ ID NO: 422319 - DNA, 609 bp, Homo sapiens
  misc_feature: GZ8MTXP01DRP6Q.15.25.C03.1.454.CMB.2.raw
  modified_base (535)..(535): a, c, t, g, unknown or other
  modified_base (589)..(589): a, c, t, g, unknown or other
  modified_base (603)..(603): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtctccactctccctgcccgtcaccccgtggagacgccggcctccatcctcctgcaggtctaagtcagagccctcagcatactgatggataacactattggattggacctgacagacgcgaggcagtcaccacaactctagactttcgttagttttgggttacctaaggtccggggtcccttcccccgggggtccctaggacgtacggtttcgaaacggtgggcgaaggtcgggacttcgaaggtcaagttagtaattttaacacttaagaaaattcaagacgagaggtggacggtgtggtagggtacgggttttaggggggtttaattacgtgactagtgacgtaacggtaactaacctaaacccgtancctaccgtcgggcgacgggacacggacgtaggaacgttattaaaacgcttaggnggctcggctaacgnttaacg

SEQ ID NO: 422320 - DNA, 600 bp, Homo sapiens
  misc_feature: GZ8MTXP01ASL8N.15.25.C03.1.454.CMB.2.raw
  modified_base (276)..(276): a, c, t, g, unknown or other
  modified_base (400)..(400): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagacgccggcctccatctcctgcaggtctagtcagacgcctccagcatactgatggatacaactatttggattgaataccngacagagccaggggcagtctccaacacgtcctgattcgtatttgggtctaagtccgggcccctccgggggtcctgcgtaggtcaggtgcagtgatcgagcatagtatttacactagaatgacgnagagtaggcggctaggtagggtacggggtttaggggtttaatcgttggctaagtcgtacgtaacggtacctaaccgtaaaccccgacgtccgtaacccggttccgggacccggtacgggttaccgtaccgcccggttagggacgttaacgttaaaaccggaaccgttggtcgggaccttcggtaacccgaacccgtaacg

SEQ ID NO: 422321 - DNA, 381 bp, Homo sapiens
  misc_feature: GZ8MTXP01BHWFK.15.25.C03.1.454.CMB.2.raw
  modified_base (180)..(180): a, c, t, g, unknown or other
  modified_base (353)..(353): a, c, t, g, unknown or other
  modified_base (376)..(381): a, c, t, g, unknown or other
tcagtctacgtagccacgaccggtgctcgatttagtagtgtagatttgggtttggggtacgatttgatgttacctgatgcttagaggcttttcctggaagcagggcatttgttgcttcagcaccgtagtgcctcgtcatcacgcctcagccttgattttccggatttgcctggaaaaccngcctacacgcttaaaccgggacaaccgtcgcccggcaacatagccttctccgtccccccttgcagtaacaccaagtacagaatattaacctgttcccatcgactacgccttcggcctcgcctagggtcactcaccctgccccgattaacgtgacaggacccttggtcttcggngagcggctggcaaggcgcatagnnnnnn

SEQ ID NO: 422322 - DNA, 649 bp, Homo sapiens
  misc_feature: GZ8MTXP01EM8VO.15.25.C03.1.454.CMB.2.raw
  modified_base (278)..(278): a, c, t, g, unknown or other
  modified_base (392)..(392): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtccacccctggagacgcccggcctccatcctcctgcaggtctagtcagacgcctccagcatactgatgatactaactagttggattggtaccngacagaagccgagggcagtcctacacctaactcgtagtactactttagttttcggtactaaggtcccggggtcccgtccggggtccccctggtacgtaggttccaggtcggacngtgatcgagctatagttactttacgataagaaatcgagagtaagggagtagggaaggcgttagggtaaagggttacgggttttagggtttaacgtttacgtgtaccgtactaggtaaccgtaaacggttaccctaaacccgaaaccccgtcgtacccgttcccggtaacgggccgggaaacgggacctacggacgtaacgggtaaattaaagttaaaccgttagtaacggtgaactcgacactaacgttcgttaacg

SEQ ID NO: 422323 - DNA, 665 bp, Homo sapiens
  misc_feature: GZ8MTXP01BH4XG.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtgggatattgtgatgactcagtctccactcctccctcgccccgtccacccgtggagacgcccggcctccactcctcctgctaggtctagtcagacgcctcagcatactgatggaactactaattgttggattcggtacctgacagaacgcgaggcagtcctccaactactctagtattcttagtttcggtactaagtccgacgtcccgtcccggggtcctgacgtggttcgaaggttcgcgtaggtgattacgacgggtatattaacgttatttaactaacgtaagtaaacgtacgaagagaggtaagggtagggtagggtacgtagggtaagggttacggggtttaggggggtttacgtttaacgtcgtacgtagtacgtaacgtaacgtaaccgtaacccgtaaaccccgtactaccgtacccgtccggtaccggacggtaccgaccggtacgtacggaacgttaacgttaacgtaacgtacggtcggtgtacccccccccgataaccgttaacgttcg

SEQ ID NO: 422324 - DNA, 623 bp, Homo sapiens
  misc_feature: GZ8MTXP01AX0KL.15.25.C03.1.454.CMB.2.raw
  modified_base (255)..(255): a, c, t, g, unknown or other
  modified_base (608)..(608): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctcgcccgtcacccctggagagcccggcctccatctcctgcaggtctagtcagagcctccagcatactgatggataanaacttattggattggtacctgacgagaacgcagggcagtcctaccacaactcctgattcttagtttcggggttactaacggtccggggtcccgtcccgggggtcccccctaggtacgtagggttccgaggtcgggaccgtaagggtgggtactcgacgggtactaagtaagttacttttaacaatagtaaaatcagacgagaggtgggaggcgtaggaggtaggtttaggggtttaattcgtagctagtgacgtaacggtacctaaccgaaacccgtcaccgtacccgtcggaaccggaggaccgacgttccgtaggaacgttaacgttaacgacgttgggtacgcgtcgacncctaattcgttaacg

SEQ ID NO: 422325 - DNA, 609 bp, Homo sapiens
  misc_feature: GZ8MTXP01AWRJT.15.25.C03.1.454.CMB.2.raw
  modified_base (250)..(250): a, c, t, g, unknown or other
  modified_base (264)..(264): a, c, t, g, unknown or other
  modified_base (469)..(469): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactctccctgcccgtcacccctggagacgcccggcctccatccgtacccgtcaggttctagtcagacgcctcagcatactnatggatactaactnttggattggacctgacagacgcgaggcacgtctaccaacaactccgtagtacttcgttagttttcgggtacttagtccgggtccgtccggggtcctacggacgtaggtcgagtggacgtacgtggactcgagggctagtagtatttaacatagaaatcgagacaggagtacggagcgtaggtaggtacggttagggttatacggngtacgagtacgacgtaacgtactaaccgaacccgacgtccgtaaccgttccgggacgaacggtaccgcggtacgacggtaaacgtacgttaaacgcggttacgaacgggtctcgtaccacgttcttccggttaacttccg

SEQ ID NO: 422326 - DNA, 767 bp, Homo sapiens
  misc_feature: GZ8MTXP01AJM8W.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggattattgtgatgactcagtctccactctccctcgcccgtcacccgtggagacgccgcctccatctcctgcaggtctagtcagacgcctcagcatactgatggataactaacttagttgattggtacctgacgaagaacgcgaggcacgtcctaccaactactctagatttcgtttagtttgggttactacgtccggggtcccgttacccgggggtcccctggacgttaggttccgagggtacggacgtaagggtggtaacgtcggaacggtacttaaagttaaaggtttacttttaaacgaacgttaagtaaaactccggaaggagtaaggtagggttagggacgggtaccgttaggggtaaccggggtttaggggtttttacgggggttttaacttacggttaggtaccgtaacggttaccggaaaccggttaacggttaacccccttaaaacccgaaaccccccggttacgttacccccggttaacccgggtttccccgggggaacccgggaacggggttaacccggaccggttccggtaaagggtaacgttaaaccgttaaacgggttacggttcgggtacgaacggtccgaccgttaccttcggttcccttcccg

SEQ ID NO: 422327 - DNA, 644 bp, Homo sapiens
  misc_feature: GZ8MTXP01AYKM1.15.25.C03.1.454.CMB.2.raw
  modified_base (280)..(280): a, c, t, g, unknown or other
  modified_base (302)..(302): a, c, t, g, unknown or other
  modified_base (553)..(553): a, c, t, g, unknown or other
  modified_base (616)..(616): a, c, t, g, unknown or other
  modified_base (622)..(622): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaagtggggatattgtgatgactcagtctccactcctccctcgcccgtcaccccgtggagacgcccggcctccatcctcctgcaggtctagtcagacgcctcagcatactgagtgatacaacttagtggattcggtaccngcagacgcgaggcagtcaccanactctgtactcttagtttggtactaggtccggtccgtccggtccctggactggttcaggtcggactggtaggactacgaggtctaaggttaacttaacttttaaccagttaagaaaacgtcgaagtcgaagggtaggtaggggtacggtacggtagggttaaggggttaccgggttttaagggggttttaacttacgtagggtacctagttacgggaacgtaaccgggttaccttaaacccgaaacccgtntacccgtacccgttcgggaacggtacggaccgccgacgtacggaattacgttaaacgacgttngggtcncgaccttctaattcgttaaccg

SEQ ID NO: 422328 - DNA, 657 bp, Homo sapiens
  misc_feature: GZ8MTXP01AGQTC.15.25.C03.1.454.CMB.2.raw
  modified_base (219)..(219): a, c, t, g, unknown or other
  modified_base (642)..(642): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcaccccgtggagacgccggcctccatcctcccgnaggtctagtcagacgccctcagctatactgatggatacaacttagtttggattcggtacctggacaaggaacgcccgaagggcacgtcctaccaacaactcctagtacttcgttagtttgggtactacggtccgggtcccgttccgggggtcctaggacctagggttccagggttcggactaggttcgtaatccgaggtctaagttaagtactttaaaccattaagaaaactcgaagacgaaggtaggtgggacggtacgtagggtaacgggttacgggtttaggggtttactacggttggactagtacgtacgtaaacggtcctaaacccgaaaccccgtatcccgtaaccggtccggacggaacggccacggtcgttaggaaacgtaacgttaaaccgagttcggtaagcgaacacctacncttcgttcgttaacc

SEQ ID NO: 422329 - DNA, 695 bp, Homo sapiens
  misc_feature: GZ8MTXP01BB91P.15.25.C03.1.454.CMB.2.raw
  modified_base (376)..(376): a, c, t, g, unknown or other
tcagtctacgtagccacgaccggtgctcgatttagtagtgtagatttggggttggggagtcaggactcctcagttcaccttctcacaatgaggctccctgctcagctcctggggctgctaatgctctgggtctctggatccagtggggatattgtgatgactcagtctccactctccctgccccgtcacccctggagagcccgcctccatctcctgcaggtctagtcagacgcctccagcatactgatggatacactagtggattcggtacctgacagaagccagggcagtccaccacaactctagtattcgtatttgggtactaacgtccgggaccgtccgggtccccctagtacgtacggtctaaggcgggtcngggttaggatcgagggctaagtaggtttactttaacgacgtaagaaaacgtcgaaggtacggtaaagtagggttagggacggggtacttaggggtaacgggttaccgggggtttttaaggggtttatttaaccgtggaccgttaggttaacggaccgttaaacgggtaccttaaaaccccggaacccgtactaccgtacccggtttaccgggaacggtaacgggttaccaccgggttaccgtaggggtaaacgttaaaccgttaaacggttaccgtgggttcggaacttcccggtacaacctaacggtttcctttccgg

SEQ ID NO: 422330 - DNA, 744 bp, Homo sapiens
  misc_feature: GZ8MTXP01ESPYI.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctcgcccgtcaccctggagcgccggcctccatcctcctgcaggtctagtcagacgcctaccagcatactgataggatactaacttagttaggattcggtacctgacgaagaacgccgagggcacgtcctaccaactactctagtactctttaggtttcgggttactacggtccggggtcccgttcccgggggtcccctaggtacgtaggggtttcacggggttacggacgtaagggtgggtaaccgttcggaacgggtaccttaaaggttaacggtttaaacttttaaaccgaacgtttaaagaaaacgtacaaggacgtaaaggggtagggttaggggagggttacggttaggggttaacgggggtttacgggttttaagggggttttaactttacggtggtaacctaaggtcggtaaacgtaaccggttaaccttaaacccggaaacccgtcgtacccgtacccggttcggggaaccggtaacgggttaccaccggttcgtaacggtaaagttaacgttaaaccgacggttggacggtctacgacttaacctcgttcgttaacg

SEQ ID NO: 422331 - DNA, 575 bp, Homo sapiens
  misc_feature: GZ8MTXP01CSH9A.15.25.C03.1.454.CMB.2.raw
  modified_base (307)..(307): a, c, t, g, unknown or other
  modified_base (339)..(339): a, c, t, g, unknown or other
  modified_base (345)..(345): a, c, t, g, unknown or other
  modified_base (350)..(350): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagacgcctcagcatactgatggatacaactatgattggtactgcagaagcaggcagtctcacactctgatctattgggtntagtcggccgtcgggtccccctgactggttcnggtgcngtgancaggctatagtatttacactagaaatcagtacagagtagggaggtcgtagtaggtacgggtttaggggtttaagtttacgtggtctagtcgacgtaacggtacctaaacccgaaaccccgtctaccggtaccgtccgggtaaccggaacgggaccgtacgcccgttaggaacgttaaaggttaaacgaacgtcggtacgtcgtcgcgttaacctgttaacgttcc

SEQ ID NO: 422332 - DNA, 697 bp, Homo sapiens
  misc_feature: GZ8MTXP01EVABT.15.25.C03.1.454.CMB.2.raw
  modified_base (400)..(400): a, c, t, g, unknown or other
  modified_base (660)..(660): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgccccgtcacccctggagacgcccggcctccatcctcctgcaggtctagtcagacgccctccagcatactgatggataacaacttagttggattcggtacctgacaagaacgccgagggctacgtctaccactaactcctagtacttctttagttttcgggtacttaacggtccggggtcccgtccggggtccccctggtacgtaggttcaggtcggacnggtggactacgaggtactaagtagttaactttacaataagaaaatcgaagacgtaaggaggtaggaacgtacgtagggtaacgggttacgggttttaggggttttaacttacggttgacgtagtacggtaaccgtaaacggttaccctaaaacccgtaaaccccgtagttaccccgtaacccggttccggggaacccggtaacgggttacccgaccggttaccgtaagggtaacgttaaacgttaaaccggacgttgggnggtaaccgttcggacccttactaacgtttcgtttccg

SEQ ID NO: 422333 - DNA, 634 bp, Homo sapiens
  misc_feature: GZ8MTXP01E0NUO.15.25.C03.1.454.CMB.2.raw
  modified_base (259)..(259): a, c, t, g, unknown or other
  modified_base (273)..(273): a, c, t, g, unknown or other
  modified_base (374)..(374): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagagccggcctccatctcctgcaggtctagtcagagccctccagcatactgatggatacaactnttggattggtaccngcagaagccagggcagtcctcactaactcctagactcttagttttgggttactaacgtccggggccctccgggggtccccctgacgtaggttcaggtggcnggtggatcgaggctatacgtattttacacttagaaatcagcgaaggaggtcgggaggcgtagggacgggttacgggtttgggggtttaacttacgtgtagtacgtgacgtagttcggtaaccttaaacccgaaaccccgtatacccggtaacccggttccgggaacccgggagggaacccggacgtaccggtagggaacgttaaacgttaaaacggtaacgtgggttaacgggcttacggacccgtaaccttcgtttccg

SEQ ID NO: 422334 - DNA, 649 bp, Homo sapiens
  misc_feature: GZ8MTXP01BDUDO.15.25.C03.1.454.CMB.2.raw
  modified_base (359)..(359): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcaccccctggagagccggcctccatctcctgcaggtctagtcagagcctccagcatactgatggatacaactattggattggtacctgcagaagccaggcagtctccacaactcctgatctatttgggttactaatcgggcctccgggggtccccctggactggtcagtcggcnggtggatcaggcaatagtactttacgactaggaaaactcgagcgagaggtggaggcgtagagggtacggtttagggggtttaacttaacgttggactagttcggaccgtaaagggtacccttaaaccgaaaacccccggtaacttacccgaaccccgtttccggggaaccccggtaacgggggaacccaacccgggacccgttaggggaacgttaaacgttaaaacgggttaaacccgttgggtacgggtaaccgttaggtacccaaccgtaactttccgtttaaccggg

SEQ ID NO: 422335 - DNA, 627 bp, Homo sapiens
  misc_feature: GZ8MTXP01DKUB0.15.25.C03.1.454.CMB.2.raw
  modified_base (302)..(302): a, c, t, g, unknown or other
  modified_base (340)..(340): a, c, t, g, unknown or other
  modified_base (360)..(360): a, c, t, g, unknown or other
  modified_base (403)..(403): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagagcccggcctccatctcctgcaggtctagtcagacgcctccagcatactgatggatacaacttattggattcggactgacagaagcgaggcagtcaccacactcngtatcttagttggtactagtccggccgtccgggtcccngactggtcaggtgactggtnatcgagactaagttaacgttatttaacaagtagaaaatcaagnaagaggtggaggcgtaggagggtaggtttaggggtttattacgtagacgtaagtcggaactaaaggtaccttaaaacccgaacccgtacgtaccgtaccggttccggaaccggtaaacggggacctaaccgggttcccgtaaaggggtaacgttaaacgttaaacccgggttaacttgggttaccggcttacgggaccccttacgttaaccgttcgtttaaccg

SEQ ID NO: 422336 - DNA, 592 bp, Homo sapiens
  misc_feature: GZ8MTXP01CZ4WV.15.25.C03.1.454.CMB.2.raw
  modified_base (362)..(362): a, c, t, g, unknown or other
  modified_base (368)..(368): a, c, t, g, unknown or other
  modified_base (400)..(400): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatcagtggggatattgtgatgactcagtctccactcctccctcgcccgtcaccccgtggacgacgccggcctccatctcctgcaggtctagtcagacgcctccagcatactgatggaatactaacttattggattcggacctgcaagacgcaggcacgtctcactaactctagacttcttagtttggtactaacgtccggccgtccggggtccctggacgtgtcngtggcngtgactgagtctaatagttacttacacgtaanaaagtcgagtacgaaggtgggtaggaacggtgagggtaggttacggtttaggggtttacttacgtgactaggtacgacgaacgttaccaaacccaaccgtactaccgtaccgtccgggaacggtaacggacgtacgacgtaaggacgttaaagttaacgttacgtggagtctcgacgttaccttgttcgtcg

SEQ ID NO: 422337 - DNA, 635 bp, Homo sapiens
  misc_feature: GZ8MTXP01CMCDD.15.25.C03.1.454.CMB.2.raw
  modified_base (385)..(385): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctggtctctggatccagtgggatattgtgatgactcagtctccactcctccctcgcccgtccaccccgtggacgacggcccggcctccactcctcccgtgcgtaggtctagtcagacgcctcagcatactagagtggaactactaacttagttagtagtcgtactgacgagacgcgaggcacgtcaccactaactctagtattacgtttagtttggtactacgtccggtccgtccggtccctgacgtgtcgaggtacgcnggtgactacgaggactaagtagttaacttaacaacgtaagtaaacgtcgagagtaggaggtaggaggtacgtaggtacgggttacgggtttaggtttacggttacgtgtacgtagtacgtaacgaacgtaccgtaaacccgaaacccggtactacccgtaccggtccggaaccggtaacggacgtaccgcggtaaacgtacgttaaacgttacgttaacggtcggtgaactacggccactcgttcgttcg

SEQ ID NO: 422338 - DNA, 658 bp, Homo sapiens
  misc_feature: GZ8MTXP01EL9U0.15.25.C03.1.454.CMB.2.raw
  modified_base (390)..(390): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagccctccagcatactgatggatacaattagttggattggtacctgacaggaagccgagggcacgtcctccaacaaccttcctgtacttcgtttaagttttcggggtacttaacgtccggggcccttcccgggggtccccctggacgtaggttcaggtggcngggtgactcgagggtactaagtagttaacttttaacaacgttaagaaaacgtcgaagacgaaggtagggttagggacgggtgttagggaagggttacgggttttaggggtttaattacgttgccgtaagttacgacgtaaacggtacctaaaacccgaacccggtactaccgtaccggtccgggaaccggtaacgggaccgaccggttacgtagggtaacgttaacgttaaacgaacgtgtacggcgtacaccgactaacgttcttcg

SEQ ID NO: 422339 - DNA, 597 bp, Homo sapiens
  misc_feature: GZ8MTXP01BZF8E.15.25.C03.1.454.CMB.2.raw
  modified_base (284)..(284): a, c, t, g, unknown or other
  modified_base (353)..(353): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagcccggcctccatctcctgcaggtctagtcagacgcctccagcatactgatggatacactatgatgtactgcagagcaggcagtcncacactctgatcttagtttggtctagtccgggtccgtccggggtcccctggactaggttcaggtcggcnggtggactcgaggctattagtactttacatagaaactcagacgaaggaggtagggaggtcgtagggtagggttacggtttaggggtttattacgtgacgtagtgacgtaacggtacctaaaccgtaaacccgtagtacccgtaccggttccgggaaccggaacggggacctaccggttccgtagggtaacgttaaacgttaaacggacgtaaggtcggcgttcggaccttaccgtcttcgttcg

SEQ ID NO: 422340 - DNA, 715 bp, Homo sapiens
  misc_feature: GZ8MTXP01BFK18.15.25.C03.1.454.CMB.2.raw
  modified_base (223)..(223): a, c, t, g, unknown or other
  modified_base (286)..(286): a, c, t, g, unknown or other
  modified_base (414)..(414): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtcctccactcctccctgcccgtcaccccgtggacgacgcccggcctccatcctcccgntaggtctagtcagcgcctcgagctatactgagtggaatactaacttagttggattcggtaccngacagaacgccgagggctacgtcctaccactaacctcctagtacttaccgtttagtttcggttacctaacgtccgggggtacccgttccggggtccctaggaccggtacggttcgaggtcggtaacgngtcggatacgaaggctaagtttaacggtaaatttttaacaactaagtaaaacgtcgagaacgtaggtagggtagggtacggtacggtaggttaacggggtttacgggtttaggggtttaacgttacggtgtacgtaagtacggtaacgtaaaccgggtacccgtaaaacccgtaaaccccggtaaccttacccgtacccgttacccgggaccgggtaacggtcccgacggtaccgttagggtaaacgtaaacggttaaacgcgttcggtcgtacgtcgacctcgttactcgttcgttaacc

SEQ ID NO: 422341 - DNA, 680 bp, Homo sapiens
  misc_feature: GZ8MTXP01BY34U.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctaggtctctggatccagtggggatattgtgatgactcagtatccactctccctgcccgtcacccctggagacgccggcctccatctcctgcaggtctagtcagagccctcagcatactgatggatacaactgtttgatttggacctgacagaacgccgagggcacgtcctaccgactaaccttcctgtaactttcgttaagttttcggggttaccttaaaggtccccgggggtccccgtttcccccgggggttcccctggtacctacggggtttcgaaaggtcgggcgtaggtcgggatcgaggtactagtacgttattttacgatagaatacgagacaggtagtgggaagtcgtaggttagggtaccggggttttagggggtttaacttacgtggactagtcgacgtaacggtaccttaacccaaacccggtctaccgtaccggtccgggaccggacgggacgttacgggtcccgttaaggaacgttaaacgttaaaccgtaacggttcggaaccgggttactacggttaccctaacctttaacggttcccg

SEQ ID NO: 422342 - DNA, 621 bp, Homo sapiens
  misc_feature: GZ8MTXP01ADSU5.15.25.C03.1.454.CMB.2.raw
  modified_base (347)..(347): a, c, t, g, unknown or other
  modified_base (373)..(373): a, c, t, g, unknown or other
  modified_base (378)..(378): a, c, t, g, unknown or other
  modified_base (390)..(390): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagcgccgcctccatctcctgcaggtctagtcagcgcctcagcatactgatgatacatatgatgtactgcagacgcgaggctacgtctaccacactctgatcttagtttggtactacgtcggtccgtccgggtcccctggactgtcgagtcgcngtgatcgagtcatagtattacactanaaatnagcgaaggtagnggaggtacgtagggtaacggtttagggtttacgggtttacgttacgtcgtacgtacgtacgtaaccgtaacgttaacccgttaaacccgaaaccccgttacgttacccgtaccggttaccgggaaccggtaacgggaccgaccggttaccggtaaacggtaacgttaaacgttaaacggttaacgttggtccgtaacgttacgacccgttacgtaacgtttccgttaaccg

SEQ ID NO: 422343 - DNA, 699 bp, Homo sapiens
  misc_feature: GZ8MTXP01AQU55.15.25.C03.1.454.CMB.2.raw
tcagtctacgtagccacgaccggtgctcgatttagtagtgtagatttgggtttgggggatcaggactcctcagttcaccttctcacaatgaggctccctgcttagctcctggggctgctaatgctctgggtctctggatccagtggggatattgtgatgactcagtctccactctccctgcccgtcacccgtggagacgccggcctccatcctcctgcaggtctagtcagacgcctcagcatactgatggaatactaacttagttggacttcggtacctgacaggaacgccgagggcacgtcctaccacaacctccgtagtacttcgtttagttttcgggttactaacggtccgggggtccccgttccgggggtccctagggaccgttagggttccagggtcggaacgtagggtgtatacgaggtctaagttaagttacttttaaacaacgtaaagtaaaatcgaaggtacgaggtagggtagggtacggtacggttagggtaacggggttaacgggtttaggggtttacttaacggggtgtacgtagtacggtacgtaaaccggtacctaaaccccgtaaacccgtacgttacccgtacccggttaccgggaccgggaacggtacgaccgtaccgttaggggtaaacgtaacgttaaacgcgttagggtggtacctgtaccacgttatcgttcgttcc

SEQ ID NO: 422344 - DNA, 606 bp, Homo sapiens
  misc_feature: GZ8MTXP01AWM9I.15.25.C03.1.454.CMB.2.raw
  modified_base (380)..(380): a, c, t, g, unknown or other
  modified_base (428)..(428): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgccccgtcacccctggagacgccggcctccatcctcctgcaggtctagtcagacgcctccagcatactgatggatacaactattggattggtactgcagaacgcgaggcagtctaccacaactcctgtattcttagtttgggttactaaggtccggggtccctccccgggggtccctagacgtaggttcaagggttcggntaggtggatcgaggctagtagtatttacactagaatcaagcaaggtgngggagcgtaggtagggttacggtttagggggtttacttagtgactagtcgacgaacggttaccaaaccgtaaccccgtatacccgtacccggtcgggaccggaacggggaccaccggttaccggaaggaacgttaacgtttaaacggaaccttggcgtcgcgacctaacttcgttccg

SEQ ID NO: 422345 - DNA, 614 bp, Homo sapiens
  misc_feature: GZ8MTXP01DXW8R.15.25.C03.1.454.CMB.2.raw
  modified_base (221)..(221): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcaccccgtggagacgcccggcctccatcctcccgnaggtctagtcagacgcctccagcatactgatggatacaacttagttggattcggacctgacagacgccgagggcacgtctaccacaactcctgattctagtttggtctagtccggcctccggggtcctgactaggtcagtgacagtggatcgaggactagttagattttacactagaaactcagcaaggaggtaggaggcgtagggtagggtacgggtttaggggtttacttaacggtgacgtaagttacggaccgtaacggttaccctaaaccgaaaccccgtacgtaccgtacccgttaccgggaccggaacgggtaacccacggacccgttaggaaacgtaacgttaaacggacgttggtcggactcgcctacgttactcgttcgttccg

SEQ ID NO: 422346 - DNA, 662 bp, Homo sapiens
  misc_feature: GZ8MTXP01BKPJF.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagagccggcctccatctcctgcaggtctagtcagagcctccagcatactgatggatacaactattggattggacctgcagagccaggcagtctcacactcctgatctgtttggtactagtcgggcctccccggggtcctgactaggttcaagtggcagtggatcgaggctattagtattttacgacttagaaattcgaagtacaaggtaggtgggacggtcgtagggtaacggggttacggttttagggggggggttttaactttacggtacgggtacctaaggttaccggtacgttaaacggggttacccttaaacccggtaaaacccccgtagttaccccgtaacccgggtttcccggggaccggacgggggtaccaaccgggtcccgtaggggaaacgttaacgtttaaaaccgggaaccgttgggtcggtccgtacggttacctaaccccgttaagtttcccg

SEQ ID NO: 422347 - DNA, 730 bp, Homo sapiens
  misc_feature: GZ8MTXP01BT5JT.15.25.C03.1.454.CMB.2.raw
  modified_base (285)..(285): a, c, t, g, unknown or other
  modified_base (454)..(454): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactcctccctcgcccgtccacccgtggacgcgcccgcctccactcctccgtgacgtagtctacgtacgagacgcctacagactatactgagtagaatactattgtagattcgtacngacgagacgcgaggctacgtccacactactctgtacttacgtttaggtttacggtactacggtcccgggtacccggttcccggggtaccctagtacggtaggttcgacggtacggacgtggtgacgtacgacgtactaagttaacgtttacttaacgaataacgtaaancgaagaggtaaggtacgggtagggacggttacggtaggggttaaccggggtttagggtttacggggttttaacctacggggtacgtagtacggtaccggtaaaccggttaacccggttaaaccctaaaacccccggaacccgttccgttaaccccggtaccggtacccgggggaaaccggacgggaaccctaccgggttacgtaaaggtaaacgttaacgggttaaaccttcgggtaagggtcaacgttacgaccttacgttcgttaacggtttcc

SEQ ID NO: 422348 - DNA, 642 bp, Homo sapiens
  misc_feature: GZ8MTXP01EG6UE.15.25.C03.1.454.CMB.2.raw
  modified_base (277)..(277): a, c, t, g, unknown or other
  modified_base (294)..(294): a, c, t, g, unknown or other
  modified_base (496)..(496): a, c, t, g, unknown or other
  modified_base (567)..(567): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctcgcccgtccacccgtggagacgcccggcctccatcctcctgcaggtctagtcagacgcctccagcatactgatgatactaattgtgattcggtaccngacgagaacgcgaggcncgtcctaccactactctagtattcgtttatttgtagttacgtacggtccggtccgtccccggtcctagacgtggttacgaagggtcgcgtaggtagactacggagtactaagttaacgttactttaaacactaaagtaaactgaagtacgagggtagtgggacgtcgtagggtacgggttcggtttagggggtttacttagngagtagtcgaacgttacgtaaacctaacccgtaaaccgtcgtacccgtacggtaaccggacgacgggaacncggtaaccgttaagaaacgttaaacgttaaaccgtaaggtcggtcggtactacgcccttaacgttcgtttaaccg

SEQ ID NO: 422349 - DNA, 651 bp, Homo sapiens
  misc_feature: GZ8MTXP01DPH2T.15.25.C03.1.454.CMB.2.raw
  modified_base (275)..(275): a, c, t, g, unknown or other
  modified_base (382)..(382): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactcctccctgccccgtcaccccgtggacgacgcccggcctccatctccgtgcaggtctagtcagacgcctcagcatactgatggatacaattgtgattcggtacngacagacgcgaggctacgtcctaccaactacctctagtacttcgtttaagtttcggttactacgtccgggcccgttccgggtcccctagacgtggttcaggtcgacnggtgactacgaggctagtagttacttaacataagaaaatcgagaggtaagtaggtagggacggtgtagggtaaggtttacgggtttagggtttacttacgtagtacgtaagttacggaaccgtaacggttaaccctaaacccgaaccccgttagtacccgtaccgtccggggaacgacggaccgtaccgttacgggtaaaggtaacgttaaacgttaaaacggcgttcggtacggtaacctacgaccgttacctaagttcctttaaccg

SEQ ID NO: 422350 - DNA, 633 bp, Homo sapiens
  misc_feature: GZ8MTXP01EVC1P.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactcctccctcgcccgtccaccccgtggagacgcccggcctccatcctcctgcaggtctagtcagagcctcagcatactgatggatacaacttagtgattcggtacctgcaagaagccgagggcagtctaccaacaccttctagacttctttagttttgggtactaacggtccggggcccgttcccggggtccccctggtacgtgggttcagggtcgactaaggtggaatcgaggtactaagttagttaactttacaataagaaaactcgaagagtaaggagggttagggagggtacgtaggggtacgggtttaagggttttagggtttattacgttagacgtagtcgaacgtaaacggttacctaaacccgaacccgtatacccgtaccggtccggaacggacgacgacgacgtggaaacgttagttaaacgacgtgtcgctcgaccttactcgttcgtaacg

SEQ ID NO: 422351 - DNA, 579 bp, Homo sapiens
  misc_feature: GZ8MTXP01DEYVQ.15.25.C03.1.454.CMB.2.raw
  modified_base (288)..(288): a, c, t, g, unknown or other
  modified_base (332)..(332): a, c, t, g, unknown or other
  modified_base (341)..(341): a, c, t, g, unknown or other
  modified_base (349)..(349): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagagccggcctccatctcctgcaggtctagtcagagcctccagcatactgatggatacaactattggattggacctgcagagccaggcagtcnccacactctgatcttatgggttctaagtcggctccgggtccccngacaggtcnggtacgcngtgatacgagcatagtatttacactagaaatcagacgaggtagtgggaggtctaggaggtacgtttggggtttattacgtgacagtagtccgaaggttaccgaaacctaaaccccggtatacccgtaccgttccgggaaccggtaacgggacacccggacgttacgggaacgttaacgttaaaaccggttaacgtgtacggtctacggaccttactaacttcgttaaccg

SEQ ID NO: 422352 - DNA, 659 bp, Homo sapiens
  misc_feature: GZ8MTXP01D0B5O.15.25.C03.1.454.CMB.2.raw
  modified_base (258)..(258): a, c, t, g, unknown or other
  modified_base (288)..(288): a, c, t, g, unknown or other
  modified_base (348)..(348): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagcccggctccatctcctgcaggtctagtcagacgcctccagcatactgatggatacaactntggattggtacctgcagacgcaggcagtcncactactctgatctagtttggtctacgtcggcctcggggtccctggactggtcaggtgcnggtgatacgaggtctaagtagttaacttttacacgttaagaaactcgaacgtacgtaaggtacgggtagggacgggtacgttagggtaacgggtttacgggttttacgggggttttaacgttaacgttgggtaaccttacggttacggtaaccgttaaacgggttaccctaaacccgtaaccccgtagttacccgtaccggttccgggaacggttacgggacctaccggttacgtacgggtaacgttaaacgttaaaccggttacgttcgggtggtaaccgtcggaccttaccgtaacgttcgtttaaccg

SEQ ID NO: 422353 - DNA, 779 bp, Homo sapiens
  misc_feature: GZ8MTXP01BJZKK.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctcgcccgtccacccctggacgacgcccgcctccatcctcctgcaggtctagtcagacgcctcagcatactgagtcggtaactaacttagttggtattcggtacctgacgaagacgtccgaggctacgtccctaccaacctaacctcctagtacttacgtttacggttttacgggtttacgttaaccggttcccgggggtaccccggttccccgggggttccgtacggtaaccggtagggttccgtaagggtcgggaccgtaagggttcgggtacttcggaacgggtacttaaagtttaacgtttaaacgttttaacgtaaacgttaaagtaaaacttccgaaagtaacggtaagggtagggtagggtacggtacggtaggggtacggttaggggttttaggggtttacttaggggtcgtacgtagtacgtaccgtaacgtaacccaaacccgtaaaccccgtcgtacccgtacccggtccggtaacccgggaacggtaaccttccgggtacgttaacgggtaaacgttaaacgttaaacccgggttgttaccggtaacgggtcctaacggttaaccctccgttacttccgttaacgtccc

SEQ ID NO: 422354 - DNA, 634 bp, Homo sapiens
  misc_feature: GZ8MTXP01AU6UP.15.25.C03.1.454.CMB.2.raw
  modified_base (246)..(246): a, c, t, g, unknown or other
  modified_base (541)..(541): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgccccgtcacccctggagacgccggcctccatctcctgcaggtctagtcagacgcctcagcatacngatggatactaactagttggattggacctgacagaacgccgagggcacgtcctaccacaactctagacttcgttagtttggttactaaggtccggtccgttccccgggggtcctggacgtaggttcaaggttcggcagtggaactcgaggctagttaagtactttacacttagaaactcgagtacgaaggtagtcgggaggtcgttagggtaaggggtttacggtttaggggggttttaacttaccgtagtacgtagtcggacgttaaacggtacctaaacccgtaaaccccgtntaccgtaccggtcgggaccgacgggtaccacggtacgtaagggaacgttaacgttaaacgaacgttggtcgcgtcgactaacttaacgttccg

SEQ ID NO: 422355 - DNA, 672 bp, Homo sapiens
  misc_feature: GZ8MTXP01EIA8I.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgccccgtcaccccgtggagacgccggcctccatcctcctgcaggtctagtcagacgcctccagcatactgatggaactacaacttagttggattcggtacctggacgaaggaacgcgtagggactacgtccctaccaactacctcgtagtactttcgtttaggtttcgggttactaacggtccgggtccccgttccggggtacccctaggacgtagggttcgaggtcggacgtgggtagtactacgacggtactaagttaacgtttaaactttaaccgaagtaaataaacacgaggtagaagggtagggtagggagtacggtagggtaagggtttacgggttttagggtttactagtggtactagtacgaacgtaacggtaccaaaacccgtaccgtcgtacccgtaccgggtcgggaacgaacgggaccacgggttctaaagggtaacttaaagttaccgagtggtcgctcgaccttacttcttcggttcc

SEQ ID NO: 422356 - DNA, 686 bp, Homo sapiens
  misc_feature: GZ8MTXP01A096J.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtggggatattgtgatgactcagtcctccactcctccctcgcccgtccaccccgtggacgacgcccgcctccatcctcctgcgagtctagtcagacgccctacagctatactgagtaggaactaactaacttagttaggtagttcggtacctagacgaacggaacgccgagggctacgtcctaccaactaccttcctagtacttcgtttaggttttcggtacttacggtccgggtcccgtccggggtcccctaggacgtaggtcgaggtgcgtaaggtggactacgaggtactaagttacgttaactttaaccgaattaaaggaaaacctgaacgagtaaaggggtaggtagggacggttacgttaggggtaacgggtttacgggtttttagggtttaactcgtagacgtaacgtacgaacgtaaacgtaccctaaacccgtaaacccgtgtacccgtacggtccgggaacggaacggaccgacgttcgtaaggtaacgttaaacgttacggacgttggacgtcacgacactgttcgttaacg

SEQ ID NO: 422357 - DNA, 660 bp, Homo sapiens
  misc_feature: GZ8MTXP01CZM6O.15.25.C03.1.454.CMB.2.raw
  modified_base (374)..(374): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagagccggcctccatctcctgcaggtctagtcagagcctccagcatactgatggatacaatattggattcggtactgacaagaacgcgagggcacgtcaccacaactcctgattcttagtttcgggttactacgtccgggccgtccggggtcccctagacgtaggttccaggttcggcnggtgatcgaggtcaagttagtaactttacactaggaaatcgagacgaaggtaggtaggacggtgtaggtagggttacggtttaggggtttacgttacgtgactagtcggtaactaacggtacctaaacccgtaaacccgtacttacccgacccgtttccggggccggtaaacggggacccgtaaccggttcgtaaacggggtaacttaaaacggtttaaaaccggttaacgttaacggggtacgtaaccgttcgggacccttaccgttaacgttccgtttaaccgg

SEQ ID NO: 422358 - DNA, 658 bp, Homo sapiens
  misc_feature: GZ8MTXP01B3Q5D.15.25.C03.1.454.CMB.2.raw
  modified_base (423)..(423): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactcctccctcgcccgtcaccccgtggacgacgcccggcctccattcctcctgctaggtctagtcagcgcctccagcatactgatggatacaacttagttggattcggtacctgacgaagacgccgagggctacgtaccaccaactaccgtctagtacttcgtttagtttcggtactaacggtccggtcccggttcccgggtccctaggtacgttaggtccgaggttggacgtaagggttgaacttcgacggtntaaacgttacgttaaacttttaacgaacgttaagaaaacgtccgaacggtagaaagggttacgggtgggtaacggtcgttagggtaagggtttacgggttttagggtttacttacggtgacctaagtacgaacgtacggtaccctaaaccgaccctgtaccgtacggtccgggaacgtacggacctcggacgtaggaattagttacgagttgacggctacgcttactcgttgtcc

SEQ ID NO: 422359 - DNA, 683 bp, Homo sapiens
  misc_feature: GZ8MTXP01A4OH5.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtgggatattgtgatgactcagtctccactcctccctcgcccgtccacccgtggacgacgccgcctccatctcctgcagtctagtcagacgcctccagctatactagagtaggaactactaacttagttggattcggtactgacagaacgcgaggcagtccaccactacctctagtattcgttagtttcggtactacggtccgggtccgtcccggggtcccaggtacgtaggtcaggtcggacgtggtagtactacgacgggtactaagttaaacgttaacttttaactaacgtaaagtaaacgtacgaacggtaggtaaggtagggtagggacgggtacggtagggtaagggttacgggttttaggggtttaattacgtaggtactacggtacgtaaccgtaaacgttaacccgtaaaccgtaaaccccgtacgtacccgtaaccggttccgggaaccggtaacggaccggtacgaccggtaaagggtaacttaaacgttaacgacgtggtcggtctacgaccttacgtctttcgtccg

SEQ ID NO: 422360 - DNA, 746 bp, Homo sapiens
  misc_feature: GZ8MTXP01API9I.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactcctccctgcccgtcaccctggagagccggcctccatcctcctgcaggtctagtcagacgcctccagcatactgatgatacaacttagtggattcggtacctgacgaaggaacgccgaggctagtcctaccaactaaccttcctgtacttcgtttaacgttttcgggttacttaacgtcccggggtcccgttcccgggggttccccctaggtacggtagggtttccgagggttcgggacgtaaggtgggacttaccggagggtactaagttaaagttaactttttaaaccgaacgttaaagtaaaaacgtcgaaggtacgaagggacgggttagggaacgggtcgttagggtaacggggttacgggtttttaggggtttaactttacggtaggtacctaggttacgacgtaaacggttacctaaacccgtaaaccccgtacgtaccgtaacccggtccgggaacccgggacgggaacccgtaccggttaccgtaacggggtaaacttaaacggttaaaccgttaacgttcgggtacggtcgtaccggaacccgttaccgtaacgttcctttccgg

SEQ ID NO: 422361 - DNA, 592 bp, Homo sapiens
  misc_feature: GZ8MTXP01BPIYC.15.25.C03.1.454.CMB.2.raw
  modified_base (356)..(356): a, c, t, g, unknown or other
  modified_base (485)..(485): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatcctcctgcaggtctagtcagagcctccagcatactgatgatacatattggattggtacctgacagaagcagggcagtctcacaactctgattctatttggtctaagtccgggcctccggggtcccctggacgtaggttcaggtggcnggtgatcgaggctagtagtatttacactagaaactcaagcgaaggaggttagggacggtcgttggaaggtacggtttaggggtttattacgttgactagtcgacaacggtacctaaaccgaaacccgtntaccgtaaccgttccggaacggtaacgggaccaccggttccgtaagggtaacgttaaacgttaaacggacgttaacgggtgccgttcgacccaacgtcgttcttccg

SEQ ID NO: 422362 - DNA, 692 bp, Homo sapiens
  misc_feature: GZ8MTXP01ESRJI.15.25.C03.1.454.CMB.2.raw
  modified_base (392)..(392): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctcgcccgtccaccccgtggacgacgcccggcctccactcctcccgcaggtctagtcagacgcctcagcatactgatggatacgtaacttagttggagttcggtacctgacagaacgccgagggcacgtcctaccaactaacctcctagtacttcgttaagttttcggttactacgtccggtccgtccgggtcctgacgtaggtgagtcggacngtgatcgaggactaagttaagtatttaacataagaaatcgagagaggaggtgggagtcgtagggtaacgggttagggtttacggggtttaacttacggtacgtcgtaagtacgtaacgtaaaccggttaccctaaaacccggaaaccccgtacgtcccgtaacccggttccgggaacccgggtaaccgggaaccgttacccgggtacggttaaccgggtaaaagttaaaccgttaaaacggttcgttacgggtcggtacctaacgtacccgtacttacggtttccgtttccgtttaaccg

SEQ ID NO: 422363 - DNA, 638 bp, Homo sapiens
  misc_feature: GZ8MTXP01D0LYQ.15.25.C03.1.454.CMB.2.raw
  modified_base (256)..(256): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcaccctggagacgccggcctccatctcctgcaggtctagtcagacgcctccagcatactgatgatacaatntggattggtactgacagacgcgaggcagtcctaccaacaacttctagtacttcttaagttttcgggttactaacggtcccggggtcccgttcccggggtcccccctaggtacgtaggggttcaggttcggactggtggaatccgaggtactaagttagtaacttttaacaattaagaaaatcgaagagaaggaggttagggaggacgtagggtaagggttaacggggtttaggggtttaattaacgtggtactagtacgacgtaacggtacctaaacccgaaacccgtctaccgaccgttcgggaaccggaacgggacacgttacgtacggtaagttaaacgttaaaccgacgtgtacggctcgaccttacctcttcgttcg

SEQ ID NO: 422364 - DNA, 632 bp, Homo sapiens
  misc_feature: GZ8MTXP01DD5EO.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccgcctccatctcctgcaggtctagtcagagcctccagcatactgatggatacaactattggattggtacctgcagaagccaggcagtctaccacaactctgattcttaagtttggtactaacgtccggggccgtcccggggtccccctggactaggttcaggtggctaaggtcggatcgagggactaattagtaacttttaacaacttaagaaaatcgagagaaggaggtagggaaggcgtaggaagggtacgggtttagggggttttaacttacggtagctaagtacggaacgtaaacggtacctaaacccgaaaccccgtatacccgtaccgttccgggaaccggaacgggaccgaaccggccgtaagggtaacgttaaacgttaaaccggaaacgttggtacggctacgaccaacctaacttcgttaacg

SEQ ID NO: 422365 - DNA, 696 bp, Homo sapiens
  misc_feature: GZ8MTXP01EZXQ0.15.25.C03.1.454.CMB.2.raw
  modified_base (289)..(289): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtggggatattgtgatgactcagtcctccactcctccctcgcccgtccaccccgtggacgacggcccggcctccatcctcctgccgaggtctagtcagacgcctccagcatactgatgaatactaacttgttaggattcggtaccngacgaaggacgccgaggcacgtccaccaactactcctgtactcgtttagtttcgggtactacggtcccggggcccgttccggggtcccctaggacgtaggttccgaggttcgggactaagggttcgaacttaccggaggtactaagttaacgttaaacttttaaccaagttaaacgaaatcgagaggaagggtaggtagggacgtacggtaggggtacgggtttacggggtttagggttttacacgttaggacgtaagtacggtaaccgtaaaccggttaaccctaaacccggaaccccgtagtaccccgtaccggttacgggaacgggaacggaccgtaccgacgtagggaaacgttaaacgttaacgcgttaaggcgtcgtaacgcttaaccgtcgttcgttccg

SEQ ID NO: 422366 - DNA, 672 bp, Homo sapiens
  misc_feature: GZ8MTXP01EMLR6.15.25.C03.1.454.CMB.2.raw
  modified_base (237)..(237): a, c, t, g, unknown or other
  modified_base (243)..(243): a, c, t, g, unknown or other
  modified_base (250)..(250): a, c, t, g, unknown or other
  modified_base (283)..(283): a, c, t, g, unknown or other
  modified_base (300)..(300): a, c, t, g, unknown or other
  modified_base (477)..(477): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctggtctctggatccgagtgggatattgtgatgactcagtcctccactcctccctcgccccgtccaccccgtggacgcgcccgcctccatcctcctgcgagtctagtcagcncctcanacatacngagtagatactaattgtgtagttcggtactganaacgacgtcgaggtccngttccaccactaccttcgtagtactttcgtttaagttttccggtaacttaccggtcccggggtcccgttcccgggtccctaggacgttaggtccgtaggtcgggacgtggttgaaccgtgtaacgtataacgttattacttaacaagttagaaactgagagtaagggtggttagggnggtagttagggttaacgggtttacggtttaggttacgtagacgtaacgtagtacgtaaccgttaacccgtaaaccgtaaacccgtacccgtacgtacccgtaccgggtacgggaaccggtacgttacggtaccgttaggaaacgttaacgttaaacgttacgttcgtgccgtcgtacgccttactcgttcgtaac

SEQ ID NO: 422367 - DNA, 756 bp, Homo sapiens
  misc_feature: GZ8MTXP01A6P53.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatcagtgggatattgtgatgactcagtactccactctccctcgcccgtcaccctggagacgccgcctcactctctgctaggtctagtcagacgcctacagcaatacgtgataggaataactaactagttaggagtttcggtaacctgacaaggaacgccgagggcaacgttccaaccacgtaactcgtgtattacgtttaaggttcggttacgttaacggtccggggtccgttaccccccggggtacctagtacgtacggtcgtaaagggttcggaacgtggtacgggtactacggtaggtactaagttaaacgttaacttttaacaaacgttaagtaaacgtacctaaggacgtaaggtagggtacgggtaaggtacgtaagggttaacgggggtttacggttttaggggggggtttaacttaacggttgacgttagacgtacgttaacgtaacctaaacccgtaaacccgtacgttacccgaacgggttcccgggaacggttaaaccggaacccgaccgggttaaccggtaagggggttaaaacttaaccggttaaaaaccggtaacgggtagtaacccggggttcaccggaccttaaacccgttgtttaaccccg

SEQ ID NO: 422368 - DNA, 682 bp, Homo sapiens
  misc_feature: GZ8MTXP01BIPC7.15.25.C03.1.454.CMB.2.raw
  modified_base (435)..(435): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccgtggagacgccggcctccatctcctgctaggtctagtcagacgcctcagctatactgataggatacaacttagtgattcggtacctgcacgagccgaggctacgcctccaacactcagtacttacgtttgtttacgggttactacggtcccgggtccgttccggggtcccccctaggtacgtacggtcaggtggcgtaaggtacgtatccgagtactagttaattaacttacaactaaggaaacnctaggacgtaagaggtgggacgtgtacgggtaagggttacgtttaggggtttactacgtaaggctagtacgacgaacggttaccctaaacccggtaaaccctgttaccccgtaacggtttcccggggcccgggaaacgggttaccaacccggttacggtaaacgggtaaacgtttaaaccgttaaaacgggttacgtttcgggacgggttccaccggtaacgttaccctaactttccgggtttaacc

SEQ ID NO: 422369 - DNA, 644 bp, Homo sapiens
  misc_feature: GZ8MTXP01B5YWM.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcaggaacgccgagggcacgtcctccaacaactcctagattcttagttttcggggttctaacgtccggggccgttccgggggtccccctaggacgtagggttccaggtcgggcaaggttggacttccgagggtctaagttacgtacttttacgataggaaatcgagcgaaggtaggtgggagggcgtaggacgggtaggtttaggggtttacgttaagtggactagttagaccgtaacggttacgtaaacccgtaaacccgtacgtaccgtacccggttcccgggaacggtaacgggaccgaacgttcccggtaaaggagttaaacttaaaccgaacgttaacggtggaacgtcggacttacctcgttcttcg

SEQ ID NO: 422370 - DNA, 638 bp, Homo sapiens
  misc_feature: GZ8MTXP01DY2DR.15.25.C03.1.454.CMB.2.raw
  modified_base (196)..(196): a, c, t, g, unknown or other
  modified_base (254)..(254): a, c, t, g, unknown or other
  modified_base (283)..(283): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactctcctcgcccgtcacccgtggagngccggctcatctcctgcaggtctagtcagacgcctacagcatactgatgatacaactntgatggtactgacagacgcaggcacgtcnccaacactcgtatattcttagtttcggtactagtccggccgttaccggggtcccctaggtacgtacggttacaggttcggactaagggtacggaattcgaacgggtactaagttaagttaactttaacctaagttaacaaaagtcagtacgaaggtagtacgggagacgtaggtagggttagggtttagggtttaactaacgttgaccgtagtacgacgtaacgtaccgtaaaccgaacccgtagtacctaccgttcgggaaccggacggaaccgtacgacggtaagaaacgttaaacggttaaacgttaacggttcgtacggtaacgtcgtaccttaacctcttccggtttccg

SEQ ID NO: 422371 - DNA, 564 bp, Homo sapiens
  misc_feature: GZ8MTXP01A4HB5.15.25.C03.1.454.CMB.2.raw
  modified_base (255)..(255): a, c, t, g, unknown or other
  modified_base (264)..(264): a, c, t, g, unknown or other
  modified_base (272)..(272): a, c, t, g, unknown or other
  modified_base (352)..(352): a, c, t, g, unknown or other
  modified_base (404)..(404): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcaccctggagagccgcctccatctcctagcaggtctagtcagagcctcagcatactgatcggatacaatntgatgtacngacagacncgaggctcgtcacacacgtctatacttcttagtttcggtactacggtccggtccgtccgggtcccctagacgtaggtacngtgcgtgtgtagcgagatatatacttactatagaatacagagagaggtaggnggacgtaggtacggtaggtttagggttaggtagtagtcgtagtacgtacgtacgtaccgtaaccgaacccgtactaccgtccgtcggaacggacggacgacgacgtacgtaacgttaacgttaacgttacgtcgtcgtcgcgcttacctaacgttcgtcg

SEQ ID NO: 422372 - DNA, 706 bp, Homo sapiens
  misc_feature: GZ8MTXP01AIB1A.15.25.C03.1.454.CMB.2.raw
  modified_base (410)..(410): a, c, t, g, unknown or other
  modified_base (540)..(540): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtcctccactcctccctcgccccgtccaccccgtggacgacgcccggcctccatcctccgtgcgaggtctagtcagacgcctcgagcatacgtgatggtaactaactaacgttagttacggtattcggtacctgacgaaggacgtccgaggtcacgtcctaccaactacctctagtacttctttaggtttcggtacctacggtccggtaccgtccggtcccctagacgtgtaccgagtcggtacgngtcggactaggacgtacgtaattaacggttatttaaccgaacgttaaacgaaactcggagtacggaaggtagggtacggtaggtcggttaacgggtaacgggtttaggtttacggggttactacggtcgngtaacgtcgaaccgtacgtacccgtaaaccgtaacccgtcgtacccgtaaccgggtccgggaacggtaacggacccgacggttacgtaacggtaaacgttaacggttaaacgcggttaacggtcgtaaccgtaccgtaacggttaccttaacgttcgtttaacccg

SEQ ID NO: 422373 - DNA, 610 bp, Homo sapiens
  misc_feature: GZ8MTXP01CDVVQ.15.25.C03.1.454.CMB.2.raw
  modified_base (401)..(401): a, c, t, g, unknown or other
  modified_base (458)..(458): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagagcctcagcatactgatggatacaacttattggattggacctgacagaacgcgaggcagtcctccaacaactctagacttcttagtttcgggtactaagtccggggtcccgttccggggtcccctggactagggttcaggtgctggtgatcgagcatagtactttacactanaaatcaagcgagagtggagcgtaggtaagggtacggtttagggttattacgtaggtntacgttgacgtaaacggttacctaaacccgtaaacccgtgtacccgtaaccggttcccgggtaaccgggaacgggaccgtaacgcccggtaagggaagttaacgttaaaacggacttgggacgtaacgcgaccttacctaacgttctttccg

SEQ ID NO: 422374 - DNA, 703 bp, Homo sapiens
  misc_feature: GZ8MTXP01AJZR9.15.25.C03.1.454.CMB.2.raw
  modified_base (221)..(221): a, c, t, g, unknown or other
  modified_base (368)..(368): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtcctccactcctccctcgcccgtcaccccgtggacgcgccgcctccatcctctgcngtctagcagcgcctaccagctatactgagtggaatactaattgttggattcgtacctgacgagacgcgaggcacgtcctaccaactactctgtactttctttaggtttcgggttactacggtccgggtacccggttccgggtacccncggtacgtaggttcgaggtccgggagtaaggacgacgtaccgtaggacttaaagttaacgtttactttaaaccaagttaaacgaaaagttcgaacggtacgaaggggtacgggttagggtacgggtacggttagggtaaggggtttacgggttttaagggtttacttacggaggtactacggtacgtaccgtaaaccgtaccgtaaacccgaacccggttactacccggttaccggtccgggaaccggaaggaccgaccggttcgttaaacgggaagttaacgttaaaccggttagtggttaacggctaacgcccgttaacgttcttccggtttc

SEQ ID NO: 422375 - DNA, 603 bp, Homo sapiens
  misc_feature: GZ8MTXP01BOQW2.15.25.C03.1.454.CMB.2.raw
  modified_base (377)..(377): a, c, t, g, unknown or other
  modified_base (586)..(586): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcaccccgtggagacgccggcctccatctcctgcaggtctagtcagagcctccagcatactgatgatacaattatgattgtactgacagacgcgtaggctacgtcctaccaactaaccttccgtagtacttctttaagtttcgggtactaacggtccggtccgtccgggtcccctagactggttcaggtgacnggtgactgaggtctaagttagtaacttttacaattaagaaacgtagacgagtaaggaggttgggacggtcgtaggtagggttaccggtttagggtttaatacgttcgctagtacgacgtaacggtacctaaacccgacccgtatccgtaccgtcgggaacgtacggaccgcgccgtaggaattaacgttaaacgacgttggcggctacncttaaccttcgttcgtc

SEQ ID NO: 422376 - DNA, 638 bp, Homo sapiens
  misc_feature: GZ8MTXP01B0GP4.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcaccctggagagccggcctccatctcctgcaggtctagtcagagcctccagcatactgatggaatacaactatttggattggtacctgacagaagccagggcagtctccacaacttcctgtattcttagtttcgggggttctaaacgtcggggccttcccccgggggccctagacctaggttcaagtagggcaaggtggatcaggctatagtatttacactagaaatcaagcgagtaggtgggaggcttggaagggtacgtttggggggggtttacttacgtgacagtacggacgtaacgggttacacccgtaaaacccccgagtacccgtacccgttaaccgggaaccgggttacgggaaccgaccggtacccgtacgggaaaggttaacggtttaaaaacccgaaacgtttcggtaacgggtcgttacggcctaaccccttaagtttccg

SEQ ID NO: 422377 - DNA, 710 bp, Homo sapiens
  misc_feature: GZ8MTXP01ERPHR.15.25.C03.1.454.CMB.2.raw
  modified_base (154)..(154): a, c, t, g, unknown or other
  modified_base (279)..(279): a, c, t, g, unknown or other
  modified_base (373)..(373): a, c, t, g, unknown or other
  modified_base (396)..(396): a, c, t, g, unknown or other
  modified_base (482)..(482): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgngatgactcagtctccactcctccctcgcccgtcaccccgtggacgacgcccggcctccatcctcctgctaggtctagtcagacgtcctcagacatacgtgatggataactattagtgatcgtacngcgagacgacgaggctacgtccacctaacgtaacctcgtagtactacgtttagttttcgggtactaccggtccggggacccgtccgggtacccngacgtacggttcgagtgggtacnggtaggacgtacgaaggtctaagtaactttacgtttaaccaattaaacgtaaatacgaacgacggtaagggtaggtgggtaacggngttagggtacgggttacggggttttaagggttatttaacgcggtagtaacgtcgggtaacgtaaccggttaaccaaaaccccggtaaaccgtcgttacccggtaaccggttccggggaaaccggtaacgggttaccggtaaccggttaccggtaaagggtaaccgttaaaacgttaacgggaaccggtgttacgaacccggttaacacccttaccgttcgttccgtcg

SEQ ID NO: 422378 - DNA, 517 bp, Homo sapiens
  misc_feature: GZ8MTXP02JGO46.15.25.C03.1.454.CMB.2.raw
  modified_base (355)..(355): a, c, t, g, unknown or other
tcagtctacgtagccacgaccggtgctcgatttagtagtgtagatttgggtttggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctccagcatactgatggatacaactattggattggtacctgcagaagccagggcagtctccacaactcctgatctatttgggtctaagtcgggcctccggggtccccctgacaggttcagtgcngtgatcgaggcatagatttacactagaaaatcagcagagtggaggctgaggtacggttggggtttattacgttgcagtgacaaggtctaacaaacccgatccaccgttcggccgagggacacgcctaggagaacttaacgaactgtaggctcgcaccatctg

SEQ ID NO: 422379 - DNA, 512 bp, Homo sapiens
  misc_feature: GZ8MTXP02JCNUP.15.25.C03.1.454.CMB.2.raw
  modified_base (354)..(354): a, c, t, g, unknown or other
  modified_base (495)..(495): a, c, t, g, unknown or other
tcagtctacgtagccacgaccggtgctcgatttagtagtgtagatttgggtttggggatcaggactcctcagttcaccttctcacaatgaggctccctgctcagctcctggggctgctaatgctctgggctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtcccctgacaggttcagtggcngtggatcaggcatagattttacactgaaaatcagcagagtggaggctgaggtacggttggggtttattacgtgcatgcaaggtctacaaacccgatcaccttcggccgagggacacgcctaggacgacttaaacgaactgnggctcgacacagtctcg

SEQ ID NO: 422380 - DNA, 515 bp, Homo sapiens
  misc_feature: GZ8MTXP02HN6OS.15.25.C03.1.454.CMB.2.raw
  modified_base (344)..(344): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctccagcatactgatggatacaactatttggattggtacctgcagaagccagggcagtctccacactcctgatctattggttctaagtcgggcctccggggtccccctgacnggttcagtggcaggtggatcgaggctagtagtatttacactagaaaatcgagcagagtggagcgtgaggtacggttgggtttattacttgcagtgcaaggtctaacaacccgatcaccgtcggaccgaggcacgcgtacggacgactaacgatgtagctcgcacactctcg

SEQ ID NO: 422381 - DNA, 553 bp, Homo sapiens
  misc_feature: GZ8MTXP02HM0OB.15.25.C03.1.454.CMB.2.raw
  modified_base (291)..(291): a, c, t, g, unknown or other
  modified_base (355)..(355): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtcnccacaactcctgatctatttggtctaagtcgggcctccggggtcccctgacaggttcagtggcnggtggatcgaggcatagtatttacactagaaaatcagcagagtggagcgtagaggtacggtttaggggtttattacgtgctatgacgaaggtactaacgaaaccccgtataccgaccgttccggaccggacgggaccaccggccgtaggaacgtaacgttaaaacgaacgtaagtggctacgccacctacttacttcg

SEQ ID NO: 422382 - DNA, 518 bp, Homo sapiens
  misc_feature: GZ8MTXP02G1OB9.15.25.C03.1.454.CMB.2.raw
  modified_base (290)..(290): a, c, t, g, unknown or other
  modified_base (350)..(350): a, c, t, g, unknown or other
tcagtctacgtagccacgaccggtgctcgatttagtagtgtagatttgggtttggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtcnccacaactcctgatctatttggttctaagtcggcctcggggtcccctgacagtcagtgcngtgatcagcatagtatttacactagaaaatcagcagagtggaggctgaggtacggtttggggtttattacgtgcatgacgaaggtctaacgaaacccgatacacttcggacgacggacacgcctaggacgaacgttaaacgaactgtacggcgtcgacaccactctcg

SEQ ID NO: 422383 - DNA, 564 bp, Homo sapiens
  misc_feature: GZ8MTXP02G76XA.15.25.C03.1.454.CMB.2.raw
  modified_base (418)..(418): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatcctcccgcaggtctagtcagacgccctccagcatactgatggatacaacttattggattggtacctgcagaagccagggcagtctccacaactcctgatcttagtttgggttactaacgtccgggtcccgtccggggtcctggacctaggttcagtggcaggtggatcgaggcatagtatttacatagaaatcagagagagtaggaggnggtggggtagggttaggggtttagttagtgtgtagtgtacgtaagtacgtaaccaaacccgtaactacctaccgttaccggaccggacggacgacgccgtacggagtaacgtaacgtaacgtagtgcgcgacacactctcgtcttc

SEQ ID NO: 422384 - DNA, 536 bp, Homo sapiens
  misc_feature: GZ8MTXP02H8WJM.15.25.C03.1.454.CMB.2.raw
  modified_base (293)..(293): a, c, t, g, unknown or other
  modified_base (357)..(357): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgccccgtcacccctggagagccggcctccatctcctgcaggtctagtcagagcctccagcatactgatggatacaactatttggattggtacctgcagaagccagggcagtcnccacaactctgatctatttggtctaagtccgggcctccggggtcccctgacaggttcagtggcngtgatcgaggcatagtatttacactagaaaatcagcagagtggagcgtgaggtacggtttggggtttattacgtgcatgacgaaggtctaacgaaacccgatccaaccgttcggaccgagggaccacgaccgtaggacgaacgttaaaacgaactggtcgactacggacaccatcttcg

SEQ ID NO: 422385 - DNA, 505 bp, Homo sapiens
  misc_feature: GZ8MTXP02H6JIP.15.25.C03.1.454.CMB.2.raw
tcagtctacgtagccacgaccggtgctcgatttagtagtgtagatttgggtttgggtgatcaggactcctcagttcaccttctcacaatgaggctccctgctcagctcctggggctgctaatgctctgggtctctggatccagtggggatattgtgatgactcagtatccactctccctgcccgtcacccctggagagccggcctccatctcctgcaggtctagtcagagcctccagcatactgatggatacaactattggattggtacctgcagaagccagggcagtctccacaactcctgatctatttgggtctaatcgggcctcccggggtccctgacaggttcagtgcagtggatcaggcatagatttacactgaaatcagcagagtggaggctgaggtacgtttgggggtttattacgtgctatgcaaggtctaaccaaacccgatccaccgttcggcgagggacacgcctgagtataaacgaacgtgacgctgcacatc

SEQ ID NO: 422386 - DNA, 538 bp, Homo sapiens
  misc_feature: GZ8MTXP02JSZLM.15.25.C03.1.454.CMB.2.raw
  modified_base (296)..(296): a, c, t, g, unknown or other
  modified_base (359)..(359): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctccagcatactgatggatacaactatttggattggtacctgcagaagccagggcagtctccanaactcctgatctatttgggttctaagtcgggcctccggggtccccctgacaggttcagtggcngtggatcaggcatagtatttacacttagaaaatcagcagagtggaggctggaggtacggttgggggtttattacgtgcatgacaaggtcctaacgaaaccccgatccgaccgttcggaccggagggaccacggcctagggacgtaacttaaacgaactgtggctcgacaccactcttcg

SEQ ID NO: 422387 - DNA, 517 bp, Homo sapiens
  misc_feature: GZ8MTXP02HS8WQ.15.25.C03.1.454.CMB.2.raw
  modified_base (291)..(291): a, c, t, g, unknown or other
  modified_base (333)..(333): a, c, t, g, unknown or other
  modified_base (342)..(342): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtcnccacactctgatctattggtcatcggctcgggtcccctgacngtcagtgcngtgatcgagcatagtatttacactagaaaatcagcagagtggaggctggaggtacggtttggggtttattacgtgcagtgacgaaggttctaacgaaacccgtataccgaccgttcggaccgacgggacacgccgtaggagaacgttaaacgactggtagctgaccaccatctcg

SEQ ID NO: 422388 - DNA, 519 bp, Homo sapiens
  misc_feature: GZ8MTXP02JWHQX.15.25.C03.1.454.CMB.2.raw
  modified_base (474)..(474): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcccgcaggtctagtcagagcctccagcatactgatggatacaactattggattggtacctgcagaagccagggcagtctccacaactcctgatctatttgggttctaagtcgggcctccggggtcctgacagttcagtggcagtgatcaggcatagatttacactagaaatcagcagagtggagctgaggtacgttggggtttatacgtgcatgacgaagtcctaaccgaaacccgtactccaccgttcggccgagggaccncgccgtaggacgacgtaaacgaacgtgtggctgcaccatcagttc

SEQ ID NO: 422389 - DNA, 582 bp, Homo sapiens
  misc_feature: GZ8MTXP02H4TJ3.15.25.C03.1.454.CMB.2.raw
  modified_base (354)..(354): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctcagcatactgatggatacaatatttggattggtacctgcagaagccagggcagtctcacaactctgatctatttgggtctaagtcgggcctccggggtcccctgaccaggttcagtggcngtggatcaggcagtatatttacactgaaaatcaagcagagtggaggcgtgaggacggtttagggggtttattacgttggacagttggacaaagggttacctaaaccgaaaccccgtataccgtacccgttacgggaccgaacggggaccaccgacccgttagggaacgtaacgtttaaaacggaaccgtaaggttcgggaccttcggacctacccgtaattcgttccg

SEQ ID NO: 422390 - DNA, 517 bp, Homo sapiens
  misc_feature: GZ8MTXP02JWC8Z.15.25.C03.1.454.CMB.2.raw
tcagtctacgtagccacgaccggtgctcgatttagtagtgtagatttgggtttggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcccgcaggtctagtcagagcctccagcatactgatggatacaactattggattggtacctgcagaagccagggcagtctccacaactcctgatctatttgggttctaatcgggcctccggggtcctgacaggttcagtggcagtggatcatgcatagtatttacactagaaaatcagcagagtggaggctgaggtacgttggggtttattacgtgcagtgacaaggtctaacaaacccgatcaccgttcggccgacgggacacggcctaggacgacttaaacgaactgtacggctcgcacactctcg

SEQ ID NO: 422391 - DNA, 570 bp, Homo sapiens
  misc_feature: GZ8MTXP02HMWGA.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatcctcccgcaggtctagtcagagcctccagcatactgatggatacaactattggattggtacctgcagaagccagggcagtctccacaactcctgatctatttgggttctaagtccgggcctccggggtcctgacaggttcagtgcagtggatcaggcatagattttacactagaaatcagcagagtggagcgtaggaggtacggttaggggtttattacgtggtcagtgacgaaggtacctaaccgaaaccccgactacctaccgttcggaccggacgggaccgacggaccgtagggaaacgtaacgttaaaaccgtaacgtaggtaaggcgtacggaccaacctacgtccttacgttccc

SEQ ID NO: 422392 - DNA, 564 bp, Homo sapiens
  misc_feature: GZ8MTXP02G3L8W.15.25.C03.1.454.CMB.2.raw
  modified_base (290)..(290): a, c, t, g, unknown or other
  modified_base (352)..(352): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttgattggtacctgcagaagccagggcagtcncacaactctgatctatttggtctaagtcggcctcggggtccccctgactaggttcagtggcnggtggatcgagcagtagtatttacactagaaaatcagcaggagtggaggctaggagggtacggtttgggggtttaattacgtgcagtagacgaaaggtctaaacgaaaccccgtataccgtaaccgttcggaccggacggggaccaacggccgtagggaacgtaacgttaaaacgtaacgtggtacggaccgtacgacgacctacgtcttcg

SEQ ID NO: 422393 - DNA, 542 bp, Homo sapiens
  misc_feature: GZ8MTXP02IJ3GP.15.25.C03.1.454.CMB.2.raw
  modified_base (344)..(344): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcagcatactgatggatacaactattggattggtacctgcagaagccagggcagtctccacaactcctgatctatttgggtctaagtcgggcctccccggggtccctgacnggttcagtggcagtgatcaggcatagatttacactagaaatcagcagagtggaggcgtaggagggtacggtttggggtttatttacgtgctagtgacgtaaggtactaacgaaacccgataccaaccgttcggaccgacgggacacggaccgtaggaacgtaagtaaaacgaacgtgtacggctacgaccacctatcg

SEQ ID NO: 422394 - DNA, 533 bp, Homo sapiens
  misc_feature: GZ8MTXP02GIRO5.15.25.C03.1.454.CMB.2.raw
  modified_base (292)..(292): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagagccggcctccatctcctgcaggtctagtcagagcctccagcatactgatggatacaactatttggattggtacctgcagaagccagggcagtcnccacaactcctgatctatttgggtctaagtcgggcctcccggggtcctgacaggttcagtggcagtggatcaggcatagatttacactgaaatcagcagagtggaggctggaggtacggtttgggggtttaattacgtgcagtgacaaggtcctaaacgaaaccccgatccaaccgttccggaccgagggaccacggccgtaggaacgaattaaaacgaacgtgtcggactgacaccatcg

SEQ ID NO: 422395 - DNA, 661 bp, Homo sapiens
  misc_feature: GZ8MTXP02H9MSJ.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcaccctggagagccggcctccatctcctgcaggtctagtcagacgcctcagcatactgatgaatacaactatttggattggtacctgacagaagccgaagggcagtcctaccaacaactcctagattcttagttttggtactaaacgtccggggccgttccggggtccccctaggacgtacgggttcaggtggacaggttgactcgaggacctaagtaagttactttaacaactaagaaaactcgagacgaaggtagtagggaacggtcgtggaagggttacgggtttagggtttacttacgtgactagtacgacgtaaacggtaccgtaaacccgtaaacccggtactaccgtaaccggttaccgggaccgggtaaacgggaccaaccggtaccggtaacgggtaacgttaaaacgttaaaacggaccgttaaggtcggtaaccgttcggaaccgtaccgttacttacgtttccg

SEQ ID NO: 422396 - DNA, 578 bp, Homo sapiens
  misc_feature: GZ8MTXP02HEB2V.15.25.C03.1.454.CMB.2.raw
  modified_base (352)..(352): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacactctgatctatttggtctaagtcgggcctccggggtcccctgacaggttcagtgcnggtgatcgagcatagtatttacacttagaaatcagcagagtggaggctaggagggtacggttggggtttaatacgttgactagtgacgtaaggtacctaaccgaaaaccccgtataccgaccgtttccgggaccggacgggaccgaaccggtccgtagggaaacgtaaacgttaaaaccggaaacgttggtacggccgttacggaccaaccgtaactacgtttcgg

SEQ ID NO: 422397 - DNA, 550 bp, Homo sapiens
  misc_feature: GZ8MTXP02HNRTE.15.25.C03.1.454.CMB.2.raw
  modified_base (291)..(291): a, c, t, g, unknown or other
  modified_base (354)..(354): a, c, t, g, unknown or other
  modified_base (432)..(432): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtcnccacaactcctgatctatttggtctaagtcgggcctccggggtcccctgacaggttcagtgcngtggatcgaggcataagtatttacactagaaaatcagcagagtggaggctgaggtaggtttggggtttattacgtganagtgacgaaggtactaaccgaaaccccgataccgaaccgttcggaccggaacgggaccaacgccgtacggaacgtaacttaaaacgaacgtaagtcggacgtacgacaccattactcg

SEQ ID NO: 422398 - DNA, 558 bp, Homo sapiens
  misc_feature: GZ8MTXP02FWCCY.15.25.C03.1.454.CMB.2.raw
  modified_base (355)..(355): a, c, t, g, unknown or other
  modified_base (457)..(457): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacactcctgatctatttgggttctaatcgggcctccggggtcccctgacaggttcagtggcngtgatcaggcatagtatttacactagaaatcagcagagtggaggctgaggtacggttggggtttattacgtgcagtgacgaaggtactaacgaaaccccgtntacctaaccgttcgggacccgacgggaccgacggtacccgtagggacgtaaacgttaaacgaaacgtggtacggtactacggaccaaccagttacctttcg

SEQ ID NO: 422399 - DNA, 551 bp, Homo sapiens
  misc_feature: GZ8MTXP02IERSD.15.25.C03.1.454.CMB.2.raw
  modified_base (291)..(291): a, c, t, g, unknown or other
  modified_base (357)..(357): a, c, t, g, unknown or other
  modified_base (454)..(454): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtcnccacaactcctgatctagtttggtctaaagtccgggcctccggggtcccctgacaggtcagtggcngtgatcaggcatagtatttacactagaaatcagcagagtggagcgtgaggtagtttggggtttatacgtgcagtgacaaggtactaacgaaacccgntaccgtaccgttcggaccgaacgggaccacgccgtagggaacgtaacgtttaaaacgaaaccgttggtacggcgtacggacctacctaacttcttcg

SEQ ID NO: 422400 - DNA, 553 bp, Homo sapiens
  misc_feature: GZ8MTXP02HNF0Q.15.25.C03.1.454.CMB.2.raw
  modified_base (351)..(351): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagagccagggcagtctcacaactctgatctatttgggtctaagtcgggcctccggggtcccctgacagttcagtgcngtgatcagcatagatttacactagaaaatcagcagagtggaggctgaggtacgtttggggtttattacgttgctagtgacgaaggtctaaccgaaaccccgtataccgaaccgttccgggaccggaacggggtaccgaccgtcccgtagggaacgaaacgttaaaacgaaacgtggtcggactcggacaccgtattacttcg

SEQ ID NO: 422401 - DNA, 518 bp, Homo sapiens
  misc_feature: GZ8MTXP02I13JW.15.25.C03.1.454.CMB.2.raw
  modified_base (301)..(301): a, c, t, g, unknown or other
  modified_base (356)..(356): a, c, t, g, unknown or other
tcagtctacgtagccacgaccggtgctcgatttagtagtgtagatttgggtttggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactccngatctatttgggttctaatcgggcctccggggtccccctgacaggttcagtggcngtgatcaggcatagatttacactagaaaatcagcagagtggaggctgaggtacggtttggggtttattacgtgcagtgacaaggtctaacaaaccccgataccacttcggaccgagggacacgctaggacgacttaaacgaactgtggctcgcaccatctcg

SEQ ID NO: 422402 - DNA, 526 bp, Homo sapiens
  misc_feature: GZ8MTXP02J2CDX.15.25.C03.1.454.CMB.2.raw
  modified_base (358)..(358): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctcagcatactgatggatacaactatttggattggtacctgcagaagccagggcagtctccacaactcctgatctatttgggtctaatccggggcctccggggtccccctgacaggttcagtggcngtggatcaggcatagattttacactagaaaatcagcagagtggagctagaggtacgttggggttatacgtgcatgacaaggtctaacgaaacccgataccaaccgttcggaccgaggggaccacggcctaggacgaacttaaacgaactgtggctcgacaccatctcg

SEQ ID NO: 422403 - DNA, 563 bp, Homo sapiens
  misc_feature: GZ8MTXP02JD1HZ.15.25.C03.1.454.CMB.2.raw
  modified_base (356)..(356): a, c, t, g, unknown or other
  modified_base (408)..(408): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggacctgcagaagccagggcagtctccacaactcctgatctatttgggtctaagtcgggcctccggggtcccctgactaggttcaggtggcnggtggatcgaggcatagtatttacactagaaaatcgagacagagtaggaggngtaggaggtacggtttggggtttattacgtgactagtagacgaaggtactaaccgaaaccccgataccgtaacccgttcgggaccggacgggaccaccggaccgtagggacgtaaacgttaaacgaacgtggtacggctacgacacctatcttcg

SEQ ID NO: 422404 - DNA, 549 bp, Homo sapiens
  misc_feature: GZ8MTXP02HOXJB.15.25.C03.1.454.CMB.2.raw
  modified_base (299)..(299): a, c, t, g, unknown or other
  modified_base (382)..(382): a, c, t, g, unknown or other
  modified_base (386)..(386): a, c, t, g, unknown or other
tcagtctacgtagccacgaccggtgctcgatttagtagtgtagatttgggtttgggtgatcaggactcctcagttcaccttctcacaatgaggctccctgctcagctcctggggctgctaatgctctgggtctctggatccagtggggatattgtgatgactcagtatccactctccctgcccgtcacccctggagagccggcctccatctcctgcaggtctagtcagagcctccagcatactgatggatacaacttattggattggtacctgcagaagccagggcagctccacactcngatctattggtctaagtcgggcctcccggggtccctgacaggttcagtggctagtggatcaggcatagatttacatagaaatnaganagagtaggaggagtagtaggtaggttaggtttagttagtagtacgagtagtacgtacgtacgtaaccgaaccgtacgtacgtaccgtaccggaccggacggacgacgacgtacggaacgtaacgtaaacgtaacgtacgtacgtacgtacgaccactactacg

SEQ ID NO: 422405 - DNA, 518 bp, Homo sapiens
  misc_feature: GZ8MTXP02F9T6N.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactcctgatctatttgggtctaatcgggcctcccggggtccctgacaggttcagtggcagtggatcaggcatagatttacactagaaatcagcagagtggaggctggacggtagttgggggtttattacgtgcatgacaaggtctaacaaacccgatacgaccgttcggaccgaggacgacgccgaggacgattaaacgaacgtgtgactgcaacctactcg

SEQ ID NO: 422406 - DNA, 573 bp, Homo sapiens
  misc_feature: GZ8MTXP02GHPW3.15.25.C03.1.454.CMB.2.raw
  modified_base (399)..(399): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcagcatactgatggatacaactattggatggtacctgcagaagccaggcagtctcacaactcctgatctagtttggtactaagtcgggcctccggggtcccctgactaggttcagtggcagtgatcgagcatagtatttacaactagaaaatcagcagagtggagntagaggtaggtttgggtttattacgtgcagtgacgtaaggtactaaccgaaaacccgtataccgtaacccgttcggacccggaaggggaccaccggacccgttaacgggaacgtaaacgtttaaaaccgaaaacgttaagtacgggcttacggacaacccgtagttaccttacg

SEQ ID NO: 422407 - DNA, 619 bp, Homo sapiens
  misc_feature: GZ8MTXP02IKD26.15.25.C03.1.454.CMB.2.raw
  modified_base (291)..(291): a, c, t, g, unknown or other
  modified_base (352)..(352): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtcnccacaactctgatctagtttggtctagtcgggcctccggggtcccctgacagttcagtgcnggtgatcgagcaatagtatttacactagaaaatcagcagagtaggaggtcgtagagggtaacggtttgggggtttaattacgtgtactagtaggaccgtaaaggttacctaaacccgtaaaacccccggtattacccgtaacccgtttaccggggacccggtaacggggaacccgaaccggtacccgtaaggggtaaacgtaaaacgtttaaaacggaaacgttggtacggtacgttcggacctaacccgtaagtttacctttacgg

SEQ ID NO: 422408 - DNA, 585 bp, Homo sapiens
  misc_feature: GZ8MTXP02JVBIM.15.25.C03.1.454.CMB.2.raw
  modified_base (301)..(301): a, c, t, g, unknown or other
  modified_base (351)..(351): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacactccngatctatttgggtctagtcgggcctcggggtcccctgacagttcagtgcngtgatcgagcatagtatttacactagaaatcagcagagtggagcgtgaggtacggtttggggtttattacgtgcagtgacgtaaggtacctaaccgaaaccccggtatacccgtaacccgttccgggacccgggaacggggaccgaccggtacccgttagggaacgtaaacgtttaaaaccggaaacgttcggtacgggtaccttacggaccctaccctaacgttacgtttccg

SEQ ID NO: 422409 - DNA, 537 bp, Homo sapiens
  misc_feature: GZ8MTXP02G8O6X.15.25.C03.1.454.CMB.2.raw
  modified_base (297)..(297): a, c, t, g, unknown or other
  modified_base (348)..(348): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagagccaggcagtctccacactcngatctatttggtctaagtcggcctccggggtccccctgacaggtcagtgcngtgatcgagcatagtatttacactagaaatcagcagagtggaggctagaggtacggttggggtttattacgtgcagtgacgaaggtactaaccaaacccgataccgaccgttacggaccggacgggaccacggccgtaggaacgtaacgttaaacgaacgtaagtcggactacggacaccactcgttcg

SEQ ID NO: 422410 - DNA, 629 bp, Homo sapiens
  misc_feature: GZ8MTXP02GV22J.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcccgcaggtctagtcagagcctccagcatactgatggatacaactattggattggtacctgcagaagccagggcagtctccacaactcctgattctatttgggttctaagtccgggccgtccggggtcctgacagttcagtggcagtggatcaggcatagtatttacactagaaaatcagcagagtggaggcgtaggagggtacggtttagggggtttatttacgtgtactagtcggacgtaaacggttacctaaaccgaaaacccccgtacttaccgtaacccgttaccgggacccgggaacggggacccgaccgggtacccgtacggggtaaacggttaaacgttaaaaaccggtaacgttagggtaacggtaccgttacggtacccgaaccctacgttaccgttacgtttacccg

SEQ ID NO: 422411 - DNA, 553 bp, Homo sapiens
  misc_feature: GZ8MTXP02HAPT0.15.25.C03.1.454.CMB.2.raw
  modified_base (354)..(354): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacactcctgatctatttggtctaatcgggcctccggggtccccctgacaggttcagtggcnggtggatcgaggcagtagtatttacactagaaaatcagcagagtggaggcgtaggagggtacggtttaggggtttattacgttgctagtgacgtaaggtactaaccaaacccgataccgaccgttcggaccgacgggaccacggccgtagggaacgtaactaaacgaacgtggtcggactacgaccacctacgtcttcg

SEQ ID NO: 422412 - DNA, 525 bp, Homo sapiens
  misc_feature: GZ8MTXP02G2G3G.15.25.C03.1.454.CMB.2.raw
  modified_base (356)..(356): a, c, t, g, unknown or other
  modified_base (463)..(463): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggtctaagtcgggcctccggggtccccctgactagtcagtggcngtgatcgaggcatagtatttacactagaaaatcagcagagtagaaaggcgtaggaggtacggtttggggtttattacgtgcagtgacgaaggtctaacgaaacccgntacacgtcggccgaggacacgcctaggacgtacgtaacgaacgtgtgactcgcaccatctcg

SEQ ID NO: 422413 - DNA, 515 bp, Homo sapiens
  misc_feature: GZ8MTXP02F5Z4V.15.25.C03.1.454.CMB.2.raw
  modified_base (356)..(356): a, c, t, g, unknown or other
  modified_base (458)..(458): a, c, t, g, unknown or other
  modified_base (484)..(484): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactcctgatctatttgggttctaatcgggcctccggggtccccctgacaggttcagtggcngtggatcgaggcatagtattttacactagaaatcagcagagtggaggctaggaggtacggttggggtttattacgtgcagtgcaaggtctaacgaaacccgntacaccgttcggacgaggacacgccnggagactaagacgtgtagctcgcacatctcg

SEQ ID NO: 422414 - DNA, 521 bp, Homo sapiens
  misc_feature: GZ8MTXP02IVJZW.15.25.C03.1.454.CMB.2.raw
tcagtctacgtagccacgaccggtgctcgatttagtagtgtagatttgggtttggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcccgcaggtctagtcagagcctccagcatactgatggatacaactattggattggtacctgcagaagccagggcagtctccacaactcctgatctatttggttctaagtcggcctcggggtcctgacaggttcagtgcagtggatcaggcatagattttacactagaaatcagcagagtggaggcgtgagacgttagggtttagttacgtgtcagtgacgaagtacgtacaaacccgaactactacctcgcgacggacgacgaccgtggacgagtaaacgtaacgtagtggcgtcgacaccactctcgttc

SEQ ID NO: 422415 - DNA, 551 bp, Homo sapiens
  misc_feature: GZ8MTXP02IHB3C.15.25.C03.1.454.CMB.2.raw
  modified_base (357)..(357): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaatatttggattggtacctgcagaagccagggcagtctccacaactctgatctagtttgggtctaagtccgggcctccggggtcccctgactaggttcagtggcnggtgatcgaggcatagtatttacactagaaaatcagcagagtggaggctagaggtacgtttggggtttattacgtgcatgacgaggtactaacgaaacccgatacgaccgttcggaccggaaggggaccacggccgtagggaacgtaaagtttaaaacgaacgttggttacggacgtcgaccacctatccttcg

SEQ ID NO: 422416 - DNA, 540 bp, Homo sapiens
  misc_feature: GZ8MTXP02IG1SM.15.25.C03.1.454.CMB.2.raw
  modified_base (358)..(358): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccgagggcagtctccacaactctgatctagtttggtctaagtccgggcctccggggtcccctgacaggttcaggtggcnggtgatcgaggcatagtatttacatagaaatcagcaggagtggaggctggagggtacggtttagggggtttaattacgtgctatgacaaggtactaacaaacccgatcgaccgttcggaccggaggacacggccgtaggacgtaacttaacgaacgtgtacggctacgactacctatcttcg

SEQ ID NO: 422417 - DNA, 543 bp, Homo sapiens
  misc_feature: GZ8MTXP02IZOOG.15.25.C03.1.454.CMB.2.raw
  modified_base (348)..(348): a, c, t, g, unknown or other
  modified_base (382)..(382): a, c, t, g, unknown or other
  modified_base (387)..(387): a, c, t, g, unknown or other
  modified_base (392)..(392): a, c, t, g, unknown or other
  modified_base (420)..(420): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctcacaactctgatctatttggtctaagtcggcctccggggtcccctgacagtcagtgcngtgatcagcatagtatttacatagaaaatcaganagagnggagngagaggtaggttagggtttagttagtgngagtagacgtacgtactaaccaaaccgactacctaccgtacggtaccggacggacgaccgacgtacggaacgtaaacgtaaacgtaacgtaacggtacggtacgtacgacgacctactactcg

SEQ ID NO: 422418 - DNA, 596 bp, Homo sapiens
  misc_feature: GZ8MTXP02FOH6R.15.25.C03.1.454.CMB.2.raw
  modified_base (257)..(257): a, c, t, g, unknown or other
  modified_base (284)..(284): a, c, t, g, unknown or other
  modified_base (394)..(394): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactnttgattggactgcagagcaggcagtcncacactctgatctagttggttactaagtcgggccgtccggggtcccctgactaggttcaggtggcagtggatcgagcatagtatttacatagaaatcagcagagtggagntaggaggtacggtttggggttattacgtgtacagtagacgtaacggtacctaaccgtaaaaccccgtatacccgtaaccgttccgggacccggtaacggggaaccgtaaccgggacccggttaagggaaacgttaaaacgttaaaaccggaaaccgttgggtaacggcctacggaccctaaccgtaacttaccggtttaccg

SEQ ID NO: 422419 - DNA, 563 bp, Homo sapiens
  misc_feature: GZ8MTXP02ICI80.15.25.C03.1.454.CMB.2.raw
  modified_base (338)..(338): a, c, t, g, unknown or other
  modified_base (350)..(350): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcaccctggagagccggcctccatctcctgcaggtctagtcagagcctcagcatactgatggatacaactatttgattggtacctgcagaagccgagggcagtcaccacaactctgatctatttggtctaagtcggcctcgggtccccctgacnggttcagtggcngtgatcgaggctatagtatttaacacaagaaaatcagcaggagtggaggctggtaaggtacggtttggggtttattacgttgactagtgagtaaacggtacctaaccgaaaccccgtataccgtaccgttaccgggaccggacgggaccaaccggtccgttaaggaacgtaacgttaaaacgacgtggtacggctcggacctaccattcgtcg

SEQ ID NO: 422420 - DNA, 552 bp, Homo sapiens
  misc_feature: GZ8MTXP02J1PX2.15.25.C03.1.454.CMB.2.raw
  modified_base (290)..(290): a, c, t, g, unknown or other
  modified_base (294)..(294): a, c, t, g, unknown or other
  modified_base (300)..(300): a, c, t, g, unknown or other
  modified_base (304)..(304): a, c, t, g, unknown or other
  modified_base (353)..(353): a, c, t, g, unknown or other
tcagtctacgtagccacgaccggtgctcgatttagtagtgtagatttgggtttggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctcagcatactgatggatacaactatttggattggtacctgcagaagccagggcagtcnccanactccngatntatttgggtctaatccgggctccggggtcccctgacaggttcagtggcngtgatcagcatagatttacatagaaatcagcagagtggagctggaggacggtttggggttatacgtgctagtgacaaggtctaaccgaaaccccgataccgacccgttcgggacccggaggggacccacggaccgttagggaacgtaaacgtttaaaacggaaccgtggtacggctacggacctacccgtattcttacg

SEQ ID NO: 422421 - DNA, 512 bp, Homo sapiens
  misc_feature: GZ8MTXP02GJP6K.15.25.C03.1.454.CMB.2.raw
  modified_base (357)..(357): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccccctgacaggttcagtggcngtgatcagcatagattttacactagaaaatcagcagagtggaggctagaggtacgttggggtttattacgtgcatgcaaggtctacaaacccgatacacttcggcgaggacacgcctaggacgactaaacgactgtacggctcgcaccgatctcg

SEQ ID NO: 422422 - DNA, 512 bp, Homo sapiens
  misc_feature: GZ8MTXP02JMC5P.15.25.C03.1.454.CMB.2.raw
  modified_base (355)..(355): a, c, t, g, unknown or other
tcagtctacgtagccacgaccggtgctcgatttagtagtgtagatttgggtttggggatcaggactcctcagttcaccctctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggtctaatcgggcctccggggtccccctgacaggttcagtggcngtggatcaggcatagattttacactagaaaatcagcagagtggaggctgaggtacggttggggtttattacgtgcagtgcaaggtctacaaacccgatccactcggcgaggacacgcctaggacgaacgttaacgaactgtgactcgacacactctg

SEQ ID NO: 422423 - DNA, 519 bp, Homo sapiens
  misc_feature: GZ8MTXP02JVGUQ.15.25.C03.1.454.CMB.2.raw
  modified_base (357)..(357): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccccctgacaggttcagtggcngtggatcaggcatagatttacactagaaaatcagcagagtggaggctgaggacgttggggtttatacgtgcatgcaaggtctaacaaaccccgatcaccgttcggccgagggacacgccgtggacgacttaaacgaacgtgtacggctcgcaccacgtctcg

SEQ ID NO: 422424 - DNA, 513 bp, Homo sapiens
  misc_feature: GZ8MTXP02JDH7T.15.25.C03.1.454.CMB.2.raw
  modified_base (291)..(291): a, c, t, g, unknown or other
  modified_base (301)..(301): a, c, t, g, unknown or other
  modified_base (352)..(352): a, c, t, g, unknown or other
  modified_base (365)..(365): a, c, t, g, unknown or other
  modified_base (370)..(370): a, c, t, g, unknown or other
  modified_base (376)..(376): a, c, t, g, unknown or other
  modified_base (380)..(380): a, c, t, g, unknown or other
  modified_base (382)..(382): a, c, t, g, unknown or other
  modified_base (384)..(384): a, c, t, g, unknown or other
  modified_base (386)..(386): a, c, t, g, unknown or other
  modified_base (396)..(396): a, c, t, g, unknown or other
  modified_base (398)..(398): a, c, t, g, unknown or other
  modified_base (419)..(419): a, c, t, g, unknown or other
  modified_base (421)..(421): a, c, t, g, unknown or other
tcagtctacgtagccacgaccggtgctcgatttagtagtgtagatttgggtttgggggagtcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtcnccacaactcngatctatttgggtctaagtcggcctccggggtcccctgacagttcagtgcngtgatcagcatanattanactaanaaananananagagaggagngngagtaggttaggttagtatgnanagagaagtacaacaaaccgactactactacgacgacggacgacgacgacgacgaactaaacgaacgtaagtacgacgacgacacactactcg

SEQ ID NO: 422425 - DNA, 602 bp, Homo sapiens
  misc_feature: GZ8MTXP02GX5QF.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcggtctccactctccctgcccgtcacccctggagagccggcctccatctcctgcaggtctagtcagacgcctccagcatactgatggatacaatattggattcggtacctgacaagaacgccgaagggcagtcctccaacaactcctgattcttatttgggttactaagtccggggcctccggggtcctgacctaggttcaggtggacagtggatcgaggcaagtagtacttttaacactagaaaatcgaagacaaggagtgggaggtcgtaggagggtacggtttaggggtttaattaacgtgtacagtaggacgtaacggtacctaaaccgaaaccccgataccctaaccgttcgggaccggaacggaccgacgaccgtaggaaacgtaacgtaaaaccgaacgtcgtaacggcgtacgaccacctactcgtacgttcc

SEQ ID NO: 422426 - DNA, 555 bp, Homo sapiens
  misc_feature: GZ8MTXP02HC2VU.15.25.C03.1.454.CMB.2.raw
  modified_base (346)..(346): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagccctccagcatactgatggatacaactatttggattggtacctgcagaagccagggcagtctccacaactcctgatctatttggttctaagtcgggcctccccggggtcctgacnggttcagtgcagtgatcaggcatagtatttacactagaaatcagacagagtggaagcgtggtagggtacgtttaggggttatttacgtgcagtgactaaggtacctaacgaaaccccgtatccaccgttcggaccgtaagggaccacggaccgtaggaacgaacgttaaaacgaaccgttagtacggtactacgacctaccgagttccg

SEQ ID NO: 422427 - DNA, 619 bp, Homo sapiens
  misc_feature: GZ8MTXP02JVN19.15.25.C03.1.454.CMB.2.raw
  modified_base (355)..(355): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactcctgatctatttggtctaagtcgggcctccggggtccccctgactaggtcagtggcngtggatcgaggcatagtatttacactagaaatcagcagagtggagcgtaggagggtacggtttggggtttattacgtgtacgtagtggacgtaaacgggttacctaaacccgaaaacccccggtacttaccgtacccgtttacccgggacccggaacggggaacccgaccgggtacccgttagggaacgtaaaccgtttaaaaaccggaaccgttaagggttacgggaccgttacggaccgtaacccctaagttaccctttacg

SEQ ID NO: 422428 - DNA, 546 bp, Homo sapiens
  misc_feature: GZ8MTXP02G3M41.15.25.C03.1.454.CMB.2.raw
  modified_base (355)..(355): a, c, t, g, unknown or other
  modified_base (469)..(469): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacactcctgatctatttgggtctaagtcgggcctccggggtcccctgactaggtcagtggcnggtggatcgagcatagtattttacactagaaatcagcaggaggtggaggcgtaggagggtacggtttggggtttattacgtgactagtgacgtaaggtcctaaccgaaacccgntaccgaccgttcggaccgacgggaccacgccgtaggacgtacgttaaacgaacgtgtcggctcgaccaccatcgtcg

SEQ ID NO: 422429 - DNA, 554 bp, Homo sapiens
  misc_feature: GZ8MTXP02GYC63.15.25.C03.1.454.CMB.2.raw
  modified_base (290)..(290): a, c, t, g, unknown or other
  modified_base (298)..(298): a, c, t, g, unknown or other
  modified_base (348)..(348): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtcncacactcngatctatttggtctaagtcggcctcggggtcccctgactagtcagtggcngtgatcgagcatagtatttacatagaaatcagcagagtggaggcgtagaggtacggtttggggtttaattacgtgctagtgacgtaaggtactaaccgaaaccccgataccgaaccgttccgggaccggacgggaccaccggtaccgtagggaacgtaaacgttaaacgaacgtggtcggtcgtacggaccaccgtactcgtttcg

SEQ ID NO: 422430 - DNA, 583 bp, Homo sapiens
  misc_feature: GZ8MTXP02G97Z2.15.25.C03.1.454.CMB.2.raw
  modified_base (290)..(290): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagagccggcctccatctcctgcaggtctagtcagagcctccagcatactgatggatacaactattggattggtacctgcagaagccaggcagtcnccacactcctgatctatttggtctaagtccggcctccccggggtcctgacaggttcagtggcagtggatcaggcatagtatttacactagaaatcagacaggagtgggaaggcgtaggtaagggtacggtttagggggtttatttaacgtggtactaagttcgacgtaaagggtacctaaaccgaaaccccgatccgaaccgttcggaccggtaacgggaccaacggccgtagggaacgtaacgttaaaaccgtaacgtaggtacggccgttacggacctaccgacgtttccg

SEQ ID NO: 422431 - DNA, 506 bp, Homo sapiens
  misc_feature: GZ8MTXP02HV38G.15.25.C03.1.454.CMB.2.raw
  modified_base (285)..(285): a, c, t, g, unknown or other
  modified_base (395)..(395): a, c, t, g, unknown or other
  modified_base (447)..(447): a, c, t, g, unknown or other
tcagtctacgtagccacgaccggtgctcgatttagtagtgtagatttgggtttgggtgatcaggactcctcagttcaccttctcacaatgaggctccctgctcagctcctggggctgctaatgctctgggtctctggatccagtggggatattgtgatgactcagtatccactctccctgcccgtcacccctggagagccggcctccatctcctgcaggtctagtcagagcctcagcatactgatggatacaactattggattggacctgcagagcaggcagtcnccacaactcctgatctatttgggtctaagtcggggcctccccggggtccctgacaggttcagtggcagtgatcagcatagatttacatagaaatcagcagagtaggaggntgaggtacggtttggggtttattacgtgcatgacaggtactaacaaacccgntaccacgttcggacgaggacacgctaggacaactaacgaacgtgtacggctgcaccatc

SEQ ID NO: 422432 - DNA, 559 bp, Homo sapiens
  misc_feature: GZ8MTXP02HEGCP.15.25.C03.1.454.CMB.2.raw
  modified_base (353)..(353): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggtctaagtcggcctcggggtcccctgacaggttcagtgcngtgatcaggctatagtatttacactagaaaatcaagcagagtggaggctggaggtaacggtttggggtttaattacgtgctatgaccgaaggtctaacaaaaccccgataccgtaaccgttcgggaccgacggggacaacggacccgtagggaacgaaagtttaaaaccggaaaactggtaggccttaggccaccctaatacttcg

SEQ ID NO: 422433 - DNA, 499 bp, Homo sapiens
  misc_feature: GZ8MTXP02I9ZP1.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccccggggtcctgacaggttcagtgcagtgatcaggcatagatttacactagaaatcagcagagtggaggctggaggacggtttggggttattacgtgacgatgcaaggtctaacaacccgatcactcggcgaggacacgctgagataaacgaacgtgtgctgcaccatc

SEQ ID NO: 422434 - DNA, 600 bp, Homo sapiens
  misc_feature: GZ8MTXP02GSO19.15.25.C03.1.454.CMB.2.raw
  modified_base (421)..(421): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctccagcatactgatggatacaactattggattggtacctgacagaagccgaggcagtcaccacaactctgattctagtttgggttactaaagtccggggcctccggggtccccctagaccgtaggttcaggtcggcaggtggatcgagcaatagtatttacactagaaaatcagacagagtaggaggntaggaggtaggttgggtttaagttacgttgagtagtagaacgtaacggtacttaaccgaaacccgtactaccgtaaccgttccggaccggacgggaccgaccgaccggtaacggtaagtaaaacgttaaaacgtaaaccgtaaggttcggacgtacgactaaccaacttacgtttaccg

SEQ ID NO: 422435 - DNA, 653 bp, Homo sapiens
  misc_feature: GZ8MTXP02IVOMR.15.25.C03.1.454.CMB.2.raw
  modified_base (371)..(371): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcgaagacgacggagcacgtccaccaactacctctagtacttactttaggtttcgttaactacggtccggtccggtcccggtccgtacgacgtcgtacnggtcgagtagggtgtactacgagactagtaatttactaactagtaaataacagagagagtggaggacgtgaggtaggttaggggtttaggtttactagtgagtagtacgtaacgtaacggtaacctaaaccccggtaaaccgtactacccgtaaacccggtccggggaacgggaaccggtaccgaccccggtacggtacgggtaaacgttaaaacggttaaaacccgtaacggttaagggtacggtcgtacccgaaacgtaccgtaacgtttcgtttaaccg

SEQ ID NO: 422436 - DNA, 552 bp, Homo sapiens
  misc_feature: GZ8MTXP02JFC4L.15.25.C03.1.454.CMB.2.raw
  modified_base (356)..(356): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggtctaagtcgggcctccggggtcccctgacaggttcagtggcngtgatcgagcatagatttacactagaaaatcagcagaggtggaggctaggaggtacggtttaggggtttattacgttgactagtagacgaaggtactaacgaaacccgataccaccgttcggaccggagggaccaacggccgtagggacgtaacgttaaacgaacgtggtacggactcggacacctacgtacttcg

SEQ ID NO: 422437 - DNA, 541 bp, Homo sapiens
  misc_feature: GZ8MTXP02JZP9S.15.25.C03.1.454.CMB.2.raw
  modified_base (343)..(343): a, c, t, g, unknown or other
  modified_base (354)..(354): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctccagcatactgatggatacaactattggattggtacctgcagaagccagggcagtctccacaactcctgatctatttgggtctaagtcggcctccggggtcccctgacnggttcagtgcngtgatcgagcatagtatttacactagaaatcagcaggagtggaggcgtaggagggtacggtttggggtttattacgtgcagtgacgtaaggtacctaaccgaaaccccgataccgtaccgttcggaccggacgggacacgccgtaggacgacttaaaacgacgtgtacggctacgacacacgtctcg

SEQ ID NO: 422438 - DNA, 671 bp, Homo sapiens
  misc_feature: GZ8MTXP02HXYXU.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactcctcctcgcccgtccacccgtggagacgcccggcctccactcctcccgacgtacggtctagtcaaggacgtccctaccagactaattacgtagagtaggaactaactaacttagttaggtattcggtacctgacaagaacgccgaggcacgtcctaccaacacctcgtagtacttctttagtttcgggttactaacggtccgggtccgtcccggggtcctacgacgtacggttcgaggtcggactaggtggactacgaggtactaagttacgttaacttttaacacgtaaagaaaactcgaagagaagtaggtagggaggtcgtagggaggttacgggtttagggtttacttagtgtacgtagtacggacgtaaggtacctaaaccgaaacccgtctacccgtaccgtacggaccggtacggaccaccggaccgtaggaacgtaaacgttaaaccgaagttcggaacggtctacggacctaactcttacgttacgttcc

SEQ ID NO: 422439 - DNA, 576 bp, Homo sapiens
  misc_feature: GZ8MTXP02HY6YN.15.25.C03.1.454.CMB.2.raw
  modified_base (286)..(286): a, c, t, g, unknown or other
  modified_base (289)..(289): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagagccggcctccatctcctgcaggtctagtcagagcctcagcatactgatggatacaactattggattggactgcagaagcaggcagtcncanactctgatctattggtactaagtcgggcctccccggggtcctgacaggttcaggtgcagtgatcgagcatagtatttacactagaaatcgagacagagtaggaggcgtaggaggtacggtttggggtttattacgtgacgatgacgtaacggtactaaccgaaacccgtagtacccgaaccgtttccgggacccggtacggggaaccaccgggacccgttagggaacgtaaacgttaaaacccggaacgtttggtaacggcgttacggaccaacccgtaagtttccg

SEQ ID NO: 422440 - DNA, 530 bp, Homo sapiens
  misc_feature: GZ8MTXP02IRRVT.15.25.C03.1.454.CMB.2.raw
  modified_base (353)..(353): a, c, t, g, unknown or other
tcagtctacgtagccacgaccggtgctcgatttagtagtgtagatttgggtttggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggtctaatcgggctccggggtcccctgacaggttcagtggcngtgatcgaggcatagattttacactagaaaatcagcagagtaggaggctagagggtacggtttggggtttattacgttgcatgcaaggtactacaaaaccccgatacaccttcggaccgagggacacgacctcggagtaacttaaacgaactgtacggcttacgcaaccatacttcg

SEQ ID NO: 422441 - DNA, 555 bp, Homo sapiens
  misc_feature: GZ8MTXP02FZ04F.15.25.C03.1.454.CMB.2.raw
  modified_base (352)..(352): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacactctgatctatttggttctaagtcggcctccggggtcccctgacaggtcaggtggcngtggatcgaggcaatagtatttacactagaaatcagcagagtggaggtcgtagagggtacggtttaggggtttattacgtgactagtagacgtaaggtacctaaccgaaacccgtataccgtacccgttacggaccggtacgggaccacggaccgtaggacgtaaacgtaaacgaacgtggtacggctcgacacactcgttcg

SEQ ID NO: 422442 - DNA, 556 bp, Homo sapiens
  misc_feature: GZ8MTXP02G8VK0.15.25.C03.1.454.CMB.2.raw
tcagtctacgtagccacgaccggtgctcgatttagtagtgtagatttgggtttggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatcctcccgcaggtctagtcagagcctccagcatactgatggatacaactattggattggtacctgcagaagccagggcagtctccacaactcctgatctatttgggttctaagtcgggcctccggggtcctgacaggttcagtggcagtggatcaggcatagattttacactagaaaatcagcagagtggaggcgtaggagggtacggtttagggggtttattacgtggtcagtgacgtaacggtacctaaccgaaaccccgtataccgtaccgttcggaccggacgggaccacggccgtaggaagtaacgttaaacgaacgtgtcggctacgcacctatccgtagttc

SEQ ID NO: 422443 - DNA, 580 bp, Homo sapiens
  misc_feature: GZ8MTXP02HLU99.15.25.C03.1.454.CMB.2.raw
  modified_base (339)..(339): a, c, t, g, unknown or other
tcagtctacgtagccacgaccggtgctcgatttagtagtgtagatttgggtttggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcccgcaggtctagtcagagcctccagcatactgatggatacaactattggattggtacctgcagaagccagggcagtctccacaactcctgatctatttggtctaagtcgggcctccggggtcctgacnggttcagtgcagtggatcaggcatagattttacactagaaaatcagcagagtggaggcgtaggagggtacggtttagggggtttatttaacgtggtactagttagacgaaacggtacctaaccgaaaaccccgtactacctaacccgttccgggacccggacgggaccgacggacccgtagggaagtaacgttaaaacgaaccgtgtaacgggctacggaccactacgtacttacgtttcc

SEQ ID NO: 422444 - DNA, 531 bp, Homo sapiens
  misc_feature: GZ8MTXP02GDFJI.15.25.C03.1.454.CMB.2.raw
  modified_base (289)..(289): a, c, t, g, unknown or other
  modified_base (350)..(350): a, c, t, g, unknown or other
  modified_base (453)..(453): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagagccagggcagtcncacactctgatctatttgggttctaagtcgggcctccggggtcccctgacagttcagtgcngtgatcagcatagatttacactagaaatcagcagagtggaggctaggaggtacggtttaggggtttattacgtgctagtgacgaaggtactaacgaaacccgntaccaccgttcggaccgacgggacacgccgtaggacgtaacgttaacgaacgtggtcgactacgacctacactcgtag

SEQ ID NO: 422445 - DNA, 515 bp, Homo sapiens
  misc_feature: GZ8MTXP02JJVUL.15.25.C03.1.454.CMB.2.raw
  modified_base (343)..(343): a, c, t, g, unknown or other
  modified_base (355)..(355): a, c, t, g, unknown or other
  modified_base (474)..(474): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctccagcatactgatggatacaactatttggattggtacctgcagaagccagggcagtctccacaactcctgatctatttgggtctaatcggcctcggggtccccctgacnggttcagtggcngtggatcaggcatagtatttacactagaaaatcagcagagtggagctagaggtagttggggttattacgtgcagtgcgaaggtctaacaaccccgatccgaccttcggaccgagggacncggcctggacgacttaaacgactgtagctcgcaccatctcg

SEQ ID NO: 422446 - DNA, 594 bp, Homo sapiens
  misc_feature: GZ8MTXP02JO9T0.15.25.C03.1.454.CMB.2.raw
  modified_base (349)..(349): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctcagcatactgatggatacaactatttggattggtacctgcagaagccagggcagtctccacactctgatctatttggtctaatcggcctccgggtcccctgacagttcagtggcngtgatcagcatagatttacactagaaatcagcagagtggaggcgtagaggtacggttggggtttagttacgtagtcgtagtagacgtaacggtacgtaaccgaaaccccgtaaccgtacctaacccgtttcccgggtacccggtacggggaaccggaaccggacccgttaccgggaacggtaacgttaaaacggtaaaccgtaacggttacggacgttacggccgaccgtaacgtacgtttaccg

SEQ ID NO: 422447 - DNA, 612 bp, Homo sapiens
  misc_feature: GZ8MTXP02JJ8W4.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagagccggcctccatctcctgcaggtctagtcagacgcctccagcatactgatggatacaactatttggattggtacctgacagaagccgagggcagtctaccaacaactcctagattcttagtttgggttactaacgtccggggtccttccccggggtccctggactaggttcgaggtggcgaggtggatcgaggcagttagtatttacactagaaatcagcgagaggtaggagcgtggagggtacggtttaggggtttagttacgtgcgtagtacgacgtaacggttacctaaaccgaaaccccgtactaccgtaaccgttccgggaccggaacgggaccgaccggtaccggtacggaaacgtaaacgttaaaaccggaacgtacggtacggacgtacgaccaccgtactttccg

SEQ ID NO: 422448 - DNA, 577 bp, Homo sapiens
  misc_feature: GZ8MTXP02JVYV7.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcagcatactgatggatacaactatttggattggtacctgcagaagccagggcagtctccacactcctgatctatttggtctaagtcggcctcggggtccccctgactaggttcaggtggcaggtggatcgaggcagtagtatttacactagaaaatcagcagagtggagcgtgaggtacggtttggggtttattacgtgacagtgacgtaaggtactaaccgaaaccccgtataccgtaccgttaccggaccggaacgggaccaccggaccgttaaggacgtaaacgtttaaaacccggaagttcggtcggtacgttacggaccgtacccgtacttcgtttccg

SEQ ID NO: 422449 - DNA, 613 bp, Homo sapiens
  misc_feature: GZ8MTXP02GGWIO.15.25.C03.1.454.CMB.2.raw
  modified_base (357)..(357): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggtctaagtcgggcctccggggtcccctgactaggttcagtggcnggtggatcgaggctaagtagtatttacacttagaaatcagcagagtggaggcgtaggagggtacggtttggggtttaattacgttgctagtgacgtaaagggtacctaaaccgaaaaccccgtactaccgtaacccgtttaccgggacccgggaacggggaaccgaccggtacccgtaggggtaaacgtaaacgtttaaaaaccggaaacgttcggttacgggaccttacggaccaaccgtacgttacctttccgg

SEQ ID NO: 422450 - DNA, 795 bp, Homo sapiens
  misc_feature: GZ8MTXP02JIRA7.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccgctccactctccgccagtcgtacgtcgacgagacctccacgacactactgagtaggagtaactaactaatttaggtagttaggttaccgtcgacgacgaaggaccgacgggacggacgtacgttcccaaccaaacctaccctcgtattactttacgttttagggtttcgttaaactaccggggtcccggtcccggggtccccgtccgtacgtacggttcgacggtgggccgagtgggtagtcgacggacgacttaggtaatttactaaacctagtaaaacttaccgagaccgaggtaaggtggggtaaggaccgtaggtaaggggtaccggggttttaaggggggtttttattaaaccttcgggcgtaagttagggtaacccgaaacggttaacccgtaaaccccgtaaaacccccgggacttacgtaaccccgtttcccgggggaaccccggggacggggaaaccggtaacccgccccggttaagggtaaacgggtaaaactttaaaaacccccgggttaaaacggtaggtttcgggggaaaccccttacggacccgtaaacccgtaacctttccgtttcggttttaacccccg

SEQ ID NO: 422451 - DNA, 527 bp, Homo sapiens
  misc_feature: GZ8MTXP02IPGLN.15.25.C03.1.454.CMB.2.raw
  modified_base (354)..(354): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactctgatctatttggtctaagtcgggcctccggggtcccctgacaggttcagtggcngtgatcagcatagtatttacactagaaaatcagcagagtggagctgaggtacgttggggtttattacgtgacagtgactaaggtactaaccaaaccccgataccgaccgttcggaccgagggacacgccgtaggacgaacttaaacgaacgtgtggactcgacacactactcg

SEQ ID NO: 422452 - DNA, 541 bp, Homo sapiens
  misc_feature: GZ8MTXP02JVPVM.15.25.C03.1.454.CMB.2.raw
  modified_base (347)..(347): a, c, t, g, unknown or other
  modified_base (359)..(359): a, c, t, g, unknown or other
  modified_base (406)..(406): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctccagcatactgatggatacaactatttggattggtacctgcagaagccagggcagtctccacaactcctgatcttatttgggttctaagtcgggcctccggggtcccctgacnggttcagtggcngtggatcgagcatagatttacactagaaaatcagcagagtggacggntagaggtacggtttggggtttattacgtgcagtgacgaaggtctaacgaaacccgtatacctaccgttcggaccgagggaccacggccgtaggaacgaacttaaacgaacgtgtcggactcggactaccatctcg

SEQ ID NO: 422453 - DNA, 526 bp, Homo sapiens
  misc_feature: GZ8MTXP02GBBP5.15.25.C03.1.454.CMB.2.raw
  modified_base (352)..(352): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactcctgatctatttggtctaagtcggcctccggggtcccctgacaggttcagtgcngtgatcgagcatagatttacactagaaaatcagcagagtggaggctagaggtacggtttggggtttattacgtgcagtgacgaaggtctaacaaacccgataccacgttcggaccgagggaccacgcctaggacgtaacgtaacgaactaagtcggactacgccacactcttcg

SEQ ID NO: 422454 - DNA, 618 bp, Homo sapiens
  misc_feature: GZ8MTXP02J0FWR.15.25.C03.1.454.CMB.2.raw
  modified_base (372)..(372): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcaccctggagacgccggcctccatctcctgcaggtctagtcagagcctcagcatactgatggatacaacttattggattggtacctgcaggaacgccgagggcagtcctaccaacaactcctgacttcttagtttggtactaacgtccggggccgtccggggtcccctgacgtaggttcaggtggcnggtggatcgagctagtagtatttacactagaaatcagcgaggaggtggaggcgtaggtagggtacgggtttggggtttaattacgtgactagtagacgtaacggtacctaaacccgaaaccccgtagtacccgtaccgttaccgggacccggaacggggaccgaccggtaccggttagggaaacgtaaacgtttaaaacggaacgttaaggtacggtcgtacggacctacctaagtccgtttaacg

SEQ ID NO: 422455 - DNA, 507 bp, Homo sapiens
  misc_feature: GZ8MTXP02FW3L5.15.25.C03.1.454.CMB.2.raw
tcagtctacgtagccacgaccggtgctcgatttagtagtgtagatttgggtttgggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctcacaactcctgatctatttggtctaatcgggcctcccggggtccctgacaggttcagtggcagtggatcaggcatagatttacactgaaaatcagcagagtggaggctgaggtacgttggggtttattacgtgcatgacaaggtctaacaaaccccgatcaccttcggcgagggacacgcctaggagattaaacgaacgtgtacggctgacaccatc

SEQ ID NO: 422456 - DNA, 524 bp, Homo sapiens
  misc_feature: GZ8MTXP02IQNYA.15.25.C03.1.454.CMB.2.raw
  modified_base (343)..(343): a, c, t, g, unknown or other
  modified_base (355)..(355): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggtctaatccgggctccggggtcccctgacnggttcagtggcngtggatcgagcatagatttacactagaaatcagcagagtggaggctgaggtacggtttggggtttattacgttgcatgacaaggtctaacgaaacccgataccaccttcggccgagggaccacgcctaggacgaacttaaacgaacgtgtcggctacgcaccactctag

SEQ ID NO: 422457 - DNA, 629 bp, Homo sapiens
  misc_feature: GZ8MTXP02IBWXH.15.25.C03.1.454.CMB.2.raw
  modified_base (295)..(295): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactctccctgtcccgtcacccctggagagccggcctccatcctcctgcaggtctagtcagacgcctcagcatactgatggatacaactagttggattggtacctgcagaacgccgagggcagtccnccaacaactcctgatcttagtttggtactaagtcgggcccgtccggggtcccctgacgtaggttcgaggtggctggtggactcgagggtactaagtaagttaatttaacaacgtaaagtaaaatcgaaggacgtaaggaggtagggaggacgtagggtaacgggttagggttttaggggtttaattacggtgacgtagtagtacgtaaacggtaccctaaacccgtaaacccgtactcccgtaaacccgttccgggaccggtaacggggaccaaccggtaccgtaggtaacgtaaacgttaaacgaacgtggtacgactcgacaccgattctcg

SEQ ID NO: 422458 - DNA, 560 bp, Homo sapiens
  misc_feature: GZ8MTXP02IYEI4.15.25.C03.1.454.CMB.2.raw
  modified_base (355)..(355): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactctgatctatttggtctaagtcgggcctccggggtcccctgacgaggttcagtggcnggtggatcgaggcatagtatttacactagaaatcagcagagtaggaggcgtaggaggtacggtttaggggtttattacgtgactagtgacgaaggtactaaccgaaacccgtataccgtaccgttcgggaccgacggggaccaccgaccgtacggaacgtaaacgttaaacgaacgtggtaggacgtcgaccaccgtatacttcg

SEQ ID NO: 422459 - DNA, 512 bp, Homo sapiens
  misc_feature: GZ8MTXP02HRIVO.15.25.C03.1.454.CMB.2.raw
  modified_base (299)..(299): a, c, t, g, unknown or other
  modified_base (357)..(357): a, c, t, g, unknown or other
  modified_base (404)..(404): a, c, t, g, unknown or other
  modified_base (406)..(406): a, c, t, g, unknown or other
  modified_base (427)..(427): a, c, t, g, unknown or other
  modified_base (431)..(431): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcagcatactgatggatacaactatttggattggtaacctgcagaagccagggcagtctcacactcngatcttatttgggttcaagtccgggcctccggggtccccctgaccaggttcagtggcnggtcggatcaggcatagtatttacatagaaatcagcagagtggacgngngagtagttggttagttactgnatgngagactacaaccgacacactacgcgacggacgacgcgtacgacgacgtaaacgaacgtaagtcgacgcgcacactacttcg

SEQ ID NO: 422460 - DNA, 519 bp, Homo sapiens
  misc_feature: GZ8MTXP02IY8GI.15.25.C03.1.454.CMB.2.raw
tcagtctacgtagccacgaccggtgctcgatttagtagtgtagatttgggtttggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcccgcaggtctagtcagagcctcagcatactgatggatacaactattggattggtacctgcagaagccaggcagtctcacaactcctgatctatttgggtctaagtcggcctccggggtcctgacaggttcagtggcagtggatcgaggcatagattttacactgaaaatcagcagagtggagctagaggacgtttggggttattactgtcagttgactaaggtctaacgaaacccgatcgaaccgttcggccgagggacacgccgtaggagtacttaaaacgacttgaaggctgcacctatcctgttc

SEQ ID NO: 422461 - DNA, 598 bp, Homo sapiens
  misc_feature: GZ8MTXP02JWWYN.15.25.C03.1.454.CMB.2.raw
  modified_base (348)..(348): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatcctcccgcaggtctagtcagacgccctccagcatactgatggatacaactattggattggtactgcagaagccaggcagtctccacaactccagattcttagtttgggttactaagtccgggcctccggggtcctgacnggttcagtgcagtggatcgaggcatagtatttacactagaaaatcagcagagtggagcgtagaggtacggtttaggggtttattacgtggacagttcggacgtaacggtaccttaaacccgaaacccccgtattacccgaccgttaccggacccggaacggaccgaccggacccgtagggaaacgtaacgttaaaaccggaaccgttggtaacggccgtacggacctaccgtactttaccgtacgtttcc

SEQ ID NO: 422462 - DNA, 567 bp, Homo sapiens
  misc_feature: GZ8MTXP02HW4W7.15.25.C03.1.454.CMB.2.raw
  modified_base (339)..(339): a, c, t, g, unknown or other
  modified_base (349)..(349): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagcagggcagtctccacaactctgatctatttggtctaagtcggcctccggggtcccctgacngtcagtggcngtggatcaggcatagtatttacactagaaatcagcaggagtggaggcgtggaagggtacggttttagggggtttaatttacgtagctagtgacgaaggtctaaaccgaaaccccgtactaccgtaccgttccggaccggaacgggaccgacgtccgtaggaacgtaaacgttaaaaccggaacgtaaggttcggactcgacaaccctattccgttacg

SEQ ID NO: 422463 - DNA, 563 bp, Homo sapiens
  misc_feature: GZ8MTXP02ID861.15.25.C03.1.454.CMB.2.raw
  modified_base (355)..(355): a, c, t, g, unknown or other
  modified_base (388)..(388): a, c, t, g, unknown or other
  modified_base (405)..(405): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagagccggcctccatctcctgcaggtctagtcagagcctccagcatactgatggatacaactatttggattggtacctgcagaagccagggcagtctcacaactctgatctatttggtctaatccgggctccggggtcccctagactaggttcagtggcnggtgatcgagcatagtattttacatagaaatanagagagaggtaggaggngtaggtaggttagggtttagggtttagttacgttgtacgtagtagtacgtaacgtacgtaaccgaacccgtactaccgtaccgtacggacggacggacgacgacgtacggtacgtaacgtaacgtaacgtaacgtcgacgtacgacactactacgtcg

SEQ ID NO: 422464 - DNA, 561 bp, Homo sapiens
  misc_feature: GZ8MTXP02JG5LG.15.25.C03.1.454.CMB.2.raw
  modified_base (359)..(359): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaagtcggggcctccggggtccccctgacaggttcagtggcnggtggatcgagcatagtatttacactagaaatcagcagagtggaggctggaggtacgttggggtttattacgtgacagttgactaaggtactaaccgaaaccccgtataccaccgttccggaccggacgggaccaccggccgttaggaacgtaacgttaaaacgaacgtaaggttcggacgtcggaccaaccgtactcttcg

SEQ ID NO: 422465 - DNA, 511 bp, Homo sapiens
  misc_feature: GZ8MTXP02IOVUK.15.25.C03.1.454.CMB.2.raw
  modified_base (354)..(354): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctgtatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactctgatctatttgggtctaatcgggctccggggtccccctgacaggttcagtggcnggtgatcagcatagtattttacactagaaaatcagcagagtgaggctgaggtacgttggggtttattacgtgcatgacaaggtactaacaaacccgatcacttcggccgagggacacgccgtaggagaacttaaacgaactgtggctgcaccatctg

SEQ ID NO: 422466 - DNA, 527 bp, Homo sapiens
  misc_feature: GZ8MTXP02I206B.15.25.C03.1.454.CMB.2.raw
  modified_base (272)..(272): a, c, t, g, unknown or other
  modified_base (349)..(349): a, c, t, g, unknown or other
  modified_base (351)..(351): a, c, t, g, unknown or other
  modified_base (354)..(354): a, c, t, g, unknown or other
  modified_base (384)..(384): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtaccngcagaagccagggcagtctccacaactcctgatctatttgggtctaatcggcctcggggcccctgacagtcagtgcngngancagcatagatttacactagaaatcagcagngtggaggctgaggtacggtttggggtttattacgtgcagtagactaaggtactaaccgaaacccgactcctaccgttcggccggacgggacacggccgtaggaacgtacgtaaacgacgtaagtcggctcggacaccatctcg

SEQ ID NO: 422467 - DNA, 563 bp, Homo sapiens
  misc_feature: GZ8MTXP02JULZT.15.25.C03.1.454.CMB.2.raw
  modified_base (354)..(354): a, c, t, g, unknown or other
  modified_base (386)..(386): a, c, t, g, unknown or other
  modified_base (389)..(389): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactcctgatctatttgggtctaatcgggcctccggggtcccctgacaggttcagtggcnggtgatcgagcatagtatttacactagaaatnagnagagtggaggcgtaggaggtacggtttggggtttattacgtgcagtgacgtaaggtacctaaccgaaaccccgataccgtaccgttccgggaccggtacggggaccaccggccgtacgggaacgtaaacgttaaacgaacgtggtcggacctacggacctaccgtactcgttcg

SEQ ID NO: 422468 - DNA, 579 bp, Homo sapiens
  misc_feature: GZ8MTXP02IQ6X9.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgacagaacgccagggcagtctccaacactctgatctagtttggttactaagtcgggcctccggggtcccctgactaggttcaggtgcagtgatcgagctaatagtatttacactagaaaatcagacagagtaggaggctaggaggtacggtttggggtttaattacgtgactagtagacgtaaggtactaaacccgaaaaccccgataccgaacccgttcgggacccggaacgggaccgaccgaccgttagggaacgtaaacgttaaaaccgaacgtggtacggactcgaccgtaccagttccttcg

SEQ ID NO: 422469 - DNA, 562 bp, Homo sapiens
  misc_feature: GZ8MTXP02I9BQ5.15.25.C03.1.454.CMB.2.raw
  modified_base (291)..(291): a, c, t, g, unknown or other
  modified_base (352)..(352): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtcnccacactcctgatctatttggtctagtccggcctccggggtcccctgacaggttcagtgcngtgatcagcatagtatttacactagaaatcagcagagtggagcgtaggaggtacggtttaggggtttattacgtgactagtagacgtaaggtactaaccgaaaccccgtataccgtaccgttcggaccggacgggaccacggaccgtagggaacgtaaacgttaaaccgaacgttaacggtcggacgtacggacctacctacgttcttcg

SEQ ID NO: 422470 - DNA, 520 bp, Homo sapiens
  misc_feature: GZ8MTXP02GQBFB.15.25.C03.1.454.CMB.2.raw
tcagtctacgtagccacgaccggtgctcgatttagtagtgtagatttgggtttgggggagtcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccaggggcagtctccacaactcctgatctatttggggttctaagtcggggcctccggggtcccctgacaggttcagtggcagtggatcaggcattagattttacactagaaaatcagcagagtggagctagaggacgtttggggttattacgtgcatgcaggtactaacaaacccgatacaccgttcggaccgaggacacgcctggacgacttaacgaacgtgtcggctcgcaccatctcg

SEQ ID NO: 422471 - DNA, 598 bp, Homo sapiens
  misc_feature: GZ8MTXP02HNCVK.15.25.C03.1.454.CMB.2.raw
  modified_base (352)..(352): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctaccacactctgatctatttggtactaagtcgggcctcggggtcccctgactgtcaggtgcnggtgatcagctagtagtatttacatagaaatcagacgagaggtggaggtcgtaggaagggttacgggtttaggggtttaaattacgttagctagtacggtacgtaaacggtactaaacccgaaaaccccgtacttaccgacccgttaccgggaccggaacggggaccaccggtaccgtacgggaagtaaacgttaaacgaaacgttcggtacggtacgtacggaccgtaccgtaacgttactttcg

SEQ ID NO: 422472 - DNA, 516 bp, Homo sapiens
  misc_feature: GZ8MTXP02JYZF0.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatcctcccgcaggtctagtcagagcctccagcatactgatggatacaactattggattggtacctgcagaagccagggcagtctccacaactcctgatcttatttgggttctaagtcgggcctccggggtcctgacaggttcagtgcagtgatcagcatagtatttacactagaaaatcagcagagtggaggcgtggaggtacgttgggggtttattacgtgcagtgcaaggtcctaacaaaccccgatccaccgtcggccgacggacacgccgtagacgacttaacgactgtggctgcacactctgtc

SEQ ID NO: 422473 - DNA, 531 bp, Homo sapiens
  misc_feature: GZ8MTXP02HZWXL.15.25.C03.1.454.CMB.2.raw
  modified_base (295)..(295): a, c, t, g, unknown or other
  modified_base (320)..(320): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagccctcagcatactgatggatacaactattggattggacctgcagaagccagggcagtctccanaactcctgatctatttgggtctaancgggcctccggggtccctgacaggttcaggtgcagtggatcaggcatagtatttacactagaaaatcagcagagtggagcgtgaggtacggtttggggtttattacgtgcatgacgaaggtctaacaaacccgatcaaccgttcggaccgagggacacggaccgtacggagtaacgttaaacgaaacgtgtacggctggaccacctattcg

SEQ ID NO: 422474 - DNA, 528 bp, Homo sapiens
  misc_feature: GZ8MTXP02GEV2L.15.25.C03.1.454.CMB.2.raw
  modified_base (355)..(355): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggtctaagtcgggcctccggggtcccctgacaggttcagtgcngtgatcgagcatagtatttacactagaaaatcagcagagtggaggctaggaggacggtttggggtttattacgtgactatgacgaacggtactaacgaaacccgatacaaccgttcggaccgagggcacggcctaggagaacttaaacgaactgtcggactcgcaccatctcg

SEQ ID NO: 422475 - DNA, 523 bp, Homo sapiens
  misc_feature: GZ8MTXP02HHCXL.15.25.C03.1.454.CMB.2.raw
  modified_base (265)..(265): a, c, t, g, unknown or other
  modified_base (286)..(286): a, c, t, g, unknown or other
  modified_base (334)..(334): a, c, t, g, unknown or other
  modified_base (339)..(339): a, c, t, g, unknown or other
  modified_base (347)..(347): a, c, t, g, unknown or other
  modified_base (369)..(369): a, c, t, g, unknown or other
  modified_base (373)..(373): a, c, t, g, unknown or other
  modified_base (375)..(375): a, c, t, g, unknown or other
  modified_base (390)..(390): a, c, t, g, unknown or other
  modified_base (420)..(420): a, c, t, g, unknown or other
  modified_base (422)..(422): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcaccctggagagccggcctccatctcctgcaggtctagtcagagcctcagcatactgatgatacaatattggattgacngcagaagcaggcagtcaccanaactctgatctatttggtcaatcggctccccggggtcctgacaggttnagtgngagtgagngagacatatattaactaataanaaananagagagagaggaggngtagtaggtaggttaggtttagttataganangacgaacgtactaaccaaaccaactacaccgtacggacggacggacgacgacgacgacgaaacgtaaacgtaaacgtacgtacgacgtacgacaccactac

SEQ ID NO: 422476 - DNA, 511 bp, Homo sapiens
  misc_feature: GZ8MTXP02JL7RH.15.25.C03.1.454.CMB.2.raw
  modified_base (352)..(352): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttggtctaatcgggcctccggggcccctgacagttcagtggcngtggatcgaggcatagatttacacttagaaaatcagcagagtggaggctgaggtacggttggggtttattactgcagtgcaggtctacaacccgatacgacctcggaccgagggacacgcctaggacgaacttaacgaactgtgactgacaccatctcg

SEQ ID NO: 422477 - DNA, 635 bp, Homo sapiens
  misc_feature: GZ8MTXP02G8YRK.15.25.C03.1.454.CMB.2.raw
  modified_base (289)..(289): a, c, t, g, unknown or other
  modified_base (351)..(351): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagagccaggacagtcnccacaactcctgatctatttggtctaagtcgggcctcggggtcccctgacaggttcagtgcngtgatcgaggcatagtactttacacttaagaaatcgagcgaagaggtagggaggtcgtaggagggtacggtttagggggttttaacttacgtggactagtacgtacgtaaacggttacctaaacccgtaaaaccccggtacttacccgtaacccgtttacccggggaccgggtaacggggaaccgaccggtacccgttaacggggaaacggtaaacgtttaaaaccgggtaacgttaacgggttacgggaccgttacggaccaacccctaagttaccgtttacg

SEQ ID NO: 422478 - DNA, 513 bp, Homo sapiens
  misc_feature: GZ8MTXP02HPM4P.15.25.C03.1.454.CMB.2.raw
  modified_base (290)..(290): a, c, t, g, unknown or other
  modified_base (342)..(342): a, c, t, g, unknown or other
  modified_base (353)..(353): a, c, t, g, unknown or other
tcagtctacgtagccacgaccggtgctcgatttagtagtgtagatttgggtttggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtcnccacaactcctgatctatttgggtctaatcgggcctccggggtcccctgacngttcagtggcngtgatcagcatagatttacactgaaaatcagcagagtggaggctagaggacggtttggggtttattacgttgcagtgacaaggtctaacaaaccccgatacaccgttcggaccgaggacacgcctagagaacttaaacgaactgtgctcgacaccatctg

SEQ ID NO: 422479 - DNA, 577 bp, Homo sapiens
  misc_feature: GZ8MTXP02G92TO.15.25.C03.1.454.CMB.2.raw
  modified_base (289)..(289): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagagcctcagcatactgatggatacaactattggattggtacctgcagaagccaggcagtcnccacaactcctgatctagtttggtctaagtcgggcctccggggtcccctgactggtcagtggcagtggatcgaggcagtagtatttacactagaaaatcgagacagaggtggaggcgtaggagggtacggtttaggggtttattacgttgactagtgacgtaacggtacctaaaccgaaaccccgtactaccgtaccgttaccgggacccggacgggaccgacgacccgttaggaacgtaacgttaaaacgtaacgtggtacgacgtcggaccacctacttcttaccg

SEQ ID NO: 422480 - DNA, 534 bp, Homo sapiens
  misc_feature: GZ8MTXP02IHXH5.15.25.C03.1.454.CMB.2.raw
  modified_base (299)..(299): a, c, t, g, unknown or other
  modified_base (350)..(350): a, c, t, g, unknown or other
  modified_base (458)..(458): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctcatctcctgcaggtctagtcagagcctccagcatactgatggatacaactatttggattggtacctgcagaagccagggcagtctccacactcngatctatttggtctaagtccggctccggggtcccctgacagttcagtggcngtgatcaggcatagtatttacatagaaaatcagacagagtggaggctagaggtacggtttggggtttaattacgtgatagtagacgaaggtactaacaaaaccccgtntaccgtacgtcggaccgaggaccacgaccgtaggacgtaacttaacgagtggtacgcgtacgactactactcgtcg

SEQ ID NO: 422481 - DNA, 589 bp, Homo sapiens
  misc_feature: GZ8MTXP02JPLUE.15.25.C03.1.454.CMB.2.raw
  modified_base (259)..(259): a, c, t, g, unknown or other
  modified_base (353)..(353): a, c, t, g, unknown or other
  modified_base (385)..(385): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtggggatattgtgatgactcagtctccactcctccctgcccgtcacccctggagagccggcctccatctcctgcaggtctagtcagagcctccagcatactgatggatacaactntttggattggtacctgcagaagccaggcagtctccacactctgatcttatttggtctagtccgggcctccggggtcccctgacagttcagtgcngtgatcgagcatagtatttacactagaaaatnagcgagaggtgggagcgtaggaagggttacgggttagggtttaatacgtgactagtacgtacgtaaaggtacctaaaccgaaaaccccgagtacccgtaccgttaccgggaccggaacggggaccacggtacccgtaagggtaacgtaaaacgttaaaccggtaacgtgggtacggacgtacggaccaacccgtatacgtttcg

SEQ ID NO: 422482 - DNA, 551 bp, Homo sapiens
  misc_feature: GZ8MTXP02IIWQG.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactctgattctatttggtctaagtcgggcctccggggtcccctgacaggttcagtggcaggtgatcgagcatagtatttacatagaaatcagcagagtggagcgtagaggtacggtttggggtttattacgtgctagtagacgaaggtactaaccaaaccccgtataccgaccgttcggaccggaacgggaccacggtaccgtaggaacgtaacgttaaacgaacgtggttcggactagacctacctatccgttg

SEQ ID NO: 422483 - DNA, 574 bp, Homo sapiens
  misc_feature: GZ8MTXP02JTUUS.15.25.C03.1.454.CMB.2.raw
  modified_base (299)..(299): a, c, t, g, unknown or other
  modified_base (339)..(339): a, c, t, g, unknown or other
  modified_base (351)..(351): a, c, t, g, unknown or other
  modified_base (393)..(393): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctcacactcnatctatttggtctaagtccgggcctcggggtcccctgacnggttcagtggcnggtgatcaggcatagtatttacactagaaaatcagcagaggnggaggcgtaggaggtacggtttggggtttaattacgtgatagtgacgtaaacggtacctaaaccgaaaccccgtataccgtaacccgttcgggaccggacgggaccaccggtccgtaagggaacgtaaacgttaaaaccggtaaccgtggtacggacttacggacacctacgtacgtttcg

SEQ ID NO: 422484 - DNA, 602 bp, Homo sapiens
  misc_feature: GZ8MTXP02I0YFO.15.25.C03.1.454.CMB.2.raw
  modified_base (360)..(360): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccaacaactcctgactcttatttgggttctaagtccgggcctccggggtcccctgactaggtcagtggcngtgatcgagcatagtatttacactagaaatcgagcagagtaggaggcgtaggaggtacggtttagggggtttattacgttgactagttagacgtaaacgggttacctaaaccgaaaaccccgtacttacccgtaaccgttaccgggaccggaacgggaccgaaccggaccgttaagggaacgtaaaacgttaaaacggaaccgtaaggtacggacgtacggaccgaccgtaattccgttacg

SEQ ID NO: 422485 - DNA, 571 bp, Homo sapiens
  misc_feature: GZ8MTXP02IGDHT.15.25.C03.1.454.CMB.2.raw
  modified_base (258)..(258): a, c, t, g, unknown or other
  modified_base (374)..(374): a, c, t, g, unknown or other
  modified_base (448)..(448): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtccacccctggagagccggcctccatcctcctgcaggtctagtcagagcctccagcatactgatgatacaactnttgattgtacctgcagaagccagggcagtcctaccacaacctcctagacttcttagttttcgggttactaacgtccgggcccgttccggggtcccctagacgtaggttcagtggcnggtgatcgagcatagtatttacgatagaaatcagcagagtggagcgagaggtacggtttagggtttatacgtgnagtgacgtaaggtacctaaccgaaaccccgtataccgtaccgttccgggaccggaacgggaccaccggaccgtaggaacgtaaaacgttaacgaacgtgtacggactcgacacctatccgttg

SEQ ID NO: 422486 - DNA, 575 bp, Homo sapiens
  misc_feature: GZ8MTXP02HJPOC.15.25.C03.1.454.CMB.2.raw
  modified_base (359)..(359): a, c, t, g, unknown or other
  modified_base (476)..(476): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatcttagtttgggttactaagtcgggcctcggggtccccctgacaggttcagtgcngtggatcgaggcagtagtatttacactagaaaatcagcagagtggaggcgtaggagggtacggttgggggtttattacgttgactagtgacgtaagggtacctaaccgaaacccgtntaccgtacccgttacgggacccggaacgggaccaccggaccgttagggaacgtaaacgttaaacgaacgtggtaggactcggacctacctactcgttcg

SEQ ID NO: 422487 - DNA, 589 bp, Homo sapiens
  misc_feature: GZ8MTXP02H6MMB.15.25.C03.1.454.CMB.2.raw
  modified_base (325)..(325): a, c, t, g, unknown or other
tcagtctacgtagccacgaccggtgctcgatttagtagtgtagatttgggtttgggggatcaggactcctcagttcaccttctcacaatgaggctccctgctcagctcctggggctcctgctgctctggctcccaggtgccaaatgtgacatccagatgacccagtctccttccaccctgtctgcatctgtgggagatagagtcaccatcacttgccgggcagtcagagtattagtacctggttggcctggtatcagcaagaaaccagggaaacgcccctaaactcctagatgtaataaggcatctagcttaagaaagtggggtnccatcaaggtcaggcgcagtggatcgtgggacagaattcactctacacatcagcaccctgcacgcctagactgtatttgactaacttattactgtacaactagtataaattagtaattccgtggtaaccgttcgggacctaaaacgggggaaccctaaaaggggtagggtaaaaacttaccgaaaaacggtaaacgttggtacggtaccttacggaaccgaacccgtaattccgttcggtacctttccgtaaacgtttcccccg

SEQ ID NO: 422488 - DNA, 569 bp, Homo sapiens
  misc_feature: GZ8MTXP02JJUYZ.15.25.C03.1.454.CMB.2.raw
  modified_base (342)..(342): a, c, t, g, unknown or other
  modified_base (351)..(351): a, c, t, g, unknown or other
  modified_base (396)..(396): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttggttctaagtcggcctcggggtcccctgacngtcagtgcngtgatcgagcatagatttacactagaaatcagcagagtggaggcnggaggtacggttggggtttatacgttgcagtgacgtaaggtactaaccgaaaaccccgataccgtaaccgttcggacccggagggaccaaccggacccgttacgggaacgtaaacgttaaaaccgaaaccgtaaggttacgggccttacggaccaacccgtaattcctttacg

SEQ ID NO: 422489 - DNA, 553 bp, Homo sapiens
  misc_feature: GZ8MTXP02G1LCJ.15.25.C03.1.454.CMB.2.raw
  modified_base (355)..(355): a, c, t, g, unknown or other
  modified_base (462)..(462): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctccagcatactgatggatacaactatttggattggtacctgcagaagccagggcagtctccacaactctgatctatttggtctaagtcgggcctccggggtcccctgactggttcagtggcnggtgatcgagcatagtatttacactagaaatcagcagagtggaggctaggaggtacggtttggggtttaattacgtgcagtgacgtaaggtactaaccgaaacccgntaccgtaccgttcgggaccggacgggaccaccggtccgtaggacgtaaacgttaaacgaacgtggtacggacgtacgaccactactctacg

SEQ ID NO: 422490 - DNA, 600 bp, Homo sapiens
  misc_feature: GZ8MTXP02IPVYH.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccgagggcagtctccaacaactcctgacttcttagtttgggttactaagtccggggccgttcccggggtccccctaggactagggtttcaggtcggcaggtggaatcgaggcagttaagtatttacactagaaaatcgaagcagaggtgggaggcgtaggagggttacggtttaggggtttaattacgtgactagtgacgtaaggtacctaaaccgaaacccgtactaccgtaccgttccgggaccgacgggaccaccggtccgtaggaacgtaaacgttaaacgaacgtggtacggactacggaccaccgtacttcgttcg

SEQ ID NO: 422491 - DNA, 566 bp, Homo sapiens
  misc_feature: GZ8MTXP02H2HMA.15.25.C03.1.454.CMB.2.raw
  modified_base (293)..(293): a, c, t, g, unknown or other
  modified_base (357)..(357): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgccccgtcacccctggagagccggcctccatctcctgcaggtctagtcagagcctccagcatactgatggatacaactatttggattggtacctgcagaagccagggcagtcnccacaactcctgatctatttggtctaagtcgggcctccggggtcccctgacaggttcagtggcnggtgatcgaggcatagtatttacactagaaatcagcagagtggaggcgtgagggtacggtttggggtttattacgtgacagtgacgaaggtacctaaccgaaaccccgtataccgaccgttcggaccggacgggaccacggtaccgtaaggaacgtaaacgttaaaacgaacgttcggtacggtacgtcggacctacctacgttcgtcg

SEQ ID NO: 422492 - DNA, 498 bp, Homo sapiens
  misc_feature: GZ8MTXP02HM8WM.15.25.C03.1.454.CMB.2.raw
  modified_base (357)..(357): a, c, t, g, unknown or other
tcagtctacgtagccacgaccggtgctcgatttagtagtgtagatttgggtttggggatcaggactcctcagttcaccttctcacaatgaggctccctgctcagctcctggggctgctaatgctctgggtctctggatccagtggggatattgtgatgactcagtctccactctccctgccccgtcaccccctggagagccggcctccatctcctgcaggtctagtcagagcctcagcatactgatggatacaactatttggattggtacctgcagaagccagggcagtctccacaactcctgatctatttgggtctaaatcgggcctccggggtccccctgacaggttcagtggcngtggatcagcatagatttacactgaaaatcagcagagtgagctgagacgttgggttattatgcatgcaaggtctacaaacccgatcacttcggccgagggacacgcctgacgattaaacgactaagtggctgcaccatctg

SEQ ID NO: 422493 - DNA, 549 bp, Homo sapiens
  misc_feature: GZ8MTXP02G6OC0.15.25.C03.1.454.CMB.2.raw
  modified_base (350)..(350): a, c, t, g, unknown or other
  modified_base (398)..(398): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcagcatactgatggatacaactatttggattggacctgcagaagccagggcagtctcacaactctgatctatttgggtctaatccgggctcggggtccccctgacaggttcagtgcngtgatcaggcatagatttacactagaaaatcagacgagagtaggaggngtagaggtaggttagggtttagtttacgtagtacgtagtagacgaacggtacgttaaccaaacccgtaacctacgtaccgttaccggaccggacgggacgacgacgtacggagacgtaaacgtaacgtaagtgcgtgacactactacttcg

SEQ ID NO: 422494 - DNA, 557 bp, Homo sapiens
  misc_feature: GZ8MTXP02HJUF8.15.25.C03.1.454.CMB.2.raw
  modified_base (291)..(291): a, c, t, g, unknown or other
  modified_base (343)..(343): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtcnccacaactcctgatctatttggtctaagtcgggcctcggggtccccctgacnggttcagtggcagtggatcgagcatagtatttacactagaaaatcgagcagagtggaggctggaggtacggtttggggtttattacgtgctagtgacaaggtactaaccgaaaccccgtataccgtaacccgttcggaccggaacgggccaacggccgttagggaacgtaacgttaaaacggaactggtacggctcgactacccgattccttcg

SEQ ID NO: 422495 - DNA, 595 bp, Homo sapiens
  misc_feature: GZ8MTXP02GRTKX.15.25.C03.1.454.CMB.2.raw
  modified_base (422)..(422): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagagcctccagcatactgatggatacaacttattggattggtacctgacaagaacgccgagggcagtcctaccaacaactcctgacttcttagtttgggttactaagtccgggccttccggggtcccctgacgtaggttcaggtggctggtggatcgagcagtagtatttacactagaaatcagcagagtggagngtaggaggtacggtttggggtttaattacgtgactagtagacgtaaggtacctaaaccgaaaaccccgtatacccgtaccgttcggacccgggaacggaccgaaccgtaccggtagggaacgtaaacgttaaaacggaacgtggtacggacgtacgacacctacgttacttcg

SEQ ID NO: 422496 - DNA, 568 bp, Homo sapiens
  misc_feature: GZ8MTXP02GS2X5.15.25.C03.1.454.CMB.2.raw
  modified_base (347)..(347): a, c, t, g, unknown or other
  modified_base (357)..(357): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagacgcctccagcatactgatggatacaacttattggattggtacctgacagaacgccgagggcagtcctaccacaactctgatcttatttggtactagtcggcctcgggtcccctgacngttcagtgcnggtgatcgagcatagtatttacatagaaatcagcagagtggaggcgtaggagggttacggtttaggggtttaattacgtgactagtgaacgtaaggtacctaaccgaaaccccgtagtaccgtaccgttccggaccggacgggaccgacggtaccgtaggaacgtaacgttaaacgaacgtggtacggcctacgcctaacctacttcgtcg

SEQ ID NO: 422497 - DNA, 574 bp, Homo sapiens
  misc_feature: GZ8MTXP02GFFO1.15.25.C03.1.454.CMB.2.raw
  modified_base (293)..(293): a, c, t, g, unknown or other
  modified_base (353)..(353): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggacctgcagaagccagggcagtctccanaactcctgatctatttgggttctaatcgggcctcggggccccctgacaggttcagtggcngtgatcgagcatagtatttacactagaaaatcagcagagtaggagctagaggtacggttggggtttattacgtgacagtgaccgaaggtacctaaccgaaacccgactaccgtaccgttaccgggaccggaacggggaccaccggaccgttagggaacgtaaacgttaaaaccggaaacgtaaggttacggacgtacggaccgtaacctacgttctttacg

SEQ ID NO: 422498 - DNA, 541 bp, Homo sapiens
  misc_feature: GZ8MTXP02HSIOG.15.25.C03.1.454.CMB.2.raw
  modified_base (294)..(294): a, c, t, g, unknown or other
  modified_base (366)..(366): a, c, t, g, unknown or other
  modified_base (401)..(401): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcagtctagtcagagcctcagcatactgatggatacaactattggattggtacctgcagaagccaggcagtctccaanactctgatctagtttggtctaagtcgggcctccccggggtcctgacaggttcagtgcagtgatcgagcatanatttacactagaaatcagacagaggtggaagggtntaggagggtaggtttaggggtttatttaacgtgatatgacgaaaggtactaaccgaaaaccccgataccaaccgttcgggaccgacgggaccacggccgtacggacgtaaagtaaacgaacgtgagcacgccactactcg

SEQ ID NO: 422499 - DNA, 629 bp, Homo sapiens
  misc_feature: GZ8MTXP02I3OHB.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggtctaagtcgggcctccggggtcccctgacagttcagtggcagtggatcgagcaatagtatttacactagaaaatcaagcaggagtagggaggcgtaggaggtacgggtttaggggtttaagttacgttgacgtagttacgacgtaaacgggttactaaacccgtaaaaccccggtacttacccgtaaacccgtttccggggaaccccggtaacgggggaacccgtaccgggacccgtaagggtaaacgtaaaacgtttaaaaccggaaaacgttcggtacggtccgtacggaccgaacccgtatttccgttacgg

SEQ ID NO: 422500 - DNA, 550 bp, Homo sapiens
  misc_feature: GZ8MTXP02HYITF.15.25.C03.1.454.CMB.2.raw
  modified_base (293)..(293): a, c, t, g, unknown or other
  modified_base (344)..(344): a, c, t, g, unknown or other
  modified_base (354)..(354): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagagccggcctccatctcctgcaggtctagtcagacgcctccagcatactgatggatacaactatttggattggtacctgcagaagccagggcagtcncacaactctgatctatttggtctaagtccgggcctccggggtcccctgacnggtcagtgcnggtgatcgagcatagtatttacactagaaatcagcagagtggagcgtggaggtacgtttggggtttattacgtgactagtcgacgtaaggtacctaaaccgaaacccgataccgaccgttacgggaccggacgggtacacgtaccgtaggacgtaaacgttaaacgaagtcgtacgctacgacaacctattcgtcg

SEQ ID NO: 422501 - DNA, 566 bp, Homo sapiens
  misc_feature: GZ8MTXP02HD17U.15.25.C03.1.454.CMB.2.raw
  modified_base (289)..(289): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctccagcatactgatggatacaactattggattggtacctgcagagccaggcagtcnccacactctgatcttagtttggtctaagtccgggcctccggggtcccctgactaggttcagtggcaggtgatcgagctagtagtatttacactagaaatcagacagagtggagcgtaggaggttacggttggggtttaatacgtgcgtagtagacgtaaacggtacctaaaccgaaaccccgtataccgtaacccgttccggaccggacgggaccgtaccggaccgtaggaacgtaaacgttaaacgaacgtggtcgacgtcgacacctactactcg

SEQ ID NO: 422502 - DNA, 527 bp, Homo sapiens
  misc_feature: GZ8MTXP02JXTMH.15.25.C03.1.454.CMB.2.raw
  modified_base (354)..(354): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctcagcatactgatggatacaactatttggattggtacctgcagaagccagggcagtctccacaactcctgatctatttggtctaagtcgggcctcggggtccccctgacaggttcagtgcngtggatcagcatagtatttacactagaaaatcagacagagtggaggcgtaggaggtacggtttggggtttaattacgtgcagtgctaaggtctaaccaaacccgatccaccgttcggccgagggacacgccgtaggacgaactaaacgaactggtacgctcgcactactctcg

SEQ ID NO: 422503 - DNA, 519 bp, Homo sapiens
  misc_feature: GZ8MTXP02FUCLS.15.25.C03.1.454.CMB.2.raw
  modified_base (356)..(356): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactcctgatctatttgggttctaagtcgggcctccggggtcccctgacaggttcagtggcnggtgatcagcatagtatttacactagaaaatcaagcagagtggagctagaggtagttggggttattacgtgctagtgacgaaggtactaacaaacccgtatcgaaccgttcggaccgagggacacgctaggacgtactaaacgactgtgctcgcaccatctcg

SEQ ID NO: 422504 - DNA, 509 bp, Homo sapiens
  misc_feature: GZ8MTXP02I1B8J.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatcctcccgcaggtctagtcagagcctccagcatactgatggatacaactatttggattggtacctgcagaagccagggcagtctccacaactcctgatctatttggttctaatcggcctcggggtcctgacagttcagtgcagtggatcaggcatagattttacactgaaatcagcagagtggagctggaggtacgtttagggggtttattacgtggcagtgacaacggtctaacaacccgatcaccgttcggccgaggacacgcctggagacttaaacgactagtgctgcacactctgtc

SEQ ID NO: 422505 - DNA, 519 bp, Homo sapiens
  misc_feature: GZ8MTXP02HSCX7.15.25.C03.1.454.CMB.2.raw
  modified_base (329)..(329): a, c, t, g, unknown or other
  modified_base (397)..(397): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacactattgatgtactgcagagccaggcagtctcacactctgatctagttggtctaagtcgggccgtccggggtccccngactggttcaggtcggctaggtggatcgaggcagtagttatttacactagaaatcagcagagtggagngagagtaggttaggttagttagtgtagtagagacgacgtactacgaaccgactactacgtacgacggacggacgacgacgacgacgtaacgtaacgtagtaagtgacgcacactactactcg

SEQ ID NO: 422506 - DNA, 551 bp, Homo sapiens
  misc_feature: GZ8MTXP02JG5CG.15.25.C03.1.454.CMB.2.raw
  modified_base (340)..(340): a, c, t, g, unknown or other
  modified_base (350)..(350): a, c, t, g, unknown or other
  modified_base (397)..(397): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctcacaactcctgatctatttggtctagtcggcctccggggtcccctgacngttcagtgcngtggatcgaggcatagatttacactagaaatcagcagagtaggagcngaggtacggttggggtttattacgtgctagtgacaaggtctaaccgaaaccccgtataccgaccgttccggaccggtacgggaccaccggaccgtacgggaacgtaaacgttaaaacggaacgtggtcggactacggacaacccgtatcgttcg

SEQ ID NO: 422507 - DNA, 596 bp, Homo sapiens
  misc_feature: GZ8MTXP02F40EL.15.25.C03.1.454.CMB.2.raw
  modified_base (288)..(288): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacactattgattggtacctgcagaagccagggcagtcnccacaactcctgatctagtttgggttactaagtcgggcctccggggtcccctgacctaggttcagtcgcagtcggatcgaggcagtagtatttacactagaaaatcagcaaggaggtaggaggtcgtaggaggtacggtttggggttaattacgtgacagtgaccgtaaggtacctaaccgaaaccccgataccgtacccgttaccggaccggaacggggaccaccggtacccgtacgggaacgtaaaacgtttaaaaccggaaaccgtaaggttacgggcttacggacaccctaattccgtttacgg

SEQ ID NO: 422508 - DNA, 579 bp, Homo sapiens
  misc_feature: GZ8MTXP02H7ZFR.15.25.C03.1.454.CMB.2.raw
  modified_base (473)..(473): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagacgcccggcctccatcctcccgcaggtctagtcagagccctcagcatactgatggatacactattggattggtacctgcagaacgccgaggcagtctccacaactcctgatcttagtttggttctaagtccgggtcctccggggtcctgacaggttcagtgcagtgatcagcatagtatttacactagaaatcagcagagtggagcgtggagggtacgttaggggtttattacgtgtacgtagtggactaagggttacctaaccgaaaaccccgtntacccgtaccgttccgggaccggacgggaccaccggacctagggaacgtaaacgttaaaacgaacgttaggtaacggtctacggacaaccgtactcttacgttccc

SEQ ID NO: 422509 - DNA, 651 bp, Homo sapiens
  misc_feature: GZ8MTXP02HE3LO.15.25.C03.1.454.CMB.2.raw
  modified_base (366)..(366): a, c, t, g, unknown or other
tcagtctacgtagccacgaccggtgctcgatttagtagtgtagatttgggtttgggggatcaggactcctcagttcaccttctcacaatgaggctccctgctcagcttctggggctgctaatgctctgggtctctggatccagtggggatattgtgatgactcagtctccactctccctgcccgtcacccctggagagccggcctccatctcctgcaggtctagtcagacgcctccagcatactgatggatacaacttatttggattggtacctgacagaagccagggcagtctccaacaactcctgattcttagtttggtactaagtccgggcctccggggtccccctgacgtggtcagtcggcngtggatcgagcaatagtatttacactagaaatcagacagaggtggaggcgtagggaggttacggtttagggggttttactacgttagacgtagtacgacgtacgggttacctaaacccgtaaaaccccgtacgttacccgtaacccgtttacccggggaccggacgggggtaaccacccgggtacccggtaacgggtaaacgtaaaacgtttaaaacccggtaaacgttcgggttacgggtaaccgttccggacccgtaaacccttacggtttacctttacccgg

SEQ ID NO: 422510 - DNA, 606 bp, Homo sapiens
  misc_feature: GZ8MTXP02GNVCS.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagagccggcctccatctcctgcaggtctagtcagagcctccagcatactgatggatacaactattggattggtacctgcagaagccagggcagtctccacaactcctgatctatttggtctaagtcgggcctcccggggtcctgacagttcagtgcagtgatcaggcatagtatttacactagaaatcagcagagtggagcgtggaggtacggtttggggtttattacgtgactagtcggacgtaagggtacctaaaccgaaaacccccggtattacccgtaacccggtttaccggggacccgggaaacggggaacccgaaccgggtacccgtacggggtaaaacgtaaacgtttaaaaaccggaaaccgttgggttacggaccgttacggacctaacccgtaactttccg

SEQ ID NO: 422511 - DNA, 566 bp, Homo sapiens
  misc_feature: GZ8MTXP02F0UEQ.15.25.C03.1.454.CMB.2.raw
tcagtctacgtagccacgaccggtgctcgatttagtagtgtagatttgggtttgggggatcaggactcctcagttcaccttctcacaatgaggttccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaagtcgggcctccggggtcctgacaggtcagtggcagtggatcgaggcatagtatttacactagaaatcagcagagtggaggctaggaggtacggtttaggggtttattacgtgactatggactaacggtacctaaccaaaaccccggtataccgtaaccgttcgggacccggaagggaccacggtccgtaggaaacgtaaacgttaaaacggactaggtcgacgtacgcaacctactcttcgttccg

SEQ ID NO: 422512 - DNA, 514 bp, Homo sapiens
  misc_feature: GZ8MTXP02HH4J3.15.25.C03.1.454.CMB.2.raw
  modified_base (279)..(279): a, c, t, g, unknown or other
  modified_base (291)..(291): a, c, t, g, unknown or other
  modified_base (294)..(294): a, c, t, g, unknown or other
  modified_base (299)..(299): a, c, t, g, unknown or other
  modified_base (344)..(344): a, c, t, g, unknown or other
  modified_base (444)..(444): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctcagcatactgatggatacaactatttggattggtacctgcagaanccagggcagtcncanactcngatctattggtcaatcgggctcggggcccctgacagttcagtgcngtgatcgaggcagtagatttacactagaaaatcagacgagagtggagcgtagaggtagttggggtttatacgtgcatgacaaggtctacgaaaccccgtntacgtaccgtcggacgacggacacgcgtacgacgtaacgtaacgacgtgtcgactcgacactactcgtcg

SEQ ID NO: 422513 - DNA, 615 bp, Homo sapiens
  misc_feature: GZ8MTXP02GXFUW.15.25.C03.1.454.CMB.2.raw
  modified_base (305)..(305): a, c, t, g, unknown or other
  modified_base (363)..(363): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagacgcctccagcatactgatggatacaacttattggattggtacctgacaagaacgccgaggcagtctacacactcngattcttagtttggtctaagtcgggccgtccggggtcccctgacgtagttcaggtgcngtggatcgagcaagtagtactttaacataagaaaatcgaagcgagaggtggaggcgtaggagggttacggtttaggggtttattacgtgactagtacgaacgtaaacggttacctaaacccgaaacccgtacgttacccgtaacccggttaccgggacccggaaacgggtaccgaaaccggtccgtaaggtaaacgtaaaacgttaaaccggaacgtggttacggactacggaccaccgtacgttactttcg

SEQ ID NO: 422514 - DNA, 596 bp, Homo sapiens
  misc_feature: GZ8MTXP02I3YEJ.15.25.C03.1.454.CMB.2.raw
  modified_base (258)..(258): a, c, t, g, unknown or other
  modified_base (292)..(292): a, c, t, g, unknown or other
  modified_base (296)..(296): a, c, t, g, unknown or other
  modified_base (302)..(302): a, c, t, g, unknown or other
  modified_base (356)..(356): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggaatacaattnttggattggtacctgcagaacgccagggcagtcnccanaactcngatctatttgggtctaagtcgggcctccggggtcccctgactggttcagtggcnggtggatcgaggcataagtatttaacactagaaaatcaagcagagtggaggctaggaggtacggtttaggggtttaattacgttgactagtagacgtaaaggtacctaaccgaaaacccccgtataccgtaacccgttccgggaccggaacggggaccacggtaccgttagggaaacgtaaacgttaaaaccgaacgttaacggtggtacctacggaccaacccgtaagtttacgtaccg

SEQ ID NO: 422515 - DNA, 578 bp, Homo sapiens
  misc_feature: GZ8MTXP02H4XSH.15.25.C03.1.454.CMB.2.raw
  modified_base (357)..(357): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgccccgtcacccctggagagccggcctccatctcctgcaggtctagtcagagcctccagcatactgatggatacaactatttggattggtacctgcagaagccagggcagtctcacaactctgatctatttggtctaagtccgggcctccggggtcccctgactaggttcagtggcngtgatcgagctatagtatttacactagaaatcagcagagtggaggcgtggaggtacggtttggggtttattacgtgtctagtgacgtaaggtacctaaccgaaacccgtataccgaccgttaccggaccggtaagggaccgtaccgaccgtagggaacgtaaacgttaaaaccgaaccgtttaaggcggtaccgtacggaccaaccccgtagttctttccg

SEQ ID NO: 422516 - DNA, 582 bp, Homo sapiens
  misc_feature: GZ8MTXP02IAD21.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggtctaaagtccgggcctccggggtcccctgactaggttcagtggcaggtcggatcgaggcatagtatttacactagaaaatcagcagaggtggaggcgtaggaggtacggtttggggtttattacgttgcatgacgaaggtctaacaaaccccgtataccgtaccgttaccggaccggacgggaccgaacggtcccgttagggaacgtaacgtttaaaaccggaaacgttggtacggtaccttacggaccgaccctaattccgtttacg

SEQ ID NO: 422517 - DNA, 606 bp, Homo sapiens
  misc_feature: GZ8MTXP02HYW9R.15.25.C03.1.454.CMB.2.raw
  modified_base (355)..(355): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcagcatactgatggatacaactatttggattggtacctgcagaagccagggcagtctcacaactctgatctagtttggtctaagtccgggcctccggggtcccctgactggttcaggtggcngtggatcgagcatagtatttacactagaaaatcagctaggagtggaggacgtaggaagggtacggtttaggggtttaattacgttgactagtaggacgtaaacgggttactaaacccgaaaccccggtataccgtaaacccgttccgggacccggaacggggaccgaccgacccggttaacggaacggtaaacgtttaaaaccggaacgttggtacgggtacctacggtaccaaccgtactttacgttccg

SEQ ID NO: 422518 - DNA, 589 bp, Homo sapiens
  misc_feature: GZ8MTXP02F1RN1.15.25.C03.1.454.CMB.2.raw
  modified_base (364)..(364): a, c, t, g, unknown or other
  modified_base (398)..(398): a, c, t, g, unknown or other
  modified_base (401)..(401): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtcaccacaactcctgattcttatttgggttctaaagtccggggtcctccggggtccccctgactaggttcagtggcnggtggatcgagctaatagtatttacatagaaatnagnagagtggagcgtaggaggtacggtttggggtttaattacgtgactagtacgacgtaacggtacctaaaccgaaaccccgtactaccgtaccgttaccgggaccgaacggggaccaccggaccggttaggaacgtaaagttaaaaccggaacgtaaggtacggtactacgacctacctacgttcgttcg

SEQ ID NO: 422519 - DNA, 559 bp, Homo sapiens
  misc_feature: GZ8MTXP02FZFTG.15.25.C03.1.454.CMB.2.raw
  modified_base (358)..(358): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacactcctgatctagtttgggttctaagtccgggcctccggggtcccctgacaggttcagtggcngtgatcgagcatagtatttacactagaaatcagcagagtggagcgtagaggtaggttagggtttagttacgtgagtagtagacgtaacggtacgtaaccaaacccgactacgtaccgttaccggaccggacgggacgacgaccgtacggacgtaaacgtaaacgtaacgtaaggtcggacgtcgacgaccactacgtttcg

SEQ ID NO: 422520 - DNA, 607 bp, Homo sapiens
  misc_feature: GZ8MTXP02GYOWK.15.25.C03.1.454.CMB.2.raw
  modified_base (343)..(343): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatcctcccgcaggtctagtcagagcctccagcatactgatggatacaactatttggattggacctgcagaagccaggcagtctccacaactcctgatctagtttggtactagtccgggcctccggggtcctgacnggttcaggtggcagtggatcgaggcatagtattttacactagaaaatcagacagagtgggagcgtggagggtacggtttaggggtttattacgtggtacagtacggacgaaacgggttacctaaaccgaaaccccgtactacccgtacccgtaccgggacccggtaacgggaccgaccggtacccgtagggaacgtaaacgttaaaacccgtaacgttggtaacggccgttacggacctaccgtacttaccgttcgtttacccg

SEQ ID NO: 422521 - DNA, 553 bp, Homo sapiens
  misc_feature: GZ8MTXP02JS76H.15.25.C03.1.454.CMB.2.raw
  modified_base (290)..(290): a, c, t, g, unknown or other
  modified_base (350)..(350): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagagccagggcagtcncacactctgatctattggtctaagtccgggcctccggggtcccctgacaggttcagtgcngtggatcgagcagtagtactttacactagaaaatcagcgagagtggaggcgtaggaggtacggtttggggtttattacgtgacgagtgacgaagggtactaaccgaaaccccgataccgaccgttcggaccgtacgggaccaccggccgtacggtagaacgttaaacgaacgtcggtcggacgtacgaccgacctacgtctcg

SEQ ID NO: 422522 - DNA, 534 bp, Homo sapiens
  misc_feature: GZ8MTXP02F24DO.15.25.C03.1.454.CMB.2.raw
  modified_base (355)..(355): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactcctgatctatttgggttctaatcgggcctccggggtcccctgacaggttcagtggcngtggatcgagcatagatttacactagaaaatcagcagagtggaggcgtagaggtacggtttggggtttattacgtgacagtgacaaggtctaaccaaaccccgataccaccgttcggaccgagggaccacgccgtaggacgtaacgttaaacgaacgtgtggactcgacacactcttcg

SEQ ID NO: 422523 - DNA, 542 bp, Homo sapiens
  misc_feature: GZ8MTXP02GAATB.15.25.C03.1.454.CMB.2.raw
  modified_base (460)..(460): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacactcctgatctatttgggttctaagtcgggcctccggggtccccctgacaggttcaggtggcaggtggatcgagcatagtatttacactagaaaatcagcagagtggaggcgtaggaggtacggtttggggttattacgtgcagtgacaaggtacaacaaacccgntacctaccgtcggacggaggaccacgtaccgaggaacgtaacgttaaacgaacgtggtcggactcggacctaccattcttcg

SEQ ID NO: 422524 - DNA, 615 bp, Homo sapiens
  misc_feature: GZ8MTXP02JOWV7.15.25.C03.1.454.CMB.2.raw
  modified_base (286)..(286): a, c, t, g, unknown or other
  modified_base (373)..(373): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtggggatattgtgatgactcagtctccactctccctgcccgtcacccctggagacgccggcctccatcctcctgcaggtctagtcagacgcctcagcatactgatggataacaacttatttggattggtacctgcaaggaanccgagggcagtcaccacactctgattcttagtttggtactaagtccgggccgttccggggtcccctgacgtaggttcaggtcggacnggtggactcgagtactaagtagttatttaacacgtaagaaatcgagtcgaaggtaggtaggacggtacgtagggtacggggtttaacgggttttagggggttttaattacgtgtacgtaagtcgaacgtaacggttaccaacccgtaaacccgactaccgtacccgttacgggaccggacggaccgaccggtccgtaaggaacgtaacgtaaacgacgtgtcggctacgacactcgtcttcg

SEQ ID NO: 422525 - DNA, 544 bp, Homo sapiens
  misc_feature: GZ8MTXP02HHG59.15.25.C03.1.454.CMB.2.raw
  modified_base (357)..(357): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaagtcgggcctccggggtccccctgacaggttcagtgcngtgatcagcatagtatttacactagaaaatcagcagagtggagcgtagaggtacggtttggggtttattacgtgctagtgacgaaggtactaaccgaaaccccgataccgaccgttcggaccggagggaccacggccgtaggacgtaacgttaaacgaactggtaggactacgaccaccactactcg

SEQ ID NO: 422526 - DNA, 546 bp, Homo sapiens
  misc_feature: GZ8MTXP02HWVQE.15.25.C03.1.454.CMB.2.raw
  modified_base (292)..(292): a, c, t, g, unknown or other
  modified_base (353)..(353): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagagccggcctccatcctcctgcaggtctagtcagagccctccagcatactgatggatacaactatttggattggtacctgcagaagcaggcagtcnccacactctgatctatttggtcagtccgggcctccggggtccctgactaggttcaggtgcnggtgatcgaggcatagtatttacatagaaatcagcagagtggaggctaggaggtacggtttggggtttaattacgtgctagtcgacaacggtctaaaccgaaacccgtatccgaccgttcgggaccgagggaccacggccgtaggacgtaacgttaaaccgaagtgtcggtactacgactaccgtattcgtcg

SEQ ID NO: 422527 - DNA, 567 bp, Homo sapiens
  misc_feature: GZ8MTXP02JQBO3.15.25.C03.1.454.CMB.2.raw
  modified_base (340)..(340): a, c, t, g, unknown or other
  modified_base (350)..(350): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagagccaggcagtctccacaactcctgatctatttggtctaagtcgggcctccggggtcccctgacnggtcagtgcngtgatcagcaatagtatttacactagaaatcagcgagaggtaggaggtcgtaggtagggtacggtttggggtttaattacgtgactagtagacgtaaggtacctaaccgaaaccccgtataccgtaccgttccggaccggacgggaccaccggaccgtacggaacgtaaacgttaaaacgaacgtggtacggacgtacggtacaccgtactacttcg

SEQ ID NO: 422528 - DNA, 629 bp, Homo sapiens
  misc_feature: GZ8MTXP02I43Z4.15.25.C03.1.454.CMB.2.raw
  modified_base (357)..(357): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactcctgatctatttgggttctaagtccgggcctccggggtcccctgacaggttcagtggcnggtggatcgaggcagtagtatttacactagaaaatcagcagagtggaggcgtaggagggtacggtttaggggtttaattacgtgacgtagttacgacgaaagggttacctaaaccgtaaaaccccggtacttacccgtaccgtttaccgggacccgggaaggggaacccgaccggtacccgtacggggtaaacgttaaaacgtttaaaaccggaaaccggttaagggtcgggtaccgttacggacccgtaacctaacgtttacctttaccgg

SEQ ID NO: 422529 - DNA, 519 bp, Homo sapiens
  misc_feature: GZ8MTXP02HSI88.15.25.C03.1.454.CMB.2.raw
  modified_base (276)..(276): a, c, t, g, unknown or other
  modified_base (288)..(288): a, c, t, g, unknown or other
  modified_base (291)..(291): a, c, t, g, unknown or other
  modified_base (295)..(295): a, c, t, g, unknown or other
  modified_base (333)..(333): a, c, t, g, unknown or other
  modified_base (337)..(337): a, c, t, g, unknown or other
  modified_base (349)..(349): a, c, t, g, unknown or other
  modified_base (377)..(377): a, c, t, g, unknown or other
  modified_base (379)..(379): a, c, t, g, unknown or other
  modified_base (381)..(382): a, c, t, g, unknown or other
  modified_base (387)..(387): a, c, t, g, unknown or other
  modified_base (392)..(392): a, c, t, g, unknown or other
  modified_base (420)..(420): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaatatttggatggtactgcagaanccagggcagtcncanaacnctgatctatttgggtctaatcggcctccggggtccccngacnggttcagtggcngtgatcagcatagtatttacatagaaananannagagnggagngagaggtaggttaggttagttagtaganagtagacgagtactaacaaccgactactacgtcgacggacggacgacgacgtacgaacgaacgtaaacgtaacgtaagtgtacgtacacacactactcg

SEQ ID NO: 422530 - DNA, 579 bp, Homo sapiens
  misc_feature: GZ8MTXP02HIDZL.15.25.C03.1.454.CMB.2.raw
  modified_base (355)..(355): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttggttctaagtcggcctccggggccccctgacaggttcagtggcngtggatcaggcatagatttacactagaaaatcagcagagtggaggcgtaggaggtacggttgggggttttaattacgttgactagtgacgtaaagggtcctaacgaaaccccgataccgtaaccgttccgggaccgaacgggggaccaccgggaccgttagggaacgtaaacgtttaaaacgaaacgtggttacggactcggaccacccgtaatacccgtttcg

SEQ ID NO: 422531 - DNA, 595 bp, Homo sapiens
  misc_feature: GZ8MTXP02HW7MA.15.25.C03.1.454.CMB.2.raw
  modified_base (294)..(294): a, c, t, g, unknown or other
  modified_base (361)..(361): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctcaatctcctgcaggtctagtcagagcctccagcatactgatggatacaacttatttggattggtacctgcaagaagccgagggcagtcnccacactctgatcttagtttggttctaagtccggggcctccggggtcccctgacaggttcagtggcnggtgatcgaggcatagtatttacactagaaaatcagcgtagaggtggagcgtaggagggtacggtttaggggtttattacgtgactagtagactaacgggtacctaaccgaaaccccggtataccgtaacccgttccgggaccggaacggggacaccgtaccggttaaggaaacgtaaacgttaaaaccggaacgttaaggtcgggactacggactaacccgtattcgtttacg

SEQ ID NO: 422532 - DNA, 583 bp, Homo sapiens
  misc_feature: GZ8MTXP02ID85F.15.25.C03.1.454.CMB.2.raw
  modified_base (355)..(355): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccgagggcagtctccacaactctgatctatttggtctaagtccggcctcggggtcccctgactaggttcagtggcngtggatcgagctatagtatttacactagaaatcagcgaggaggtaggaggtcgtaggagggtacggtttaggggtttaattacgttgactagtgacgtaacggtacctaaccgaaaaccccgtactaccgtaacccgttccgggaccggacgggaccgaccggtaccgtagggaacgtaacgttaaacgtaacgtggtacggactacggaccaccgtacgtactttcg

SEQ ID NO: 422533 - DNA, 581 bp, Homo sapiens
  misc_feature: GZ8MTXP02IF2DC.15.25.C03.1.454.CMB.2.raw
  modified_base (288)..(288): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcagcatactgatgatacaactatttggattggtacctgcagagccagggcagtcncacactctgattctagtttgggtactaagtccggggcctccggggtcccctgactggtcagtggcaggtggatcgaggctatagtactttaacactagaaaatcagacgagaggtggaggctaggaggtacggtttggggtttattacgtgactagtagacgtaaaggtacctaaccgaaaccccgataccgtaacccgttcgggaccggacgggaccaacggcccgtaggtaacgtaaacgtttaaaaccgaaagttcggtcggacgttacggacctacccgtatacgttcg

SEQ ID NO: 422534 - DNA, 577 bp, Homo sapiens
  misc_feature: GZ8MTXP02GYOXT.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagacgcctccagcatactgatggatacaactattggattggtacctgcagagccgaggcagtctaccacaactctccgatcttagtttgggttctaagtccggggcccttccggggtccccctgactaggttcaggtggctggtgatcgagcatagtatttacatagaaatcagcagagtaggagcgtaggagggttacggtttggggtttatacgtgactagtagtacgtaacggtacctaaaccgaaacccgtagtaccgaccgttacggaccggaacgggaccaccggtaccgtaggaacgtaacgtaaacgaacgtggtacgacgtacgacctactactcgttacg

SEQ ID NO: 422535 - DNA, 604 bp, Homo sapiens
  misc_feature: GZ8MTXP02JRUQ3.15.25.C03.1.454.CMB.2.raw
  modified_base (356)..(356): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccgagggcagtctccacaactcctgatctagtttggttctaagtcgggcctcggggtccccctgactagtcagtgcngtgatcgaggcatagtatttacactagaaaatcagcagaggaggaggcgtggaggtacggtttggggtttaattacgtgcgtagtacggacgtaaacgggttacctaaccgaaaccccgtaacgtacccgtaaacccgtttccggggacccggtaacgggggaccgaccgggacccgtaggggtaaacgtaacgttaaaaccgaaaccgttggtacggtcgtacggcctaaccgtacttacgtttccg

SEQ ID NO: 422536 - DNA, 630 bp, Homo sapiens
  misc_feature: GZ8MTXP02GGF9D.15.25.C03.1.454.CMB.2.raw
  modified_base (276)..(276): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactcctccctcgcccgtcacccgtggacgacgcccggcctccatcctcctgcaggtctagtcagacgcctcagcatactgatagatacaacttagttgattcgtacngacagacgcgaggcacgtccaccaactaacctctagtacttcttaggtttcggttactaacggtccgggtaccggttccgggtcccctagacgtcggtcgaggtcgagtggtgactacgagtactaagtaagttacttaacagtaagaaactacgagagaggtaggtagggtaggtacggtagggttacgggttacgggtttaggtttactacgtagtacgttagtacgaaccgtaaccggttaccaaaccggtaacccgtacgtaccgtaccggtacgggacgacggacgaccggtacgagtaacgtaaacgtaacgtaagtcggtcgacgtcgacacttcgtacgtttaccg

SEQ ID NO: 422537 - DNA, 555 bp, Homo sapiens
  misc_feature: GZ8MTXP02F67G2.15.25.C03.1.454.CMB.2.raw
  modified_base (290)..(290): a, c, t, g, unknown or other
  modified_base (355)..(355): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtcnccacaactcctgatctatttgggttctaagtcgggcctccggggtcccctgacaggttcagtgcngtggatcgagcagtagtatttacactagaaatcagcagagtggaggctaggaggtacggtttaggggtttattacgtgctagtgactaggtactaaccgaaacccgataccgaccgttcgggaccggacggggaccacggaccgtagggaacgtaaacgttaaacgaacgtggtacggacgtacgaccactacttcttcg

SEQ ID NO: 422538 - DNA, 608 bp, Homo sapiens
  misc_feature: GZ8MTXP02HURD7.15.25.C03.1.454.CMB.2.raw
  modified_base (359)..(359): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatcttatttgggttctaagtccgggcctccggggtcccctgacaggttcagtggcnggtggatcgaggcatagtatttacactagaaatcagcagagtggaggctaggaggtacggtttggggtttatttacgttgacgtagtgacgaaggttacctaaaccgaaaaccccgtagtaccgtaacccgtttccgggacccggtaaacgggggaccaaaccggccgttacgggtaacggtaaaactttaaaaccggaaacgttgggttacgggccgttacggacctaaccctagtttacctttaccg

SEQ ID NO: 422539 - DNA, 589 bp, Homo sapiens
  misc_feature: GZ8MTXP02JXKR9.15.25.C03.1.454.CMB.2.raw
  modified_base (296)..(296): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagagccggcctccatctcctgcaggtctagtcagacgccctccagcatactgatggatacaactatttggatttggtacctgcagaagccgagggcagtcnccacaactctgatcttatttgggttactaagtccgggcctcccccggggtcctgactaggttcaggtggcaggtggatcgaggtcagttagtacttttaacattagaaatcagacaggaggtagggaggcgttaggagggttacggtttagggggtttattacgtgctagcgacgtaacggtacctaaccgaaaccccgtagtaccgtaaccgttcgggaccggacgggaccgaccggaccgtacggaacgtaaacgttaaaacgaacgtggtacggctacgacaccacttcg

SEQ ID NO: 422540 - DNA, 386 bp, Homo sapiens
  misc_feature: GZ8MTXP02GPJFD.15.25.C03.1.454.CMB.2.raw
  modified_base (359)..(359): a, c, t, g, unknown or other
  modified_base (382)..(386): a, c, t, g, unknown or other
tcagtctacgtagccacgaccggtgctcgatttagtagtgtagatttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctcccgtcccccttcgcagtaacaccaagtacaggaatattaacctgttcccatcgactacgcctttcggcctcgccttagggtcactcaccctgccccgattaacgtggacaggacccttggtctccggngagcggctggcaaggcgcatagnnnnn

SEQ ID NO: 422541 - DNA, 549 bp, Homo sapiens
  misc_feature: GZ8MTXP02HR79K.15.25.C03.1.454.CMB.2.raw
  modified_base (292)..(292): a, c, t, g, unknown or other
  modified_base (296)..(296): a, c, t, g, unknown or other
  modified_base (363)..(363): a, c, t, g, unknown or other
  modified_base (380)..(380): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagagccggcctccatctcctgcaggtctagtcagagcctccagcatactgatggatacaactatttggattggtacctgcagaagccagggcagtcnccanaactcctgatcttatttgggttactaagtcgggccttccggggtccccctgacaggttcagtcggcngtggatcaggcatagtntttacactagaaaatcagcagagtggaggctagaggtacggtttggggtttattacgtgctagtagcgaaggtactaacgaaacccgatccaccgttcggaccgtacgggacacgccgttaggaacgacgttaaaaccgagttaagtggacctcgacacctatccttcg

SEQ ID NO: 422542 - DNA, 617 bp, Homo sapiens
  misc_feature: GZ8MTXP02HNGX5.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaacttattgattggtacctgcagaagccgaggcagtctcacaactcctgatcttagtttggtactaagtccgggcctccggggtcccctgactaggttcaggtcggcaggtggaactcgaggtactaagtaagttacttttaacgaactaagtaaaatcgagtacgaggtaggtggaacggtcgtagggtaagggttacggtttaggggttttaacttacgttgatagtgtacgaggttaccaaccgtaaacccgattaccgaaccgttccgggaccggaacgggaccaaccggccggttaaggaacgtaacgtttaaaacggacgttaaggacggtactacgtaccaccgttactacgtttccg

SEQ ID NO: 422543 - DNA, 540 bp, Homo sapiens
  misc_feature: GZ8MTXP02FOPN5.15.25.C03.1.454.CMB.2.raw
  modified_base (388)..(388): a, c, t, g, unknown or other
  modified_base (400)..(400): a, c, t, g, unknown or other
  modified_base (429)..(429): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggacctgcagaagccagggcagtctccacaactcctgatctatttgggttctaatcgggcctcggggtccccctgacaggttcagtggcagtggatcagcatagatttacatagaaaatcaganagagtaggaggngtagaggtaggttagggtttagttatganagtagacgaagtactaaccaaacccgactactacgtcggacggacggacgacgacgtacggacgtaaacgtaaacgtaaacgtaagtggtacgtacgacaccactacgtcg

SEQ ID NO: 422544 - DNA, 569 bp, Homo sapiens
  misc_feature: GZ8MTXP02HXAMA.15.25.C03.1.454.CMB.2.raw
  modified_base (291)..(291): a, c, t, g, unknown or other
  modified_base (341)..(341): a, c, t, g, unknown or other
  modified_base (353)..(353): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtcncacaactctgatctatttggtctagtccgggcctccggggtcccctgacnggttcagtggcngtggatcgaggcagtagtattttacactagaaaatcagacagagtggaggcgtaggagggtacggtttggggtttaattacgtgactagtacgacgaaggtactaaaccgaaacccgataccgtaccgttcgggaccggaacgggaccgacggtcgtaacggacgtaaacgttaaaacgtaaacgtggtacggactacgacgacctattacgttcg

SEQ ID NO: 422545 - DNA, 609 bp, Homo sapiens
  misc_feature: GZ8MTXP02F6BFG.15.25.C03.1.454.CMB.2.raw
  modified_base (375)..(375): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagacgcctccagcatactgatggatacaacttattggattggtacctgacaagaacgccgagggcagtcctaccaacaactctgatcttagtttgggttactaagtccgggtccgtccggggtcccctgactaggttcaggtcggacngggtgatcgagcatagtatttacactagaaaatcagcgagaggtaggacggtgtaggtaggttacgggtttagggtttaattacgttgcgtaagtcgaacgtaacggtacctaacccgtaaacccgtatacccgtaccgttaccgggaccgggacggaccgaccggtaccgtaagggtaacgtaaacgtaaaacggtaacgtcggtaggcctacgacctaacgtactcgtttcg

SEQ ID NO: 422546 - DNA, 595 bp, Homo sapiens
  misc_feature: GZ8MTXP02FWQ7F.15.25.C03.1.454.CMB.2.raw
  modified_base (364)..(364): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctccagcatactgatggatacaactattggattggtacctgcagaagccgagggcagtctccaacaactcctgatcttagtttgggttactaagtccgggcctccggggtcccctgacctaggtcagtggcnggtgatcgagcatagtatttacatagaaatcagcagagtggaggcgtaggagggttacggtttaggggttattacgtgactagtgacgtaaggtacctaaccgaaacccgactaccgacccgttcggaccggtaacgggacctaccggaccgtaagggaacgtaaaacgttaaaaccggtaaacgttcgggtacggtaccgtacggacccgtaaccgtacgttactttacg

SEQ ID NO: 422547 - DNA, 569 bp, Homo sapiens
  misc_feature: GZ8MTXP02F9HKK.15.25.C03.1.454.CMB.2.raw
  modified_base (347)..(347): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactcctgatctagtttgggttactaagtcgggcctccggggtccccctgacnggttcagtggcaggtgatcgaggcaatagtatttacactagaaaatcagcagagtaggaggctagaggtacggtttggggtttattacgtgactatgacgtaaggtactaacgaaaaccccgatacctaaccgttccggaccgacggggaccacggaccgtagggaacgtaaacgttaaaacgaaacgtggtacggacttacggacctaaccacttacttcg

SEQ ID NO: 422548 - DNA, 548 bp, Homo sapiens
  misc_feature: GZ8MTXP02I8ED6.15.25.C03.1.454.CMB.2.raw
  modified_base (257)..(257): a, c, t, g, unknown or other
  modified_base (289)..(289): a, c, t, g, unknown or other
  modified_base (331)..(331): a, c, t, g, unknown or other
  modified_base (346)..(346): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactnttggattggtacctgcagagccagggcagtcncacactctgatctatttggtctagtccggctccgggtccccngacagttcagtggcngtgatcgagctatagtatttacactagaaatcagcagagtggaggcgtaggaggtacggttggggtttattacgtgctagtgacgtaacggtactaaccgaaaccccgtataccgaaccgttccgggaccggacggaccgaccgtaccgtacggagtaaactaacggaaacgtcggtacgcgtacgactaaccactacttcg

SEQ ID NO: 422549 - DNA, 619 bp, Homo sapiens
  misc_feature: GZ8MTXP02F2K2U.15.25.C03.1.454.CMB.2.raw
  modified_base (506)..(506): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagagccagggcagtctccacactcctgatctatttgggtctaagtcgggcctccggggtccccctgacaggttcagtggcaggtggatcgaggcagtagtatttacactagaaatcgagacgaaggaggtagggaacggtcgtagggtaacgggttaacgggttttagggggtttaattaaccggtgtacgtaagtcgtaccgtaacgggtacctaaaccgaaaaccccggtntacccgtaccgttaccgggaccggacgggaaccgaccggtaccgtagggtaacgtaaaacgttaaaccggtaaacgtcggtacgtacgtacgaccaaccgtacgtactttccg

SEQ ID NO: 422550 - DNA, 633 bp, Homo sapiens
  misc_feature: GZ8MTXP02JYX8S.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagacgccggcctccatctcctgcaggtctagtcagacgcctcagcatactgatggatacaacttagttggattcggtacctgacaaggaacgccgaggggcacgtcctaccaactaacctcctgtattcttaagtttcgggttactaacgtccgggtcccgtccggggtccccctaggacgtaggttcaggtcggcgtaggtggactcgagctattagtactttacactaagaaactcagagaggaggtggaaggtcgtaggaggttacgggtttgggttaactcgtgactagttcgaacgtaacggtacctaaccgtaaacccgacgttacccgaccggttaccgggaccggaacgggaccgacggtacccgtaggtaaacgtaaacgttaaaccgacgtaaggttcggacttacgaacctacctagttaccttcgg

SEQ ID NO: 422551 - DNA, 549 bp, Homo sapiens
  misc_feature: GZ8MTXP02HZ3G1.15.25.C03.1.454.CMB.2.raw
  modified_base (289)..(289): a, c, t, g, unknown or other
  modified_base (348)..(348): a, c, t, g, unknown or other
  modified_base (456)..(456): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagagccaggcagtcncacactctgatctatttggtactaagtcgggctccggggtcccctgactgttcagtgcngtgatcgagcatagtatttacactagaaaatcagcagagtggaggctaggaggtacggtttggggtttattacgtgacagtgacaaggtacctaaccgaaaccccgtntaccgaccgttcgggaccgacgggacaccgaccgtacggaagtaaacgttaaaacgacgtaaggtacggacgtcgaccaccgtattacgttcg

SEQ ID NO: 422552 - DNA, 593 bp, Homo sapiens
  misc_feature: GZ8MTXP02FNN3V.15.25.C03.1.454.CMB.2.raw
  modified_base (360)..(360): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatcctcctgcaggtctagtcagagcctccagcatactgatggatacaactattggattggtacctgcagaagccgagggcagtctaccacaactcctgatcttatttgggttctaagtcgggcctccggggtcccctgacaggtcaggtggcnggtgatcgagctaatagtatttacactagaaaactcagcgagaggtgggagcgtaggagggttacggtttaggggtttaattacgtgactagttagaccgtaaaggttacctaacccgtaaaccccggtatacccgtaacccggttcgggaccggaacggggaccacggtaccgtaggaacgtaaacgtaaacgtaacgtggtacggtctacggaccaccgtactcgtttacg

SEQ ID NO: 422553 - DNA, 579 bp, Homo sapiens
  misc_feature: GZ8MTXP02HR6IG.15.25.C03.1.454.CMB.2.raw
  modified_base (344)..(344): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggacctgcagagccaggcagtctcacactctgatctatttggtctagtcggcctccggggtcccctgactgtcagtgcngtgatcgagcatagtatttacactagaaatcagcagagtggagcgtaggaggtacggtttaggggtttattacgtgacagtgacgtaaggtacctaaaccgaaaccccgtattaccgtaccgttaccgggaccggaacggggaccgaaccggtccgttaacgggaacgtaaacgtttaaaaccggaaacgttcgggttaggaccgttacggaccgaacccgtaagttccgtttcg

SEQ ID NO: 422554 - DNA, 642 bp, Homo sapiens
  misc_feature: GZ8MTXP02G4DEB.15.25.C03.1.454.CMB.2.raw
  modified_base (357)..(357): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatcttatttgggttctaagtcgggcctccggggtcccctgacaggttcagtgcngtgatcgagcatagtatttacactagaaaatcagcagaggtggaggcgtagagggtaaggtttggggtttaattacgttgacgtagttaggtacgaaacgggtaccttaaacccgaaaacccccggtaacttacccgtaaacccgtttaccggggacccggtaaaccgggggtaaaccgaacccgggacccgttaaggggaaaccggtaaaacgtttaaaaaccggtaaacgttaacgggttacggacccgttacggacccgaacccgtaactttactttaccgg

SEQ ID NO: 422555 - DNA, 640 bp, Homo sapiens
  misc_feature: GZ8MTXP02GT659.15.25.C03.1.454.CMB.2.raw
  modified_base (403)..(403): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaacttatttggattggtacctgcaagaagccgagggcagtctaccacaactcctagatcttagtttgggtactaagtccggggcctccggggtcccctgactaggttcaggtggcagtggatcgaggctaatagtatttacactagaaaanacagacgagaggtaggaggagtaggtaagggtacgggtttaggggtttaaggtttaacgttagtacgtagttagacgtaacggtaaccgttaaacccgaaaaccccggtaaccgtacctaacccgttaccgggtacccgggaaccggggaaccggaaccggaccggtacgggaacgtaaacgttaaaacgtaaaccgtaaggtcggacgtacggtaccgacctaacgtacgtttccg

SEQ ID NO: 422556 - DNA, 587 bp, Homo sapiens
  misc_feature: GZ8MTXP02IFH22.15.25.C03.1.454.CMB.2.raw
  modified_base (354)..(354): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactcctgatctatttggtctaagtcggcctccggggtcccctgactaggttcaggtgcngtgatcgagcagtagtatttacactagaaaatcagacagagtaggaggtcgtaggaggtacggtttggggtttaattacgtgactagtacgacgtaacggtacctaaaccgaaacccccgtataccgtaaccgttaccgggacccgaacggggaccaccggacccgtagggaacgtaaacgtttaaaaccgaacgttaaggtacggcgtacggaccaccctagtaccgtttcg

SEQ ID NO: 422557 - DNA, 584 bp, Homo sapiens
  misc_feature: GZ8MTXP02H2NV8.15.25.C03.1.454.CMB.2.raw
  modified_base (294)..(294): a, c, t, g, unknown or other
  modified_base (362)..(362): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagacgccggcctccatctcctgcaggtctagtcagagcctccagcatactgatggatacaactattggattggtacctgacagaacgccagggcagtcnccaacaactctgattcttagttttggtactaagtccgggcctccggggtccctgactggtcagtggcnggtgatcgagctagtagtactttacactaagaaatcagcgaagaggtggaggacgtggtaagggttacggtttagggtttaacttagtagtactagtgaacgtaacggtacctaaccgaaacccgtataccgtaccgttacggaccggaacggaccgacgtaccgtaaggtaacgtaaacgttaaacgacgttaacggcggtactcgacactacttacgtcg

SEQ ID NO: 422558 - DNA, 607 bp, Homo sapiens
  misc_feature: GZ8MTXP02HS5WF.15.25.C03.1.454.CMB.2.raw
  modified_base (296)..(296): a, c, t, g, unknown or other
  modified_base (360)..(360): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagagccggcctcatctctgcaggtctagtcagagcctccagcatactgatgatacaatattgattggtacctgcagaagccgagggcagtctccacactcngatcttagtttgggtactaagttccgggccttccggggtccccctgactaggttcaggtcggcnggtgatcgaggcatagtatttacactagaaaatcagcagtagtggaagcgtaggagggtacggtttaggggtttaattacgtgactagtgtacgaacggttcaaaccgaaaccccggtattaccgaccgtttaccgggaccggtaacggggaccaaccggttcccgaacggggtaccgtaaaagttaaaacccgggtaactgggttacgggacttccggacctaaccctaacggtttcgtttaaccg

SEQ ID NO: 422559 - DNA, 644 bp, Homo sapiens
  misc_feature: GZ8MTXP02H63YO.15.25.C03.1.454.CMB.2.raw
  modified_base (301)..(301): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtggggatattgtgatgactcagtctccactcctccctgcccgtcacccctggagacgccggcctccatctcctgcaggtctagtcagacgcctccagcatactgatggaatacaacttagttggattggtacctgacaagaacgccgagggcagtcnccaacaactcctagattcttagtttgggtactaacgttccggggccgttccggggtccccctgtacgtaggttcgaggtggctggtggatcgaggcagtaatatttaacaactagaaaatcgagacgagaggtggaggtcgtagggtagggtacggtttaggggtttaattacgttagactagtacgtaacgtaaacgggttacctaaacccgtaaaccccgtacttaccgtaacccgggttacgggacccggaaacggggaccgtaaccggacccggtaacgggaacgtaaaccgttaaacggaaacgttggtacggacttcggacctactacgtttctacg

SEQ ID NO: 422560 - DNA, 659 bp, Homo sapiens
  misc_feature: GZ8MTXP02IM7L9.15.25.C03.1.454.CMB.2.raw
  modified_base (228)..(228): a, c, t, g, unknown or other
  modified_base (280)..(280): a, c, t, g, unknown or other
  modified_base (375)..(375): a, c, t, g, unknown or other
  modified_base (399)..(399): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcaccctggagagccggcctccatctcctgcaggtctagtcagngcctccagcatactgatggatacaacttatttggattggacctgacagaacnccgagggctagtcctccaactaactcctgacttctagttttcgggtacttaagtccggggccgttccggggtcccctggactaggttcaggtgcnggtgatcgagcatagtatttacanagtaaaatcagtacgaggaggttacggaggtacgtagggtagggttaaggttttacgggggtttaattaccgtggtactaggtacggtaccgtaacgggttacctaaaccgaaaaccccggtctaacccgtaaccggttaccgggtaacccggacggggtaaaccgacggtacccggttaaggaacggtaaaacgtttaaaccgaaaccgttggtaccgggtaacttccggaccgtaaacccgtttacgttaccgttacg

SEQ ID NO: 422561 - DNA, 573 bp, Homo sapiens
  misc_feature: GZ8MTXP02FSDDC.15.25.C03.1.454.CMB.2.raw
  modified_base (355)..(355): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacactctgatctatttgggttctaagtcgggcctccggggtcccctgacaggttcagtggcnggtgatcgaggcaatagtatttaacactagaaatcagcagaggtggaggcgtaggtagggtacgggtttgggggtttaattacgtggctagtgacgtaaggtacctaaccgaaaccccgataccgacccgttaccggaccggacgggacaccggccgtagggaacgtaaacgttaaacggaaacgttggtacggctacggacctaccacttcgtttcg

SEQ ID NO: 422562 - DNA, 617 bp, Homo sapiens
  misc_feature: GZ8MTXP02IKJAZ.15.25.C03.1.454.CMB.2.raw
  modified_base (302)..(302): a, c, t, g, unknown or other
  modified_base (340)..(340): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcagcatactgatggatacaacttatttggattggtacctgcagaagccagggcagtcctccacactcngatctatttgggtctaagtcgggcctccccggggtccngactaggttcagtggcagtggatcgaggcatagatttacactagaaaatcagacaggaggtaggaggcgtaggtagggtacggtttaggggtttagtttacgtgtactagtagacgtaaacggttacctaaaccgtaaaccccgtacgtacccgtaacccggtttccgggacccgggtaacggggaaccgaaccggtacccgtaaggggaaacgtaaacgttaaaaccggtaaacgtacgggtacggtaccgtacggacccgtacctaacgtttccg

SEQ ID NO: 422563 - DNA, 755 bp, Homo sapiens
  misc_feature: GZ8MTXP02GE3FV.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctccagcatactgatggatacaacttattggattggtacctgacagaagccgagggcagtcctaccaactaacctcctagtacttcgttagttttcgggtttactaaacggtccggggtcccgttccggggtccccctaggtaccgtagggtttaccaggttcggacgtaggggtggaacttacggaacgggtacctaaagtttaaacggttaaacttttttaaaccaaacgtttaaaggaaaaaacttccgaaaggtaccgaaagggtaggggttaggggaacgggtcgtagggtaacggggtttaaccggggtttttagggggttttaaatttaaccggttggtaccgtaaggttacgaaccgtaaacgggttacccttaaaacccgaaaaccccgtacgtacccgtaacccggttaccgggaccggaacggtaccgaccggtaccggtaaaggtaacgtaaaacgtaaaaccggtaacgtcggtacggtaccgtacggacctaacgtacgttcgtttacg

SEQ ID NO: 422564 - DNA, 592 bp, Homo sapiens
  misc_feature: GZ8MTXP02G4S9P.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcagcatactgatggatacaacttattggattggtacctgcagaagccagggcagtctaccacaactcctgatctatttgggtactaagtcgggcctcccggggtcctgacaggttcaggtgcagtggatcgagcatagtatttacactagaaatcagacagaggtggaggcgtggtagggtacggtttaggggtttattacgtgacgagtgacgtaagtaccgtaaccgaaaccccgtatacccgtaaccgtttaccgggaccggtacgggaaccgtaccggtacccggtacggaaacggtaacgttaaaaccggtaacgttacggtacggacgtacggacctaaccgtaactttccg

SEQ ID NO: 422565 - DNA, 536 bp, Homo sapiens
  misc_feature: GZ8MTXP02JL2SN.15.25.C03.1.454.CMB.2.raw
  modified_base (356)..(356): a, c, t, g, unknown or other
  modified_base (515)..(515): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctccagcatactgatggatacaactattggattggtacctgcagaagccagggcagtctccacaactcctgatctatttggtctaagtccgggcctccggggtccccctgacagttcagtggcngtggatcgaggcatagtatttacactagaaaatcagcagagtggagctgaggtacggttgggtttattactgctagtagacaaggtcctaacgaaaccccgtatcctaaccgttcggaccgacgggacacggcctacggagaacgttaaaccgaatcgngtcacggacaccgtatcttcg

SEQ ID NO: 422566 - DNA, 600 bp, Homo sapiens
  misc_feature: GZ8MTXP02HU6HK.15.25.C03.1.454.CMB.2.raw
  modified_base (229)..(229): a, c, t, g, unknown or other
  modified_base (284)..(284): a, c, t, g, unknown or other
  modified_base (352)..(352): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagngcctccagcatactgatggatacaatattggattggactgcagagcaggcagtcnccacactctgacttctagtttggtactagtccgggcctccggggtccctgacgtggttcagtcggacnggtggactcgaggctatagttactttacaactagaaatcagtacgaggaggtaggaggtcgtagggtaagggttacggttttaggggtttaactttacggtagacgtagtacgacgtaacggtacctaaaccgaaaccccgtagtacccgtacccggttacggaccggaacgggaccgacgtaccggttaggaacgtaaacgttaaaaccggacgtcggttacggactcgactacctagttctttacg

SEQ ID NO: 422567 - DNA, 593 bp, Homo sapiens
  misc_feature: GZ8MTXP02JVVL3.15.25.C03.1.454.CMB.2.raw
  modified_base (338)..(338): a, c, t, g, unknown or other
  modified_base (391)..(391): a, c, t, g, unknown or other
tcagtctacgtagccacgaccggtgctcgatttagtagtgtagatttgggtttgggggatcaggactcctcagttcaccttcccacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcagcatactgatggatacatattggattggacctgacagaacgccgaggcagtctccacactcctgatctagtttggtactaacgtccgggtcctccggggtccngactaggttcagtggcagtggactcgagcagtagtatttacatagaaatcagnagagtggagtcgtaggaggttacggttaggggtttatacgtggactaagtcggactaacggtacctaaaccgaaacccggtcttacccgtaaccggttccgggacccggtaacggggacccgacggaccgtagggaaacgtaaacgttaaaccgaacgttggtaacggctacggactaacccgttacgttaccgtacgttac

SEQ ID NO: 422568 - DNA, 621 bp, Homo sapiens
  misc_feature: GZ8MTXP02J1AUF.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcccgcaggtctagtcagacgcctccagcatactgatggatacaactattggattggtacctgcagaagccaggcagtctcacactcctagatctagtttggtactaagtccgggcctccggggtcctgactaggttcagtgcagtggatcgagcatagtatttacactagaaatcagcagagtggaggcgtaggtaggtacggtttagggggtttattacgtgacgtagtacggtacgtaacggtaccttaaacccgaaacccccgtacttacccgtacccgttacccggggaacccggtacggggaacccgtaccgggtacccgtagggtaaacggtaaacgttaaaaccggaaaccgttggtaacggtccgttaccggacctaaccctacgtttcctacgtttacccg

SEQ ID NO: 422569 - DNA, 524 bp, Homo sapiens
  misc_feature: GZ8MTXP02HWLUD.15.25.C03.1.454.CMB.2.raw
  modified_base (290)..(290): a, c, t, g, unknown or other
  modified_base (299)..(299): a, c, t, g, unknown or other
  modified_base (353)..(353): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcagcatactgatggatacaactatttggattggtacctgcagaagccagggcagtcnccacactcngatctatttggtcaagtccgggcctccggggtcccctgactaggttcagtggcngtggatcgaggcatagtatttacactagaaaatcagcagagtggagctgaggtagtttggggtttatacgtgcagtgacaaggtctaacgaacccgtatccaccgttcggcgagggaccacgccgtaggacgtaacgttaaacgactgtacggctacgctaccacttctcg

SEQ ID NO: 422570 - DNA, 601 bp, Homo sapiens
  misc_feature: GZ8MTXP02HWJ42.15.25.C03.1.454.CMB.2.raw
  modified_base (360)..(360): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccgagggcagtcaccacaactcctgatcttagtttggtactaagtcgggcctccggggtcccctgactaggttcaggtggcngtggatcgaggctaagtagtactttacactagaaaatcaagcgagagtggaggcgtaggagggtacggtttaggggtttattacgtgactaagtgtacgaaggtacctaaaccgaaaacccgtactccgtaaccgtttaccgggaccggaacgggaccgaccggaccggttacgggaaagtaaacgttaaaacggtaacgttcggtacggacccgttaggacctaacccgtattacgttcg

SEQ ID NO: 422571 - DNA, 765 bp, Homo sapiens
  misc_feature: GZ8MTXP02FX6AN.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagcgccgcctccatcctcctgcgaggtctagtcagacgcctaccacgcactacgtgagttaggaactaactaaactttagtttaggtagttacggtacctgaccgaaggaacgccgaggcacgtcctaccaactaacctcctagtacttactttaggtttcgggtttactaacggtccgggtccccggttccggggtcccccctacggtaccgtaggttacgtaggtcggacgtagggtgtacgtacgtacggactaagttaaacgttaactttttaaccgaacgttaaaaggtaaaactaccgaacgacgtaaagggaggttacggggaaggtcggttaaaggggtaagggggttttaaccgggggttttagggggtttttaactttaaccggttaggtaacccgttagtttaacgggaaaccggttaaccgggttaaacccctaaacccggtaaaaccccggttactacccgtacccggtttaccggaccgggtacgggaccgtacggaccggtaggtaacgtaaacgtaacggaacgtggtcgacgtcgacctaacgtactcgttccg

SEQ ID NO: 422572 - DNA, 546 bp, Homo sapiens
  misc_feature: GZ8MTXP02G0V65.15.25.C03.1.454.CMB.2.raw
  modified_base (290)..(290): a, c, t, g, unknown or other
  modified_base (294)..(294): a, c, t, g, unknown or other
  modified_base (344)..(344): a, c, t, g, unknown or other
  modified_base (373)..(373): a, c, t, g, unknown or other
  modified_base (375)..(375): a, c, t, g, unknown or other
  modified_base (419)..(419): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcagcatactgatggatacaacgtattggattggtacctgcagaagccagggcagtcnccanaactctgatctattggtcaatcggcctcgggcccctgacagttcagtgcngtgatcagcatagatttacactagaaaananagagagagaggagagtagaggtaggttagggttagttagtgtanagtagacgaacgtacgtaaccgaaacccgtaactacgtaccgtaccggaccggacggacgaccgaccgacggaacgtaaacgtaaacgtaaacgtaagtacggtacgtacgaccgacctactactcg

SEQ ID NO: 422573 - DNA, 615 bp, Homo sapiens
  misc_feature: GZ8MTXP02FY4HI.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatcagtggggatattgtgatgactcagtctccactctccctgcccgtcacccgtggagacgccggcctccatctcctgcaggtctagtcagacgcctcagcatactgatgatacaattattggattggtactgacagaacgcgaggcagtcctaccacactcctagattctagtttgggttactaacgtccgggtccgtccggggtcccctaggacgtaggttcaggtggctaggtgatcgagctatagtatttacactaagaaaatcagacgagtaggtaggaggtgtaggtagggttacgggtttagggtttaattacgtgactaagttagaaccgtaaaggtacctaaacccgaaacccgtactaccgtaccgttaccgggaccggaacggggaccaccggtaccgtaagggtaacgtaaaacgttaaaccggaaacgtggttacggacgtacgacctaaccgttacgttcgtcg

SEQ ID NO: 422574 - DNA, 587 bp, Homo sapiens
  misc_feature: GZ8MTXP02IF5GM.15.25.C03.1.454.CMB.2.raw
  modified_base (292)..(292): a, c, t, g, unknown or other
  modified_base (353)..(353): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctcagcatactgatggatacaactatttggattggtacctgcaagaagccagggcagtcncacaactctgatctatttggtctaagtccggctccggggtcccctgactggttcagtggcngtgatcgagcatagtatttacatagaaaatcagacagaggtggaaggctaggacggtaggtttaggggtttattacgttgactagtagacgaaacgtactaaaccgaaaaccccgtagtacgtaacccgttacggaccggaaacggggaccaacggtcccgtaagggtaaacgtaaaacgtttaaaaacggaaacgtggtacggtacgttacggacctaccgtaattctttacg

SEQ ID NO: 422575 - DNA, 610 bp, Homo sapiens
  misc_feature: GZ8MTXP02J1S0W.15.25.C03.1.454.CMB.2.raw
  modified_base (381)..(381): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctccagcatactgatggatacaactatttggattggtacctgcagaagccgagggcagtctccaacaactcctagatcttaagtttggggtttcctaaagttccggggcccctcccgggggtcccccctagaccaggtttcaggtggcnggtgatcgagcatagtaattttacacttagaaaatcagacaggagtggacggcgttaggagggtaggtttagggggtttaatttacgttaggcaagtgacgtaaacggtcctaacgaaaaccccccggatacccgtaacccgtttccgggaccggacggggaccacgcccgttaggaacgtaacgttaaaacgaacttggacggtctacgacctaccctatacctttcg

SEQ ID NO: 422576 - DNA, 648 bp, Homo sapiens
  misc_feature: GZ8MTXP02I8B0L.15.25.C03.1.454.CMB.2.raw
  modified_base (403)..(403): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactcctccctgcccgtcacccctggagacgccggcctccatcctcctgcaggtctagtcagacgcctccagcatactgatggaatactaacttagttggattcggtacctgacaaggaacgccgaagggcagtccctaccaactaacctccgtagtacttccgtttagttttcgggttacctaacggtccggggcccgttccggggtcccctagaccgtaggttcgaggtgacngggtgatcgagctagtagtactttaacgataagaaactcgagtagaaggtaggtagggagtcgtagggtacggttagggtttagggtttatacgtagacgtagttacggaacgtaaacggtaccaaacccgtaacccgtacgtaccgtaccggtaccgggacggacgggacaccggtacgtaaggtaaacgtaaacgttaaaccgtacgtggtacgacgtacgtaccgacgtacgttacgtttcg

SEQ ID NO: 422577 - DNA, 524 bp, Homo sapiens
  misc_feature: GZ8MTXP02IJR1A.15.25.C03.1.454.CMB.2.raw
  modified_base (341)..(341): a, c, t, g, unknown or other
  modified_base (352)..(352): a, c, t, g, unknown or other
  modified_base (396)..(396): a, c, t, g, unknown or other
  modified_base (449)..(449): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgacagaagccgagggcagtctccacaactctgatctatttggtctagtcggcctcggggtcccctgacnggttcagtgcngtgatcgagcatagtatttacactagaaatcagcagagtggagntagaggtagtttagggtttatagtgactatgacgtaggtactaacaaacccgntaccaccgttcggaccgagggacacgccgtaggacgtaaacgttaaacgacgtaagtcgctcgacactactctcg

SEQ ID NO: 422578 - DNA, 587 bp, Homo sapiens
  misc_feature: GZ8MTXP02H2GAH.15.25.C03.1.454.CMB.2.raw
  modified_base (343)..(343): a, c, t, g, unknown or other
  modified_base (354)..(354): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctcagcatactgatggatacaactattggattggtacctgcagaagccgagggcagtcaccacaactcctgatctatttgggtctaagtcggcctccggggtcccctgacnggtcagtggcngtgatcgaggcatagtatttacactagaaatcagactagagtggaagcgtaggaaggtacggtttaggggtttatacgttgactagtacgagtaacgggtactaaaccgaaaccccggtataccgtaacccgttaccgggaccggaaacggggaccaccgtaccggtagggaaacgtaacgtttaaaaccgaacgtttcggacggacgttacggaccaccgtaacttactacg

SEQ ID NO: 422579 - DNA, 591 bp, Homo sapiens
  misc_feature: GZ8MTXP02I8WFN.15.25.C03.1.454.CMB.2.raw
  modified_base (357)..(357): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgacagaagccagggcagtctccacactctgatcttatttggttctaagtccgggcctccggggtcccctgactaggttcagtggcnggtgatcgagcatagtatttacactagaaaatcagcagaggtggaggcgtaggagggtacgggtttaggggtttaattacgtgacgtagtacgacgaacgggttacctaaccgaaaaccccgtattaccgtaccgttccgggaccggtacgggaaccgaccggtaccgttagggaacgtaaacgttaaaaccgtaaacgtggtacggcgtacgcctaaccgtacttacgtttcg

SEQ ID NO: 422580 - DNA, 611 bp, Homo sapiens
  misc_feature: GZ8MTXP02IODXE.15.25.C03.1.454.CMB.2.raw
  modified_base (475)..(475): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtccaccctggagacgccggcctccatcctcctgcaggtctagtcagacgcctcagcatactgatggatacaacttattggattggacctgacagaagccgaggcagtcaccaacactctagattcttagtttcggtactacgtccgggtccgtccccggggtcctaggacgtaggttcaggtgcgtaggtgatcgagctaattagtaactttacaacttagaaactcgagacgaggaggtagggagtcgtagggtaaggggttacgggttttaggggtttaactttacgngtacgtagtacgaacgtaacggtacctaaacccgaaacccgtacgtacccgtaccggtcggaccggaacggaccgacggtacgtaaggtaacgtaacgtaaacgtaagtcggtcgtacgtacgacctacgtctacg

SEQ ID NO: 422581 - DNA, 568 bp, Homo sapiens
  misc_feature: GZ8MTXP02H2EJU.15.25.C03.1.454.CMB.2.raw
  modified_base (350)..(350): a, c, t, g, unknown or other
  modified_base (361)..(361): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagagccggcctccatctcctgcaggtctagtcagacgcctccagcatactgatggatacaactatttggattggtacctgcagaagccgagggcagtctccaacaactcctgatcttagtttgggtactaagtccggcctccggggtccctgacnggtcagtggcngtgatcgagcatagtatttacatagaaatcagcagagtggaggtcgtgagggtacggtttaggggtttattaacgttgactagtgacgtaacggtactaaccgaaacccgtataccgtaccgttccggaccggaacgggaccaacgccgttaggacgtaaacgttaaaacgaacgttggtcggactcggaccaaccgtactacttcg

SEQ ID NO: 422582 - DNA, 522 bp, Homo sapiens
  misc_feature: GZ8MTXP02JPQ03.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagagccggcctccatctcctgcaggtctagtcagagcctccagcatactgatggatacaactatttggattggtacctgcagaagccagggcagtctccacaactcctgatctatttgggttctaagtcgggcctcccggggtccctgacaggttcagtggcagtggatcaggcatagtatttacactagaatcagcagagtggaggcgtgaggtacgttggggtttattacgtgcagtgacgaaggtctaacaaaccccgataccacgttcggcgaggacacgccgtaggacgaactaaacgaacgtaggtcgctcgcaccgatcg

SEQ ID NO: 422583 - DNA, 547 bp, Homo sapiens
  misc_feature: GZ8MTXP02HZIP4.15.25.C03.1.454.CMB.2.raw
  modified_base (355)..(355): a, c, t, g, unknown or other
  modified_base (392)..(392): a, c, t, g, unknown or other
  modified_base (433)..(433): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctccagcatactgatggatacaactattggattggtacctgcagaagccagggcagtctccacaactcctgatctatttgggtctaatcgggcctccggggtccccctgacaggtcagtggcngtggatcgaggcatagattttacactagaaaatcagntagagtggaggctgaggtacgtttggggtttattagttganagtagacgacgtacgtaaccaaccgtactacgtaccgtacggtaccggacggacgacgacgtacggtacgtaacgtaaacgtaacgtaagtcggtacgtcgacgactactctcg

SEQ ID NO: 422584 - DNA, 643 bp, Homo sapiens
  misc_feature: GZ8MTXP02HJ0NK.15.25.C03.1.454.CMB.2.raw
  modified_base (368)..(368): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagagcctccagcatactgatggatacaactattgattggtacctgcagagccgagggcagtctaccacaactcctgacttcttagtttgggttactaacgtccggggccgttccggggtcccctgactggttcaggtggcnggtggatcgagcatagtatttacactagaaatcagacgagaggtaggaggtcgtagggtaagggttacgggtttaggggtttaattacgttagactagtacgacgtaaacgggtacctaaacccgtaaaccccgtacgttacccgtacccgttacccggggaccggtaacggggacccgtaccggtacccggttaagggtaaacgtaaacgttaaaaccggaacgttaacgggttacgggaccttacggaccctaacctacgtttaccgtttccg

SEQ ID NO: 422585 - DNA, 553 bp, Homo sapiens
  misc_feature: GZ8MTXP02HNYEU.15.25.C03.1.454.CMB.2.raw
  modified_base (287)..(287): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggacctgcagagccaggcagtcncacactctgatctatttggtactaagtccggcctccggggtcccctagactaggtcaggtgcagtgatcgaggcagtagtatttacactagaaatcagcagagtggagcgtaggagggtacggtttaggggtttattacgttgacgtagtgacgaaggtacctaaaccgaaaccccgtatacccgtaccgttacgggaccggaagggaccaccgccgtaggaacgtaacttaaaacgacgtgtacgcgtacgaccacctattctcg

SEQ ID NO: 422586 - DNA, 571 bp, Homo sapiens
  misc_feature: GZ8MTXP02IW50M.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaacttatttggattggtacctgcagaagccagggcagtctaccacaactcctgatcttagtttgggttactaagtccgggcctccggggtcccctgactaggttcagtggctaggtgatcgagctagtagtatttacactagaaatcagcagagtggagctaggaggtacggtttggggtttaattacgtgactagtcgacgtaacggtacctaaccgaaaaccccgtatacccgtaccgttaccgggaccggaacgggaccacggaccgtaggacgtaaacgttaacgaacgtggtcgactacgacacctagtcttcg

SEQ ID NO: 422587 - DNA, 585 bp, Homo sapiens
  misc_feature: GZ8MTXP02FNJEG.15.25.C03.1.454.CMB.2.raw
  modified_base (364)..(364): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaacttattggattggtacctgacagaacgccgagggcagtctaccacaactcctgatctagtttgggttctaagtcggccgtccggggtcccctgactaggttcaggtggcngtggatcgagcaagtagtatttaacactaagaaatcagcaaggagtggagcgtaggaggtacggtttaggggtttattacgtgactagtagacgtaaggtacctaaccgaaacccgtataccgtaccgttaccggaccggacggggaaccaccggtaccgtagggtaaacgtaaacgttaaaacgacgttaacgtcggactcggacctaaccattacttcg

SEQ ID NO: 422588 - DNA, 586 bp, Homo sapiens
  misc_feature: GZ8MTXP02FJ6K3.15.25.C03.1.454.CMB.2.raw
  modified_base (355)..(355): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactcctgatctatttgggttctaagtcgggcctcggggtccccctgacaggttcagtgcngtggatcgagcatagtatttacactagaaatcagcgagaggtggaggtctaggaggtacggtttggggtttattacgtgactagtgacgtaaacggtactaaacccgaaacccccggatacccgtaccgttacccgggacccggaacggggacccgaccggacccgttagggaacgtaaacgtaaaaccggtaacgtaacggtcggactacggacctaaccacttcgttcg

SEQ ID NO: 422589 - DNA, 540 bp, Homo sapiens
  misc_feature: GZ8MTXP02JG1J8.15.25.C03.1.454.CMB.2.raw
  modified_base (291)..(291): a, c, t, g, unknown or other
  modified_base (333)..(333): a, c, t, g, unknown or other
  modified_base (343)..(343): a, c, t, g, unknown or other
  modified_base (346)..(346): a, c, t, g, unknown or other
  modified_base (350)..(350): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtcnccacactcctgatctattggtctatcgggcctcggggtcccngacagtcagngcngtgntcgagcatagtatttacatagaaatcagcagaggtggagcgtaggagggtacggtttggggtttatcgtgactagtgacgtaaggtctaaccgaaaccccgattaccgccgttacgggaccggacgggaccacggccgtagggactaacgttaacggaacctggtacggctcggactacgtactcgttcg

SEQ ID NO: 422590 - DNA, 555 bp, Homo sapiens
  misc_feature: GZ8MTXP02HSFT0.15.25.C03.1.454.CMB.2.raw
  modified_base (302)..(302): a, c, t, g, unknown or other
  modified_base (343)..(343): a, c, t, g, unknown or other
  modified_base (353)..(353): a, c, t, g, unknown or other
  modified_base (377)..(377): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactagtttgattggtacctgcagaagccagggcagtctaccacaactcngatcttatttggtctaagtcggccgtccgggtcccctgacngttcagtgcngtgatcgaggcagtagtactttanactagaaaatcagcagagtggagcgtgaggtaggtttggggtttattacgttgctagtgacgtaaggtactaaccgaaacccgtactaccgtaccgttacggaccggagggaccaccggaccgtaggaacgtaagttaaaacccgagtaagtacgacgttcgactaccctattcttcg

SEQ ID NO: 422591 - DNA, 572 bp, Homo sapiens
  misc_feature: GZ8MTXP02HFV98.15.25.C03.1.454.CMB.2.raw
  modified_base (290)..(290): a, c, t, g, unknown or other
  modified_base (362)..(362): a, c, t, g, unknown or other
  modified_base (389)..(389): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgacagagccgaggcagtcnccacaactgctgattctagtttgggtactaagtccgggtcctccccggggtcctgactaggttcaggtgcgngtggatcgaggcatagtatttacatanaaatcagctagagtggagtctaggagggtacggtttaggggttattacgtgactagtcgacgaacggtactaaaccgaacccgtataccgtaccgttaccggaccggtaagggaccacgtaccgtaggaaacgtaacgttaaaaccgaagttcggtacggtctacgaccgtacctagtttccg

SEQ ID NO: 422592 - DNA, 702 bp, Homo sapiens
  misc_feature: GZ8MTXP02JM8ZJ.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagacgcccggcctccatcctcccgcaggtctagtcagacgcctccagcatactgatggaatacaacttattggattggtacctgcaagaacgccgagggcacgtctaccacaactcctagattcttagtttcgggttactaacgtccggggtcccgtccggggtcctacggacgtacggttcaggtcggacgtaagggtcggaacttcgaagggtctaagttaacgttaacttttaacgaacgtaagtaaaaactcgaagacgaaggtaggtgggaggtcgtaggtacggggttacggtttaggggtttattacgtgacgtagtacggtaacgtaacggtacctaaacccgaaacccgtacgttacccgtaacccggttccgggaacccggacgggtaaccgaccgggtacccggtaagggtaaacggttaaacgttaaaaccggtaaccgttagggtaacggtaccgttacggaaccctaaccgtacgttccgttacgtttacccg

SEQ ID NO: 422593 - DNA, 592 bp, Homo sapiens
  misc_feature: GZ8MTXP02HXGVV.15.25.C03.1.454.CMB.2.raw
  modified_base (283)..(283): a, c, t, g, unknown or other
  modified_base (287)..(287): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaatattgattggtacctgcagaagcagggcngtcncacaactctgatctatttgggttactaagtccgggccgtccggggtcccctgacaggttcagtggctggtggatcgagcagtatatttacactagaaatcagcagaggtggagcgtagagggttacggtttggggtttaattaacgtgactagtacgacgtaaggtaccctaaccgaaaccccggtactaaccgtacccgttacggacccgggaagggaccgaaccgtccgtaagggtaacgtaaacgttaaaaccggtaacgtaacggtacggtacgtacggacctaaccgtactttacgttcg

SEQ ID NO: 422594 - DNA, 578 bp, Homo sapiens
  misc_feature: GZ8MTXP02FW6IX.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctccagcatactgatggatacaactattggattggactgcagaagccaggcagtctaccaacaactcctgactctagtttgggttactaaagtccggggaccgtccggggtcccctggacgtaggttcaggtcggactggtgatcgagcatagtatttacatagaaatcagcagagtaggaggtctaggaggtacggtttggggtttattacgtgactagtgacgtaaggtacctaaccgaaacccgactaccgtaaccgttccggaccggacgggaaccaccggaccgtaggaacgtaaacgtaaacgtaacgtggtacgacgtacgacctaacctacttcttcg

SEQ ID NO: 422595 - DNA, 558 bp, Homo sapiens
  misc_feature: GZ8MTXP02H7LM3.15.25.C03.1.454.CMB.2.raw
  modified_base (340)..(340): a, c, t, g, unknown or other
  modified_base (350)..(350): a, c, t, g, unknown or other
tcagtctacgtagccacgaccggtgctcgatttagtagtgtagatttgggtttggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctcacaactctgatctatttgggtctaagtcgggcctcggggtccccctgacngttcagtgcnggtgatcagcatagtatttacatagaaaatcagcagagtggagctagaggtacggtttgggtttatagtgcagtcgacgaaggtactaacgaaaccccgactaccgtaaccgttccggaccggaacgggaccgacggtaccgttagggacgtaaaacgtttaaacgaaaccgttggtacggtacgttacgaccacctactacgtttcg

SEQ ID NO: 422596 - DNA, 548 bp, Homo sapiens
  misc_feature: GZ8MTXP02FSHRZ.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcccgcaggtctagtcagagcctccagcatactgatggatacaactatttgattggtactgcagaagccaggcagtctccacactcctgatctatttggtctaagtcggcctccggggtcctgactagtcagtgcagtgatcaggcatagtatttacactagaaatcagcagagtggagcgtggtaggtacggtttaggggtttatacgtgactagttgacgtaaggtacctaaccaaacccgtacgtacctaaccgtcgggacccggagggaccacggccgtaggacgaaagttaaaacgacgtggtaaggcctagacctacgtactccgtacttcc

SEQ ID NO: 422597 - DNA, 539 bp, Homo sapiens
  misc_feature: GZ8MTXP02FFA3C.15.25.C03.1.454.CMB.2.raw
  modified_base (249)..(249): a, c, t, g, unknown or other
  modified_base (269)..(269): a, c, t, g, unknown or other
  modified_base (275)..(275): a, c, t, g, unknown or other
  modified_base (286)..(286): a, c, t, g, unknown or other
  modified_base (295)..(295): a, c, t, g, unknown or other
  modified_base (378)..(378): a, c, t, g, unknown or other
  modified_base (391)..(391): a, c, t, g, unknown or other
  modified_base (395)..(395): a, c, t, g, unknown or other
  modified_base (402)..(402): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtgggatattgtgatgactcagtactccactcctccctgcccgtcaccccgtggagacgcccggcctccatcctcctgctaggtctagtcagacgcctcagcatcngatgatacatattgatgacngcaganccaggcagtcncacactctnatctagtttcggtacagtccgggtcctcccggggtcctgactaggttcaggttcggcaggtggatcgagtcatagtactttanactagaaatcagnaggngtagggngtagtaggtaggttaggttaggttactgtgacgagtacgacgtaacgtacctaaccgaaccgtcgtaccgtaccgtacggacggacgaccgacgtacgtacgaacgtaacgtaacgcgtcgacgctcacactactcg

SEQ ID NO: 422598 - DNA, 586 bp, Homo sapiens
  misc_feature: GZ8MTXP02JSPA5.15.25.C03.1.454.CMB.2.raw
  modified_base (257)..(257): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagagcctccagcatactgatggatacactnttggattggtacctgacagaagccagggcagtcctccacaactcctgatcttagtttggtctaagtccgggcctccggggtcccctgacgtaggttcaggtggcaggtggatcgaggtctagtagtatttaacactagaaaatcgagcgagaggtaggaggtcgtaggtagggtacgggtttggggtttattacgtgtacgtagtggacgtaacggtacgtaacccgaaacccgtactaccgtaccgttccgggaccggacgggaccaccggtaccgtagggacgtaacgttaaacgacgtaaggtcggacgtcgacactacgtcttcg

SEQ ID NO: 422599 - DNA, 601 bp, Homo sapiens
  misc_feature: GZ8MTXP02H4VKD.15.25.C03.1.454.CMB.2.raw
  modified_base (371)..(371): a, c, t, g, unknown or other
  modified_base (513)..(513): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagacgccggcctccactctcctgcagtctagtcagagcctccagcatactgatggataacaactatttggattggtacctgcagaagccgagggcagtctccacaacgtcctgatcttatttgggttctaaacgtccggggcctccggggtccccctcgacgtaggttcagtggcnggtggatcgaggcataagttattttaacactagtaaaatcgaagcgaggtaggtaggagggtcgtgggaagggtaggggttttagggggtttttataacgttggactatcggtacaaacgggtctaaaccgaaaaccccgtntacgaacccgttccgggacggtacggaccgtacgcccgtagaacggaaactttaaacgaacgtcggtggctacgcaacctctacgtcg

SEQ ID NO: 422600 - DNA, 567 bp, Homo sapiens
  misc_feature: GZ8MTXP02HJFEH.15.25.C03.1.454.CMB.2.raw
  modified_base (360)..(360): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccaggcagtctccacaactcctgatcttagtttggttctaagtccgggccgtccggggtcccctgactaggttcaggtggcnggtggatcgagcaatagtatttacactagaaatcagcagagtggagcgtagaggtacggttgggtttattacgtgctagtcgacgtaaggtacctaaccgaaaccccgtataccgtaccgttaccgggacggacggaccgaccgtaccgtaggaacgtaacgttaaaacgacgttcggtacggtctacggactacgtacttcgttcg

SEQ ID NO: 422601 - DNA, 582 bp, Homo sapiens
  misc_feature: GZ8MTXP02JBSRQ.15.25.C03.1.454.CMB.2.raw
  modified_base (350)..(350): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacactctgatctatttggtctagtcgggcctccggggtcccctgacaggtcagtggcngtggatcgagcatagtatttacactagaaatcagcagagtggaggcgtgaggtacggtttggggtttattacgtgcagttgacgtaaggttacctaaccgaaaccccgataccgtaacccgtttccgggacccggaacggggaccgtaccggacccgtaggggaacgtaaacgttaaaaccggaaacgttcggtacgggtacctacggacctaaccctacgtttcgtttacg

SEQ ID NO: 422602 - DNA, 554 bp, Homo sapiens
  misc_feature: GZ8MTXP02FZDBG.15.25.C03.1.454.CMB.2.raw
  modified_base (230)..(230): a, c, t, g, unknown or other
  modified_base (355)..(355): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagancctcagcatactgatggatacaactattggattggtacctgcagaagccagggcagtctccacaactcctgatctatttgggttctaagtcgggcctccggggtcccctgacaggttcagtggcngtgatcgaggcatagtatttacactagaaaatcagcagagtggagcgtagaggtacggttggggtttaattacgtgcagtgacgtaaggtactaaccgaaaccccgataccaaccgttccggaccgacgggaccacggaccgtacgggaagtaaacgtaaaacgaacgtggtaggacttacggactaccacttcgttcg

SEQ ID NO: 422603 - DNA, 559 bp, Homo sapiens
  misc_feature: GZ8MTXP02HNT3Z.15.25.C03.1.454.CMB.2.raw
  modified_base (358)..(358): a, c, t, g, unknown or other
  modified_base (396)..(396): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactcctgatcttatttgggttctaagtcgggcctccggggtccccctgactggttcagtggcngtggatcgaggcatagtactttacactagaaaatcagnagagtggaggcgtggaggtacggttggggtttattacgttgcagtgacgtaagggtactaaccgaaaccccgatacccgtaccgttcgggaccggaacgggaccaccgccgtaggacgtaacttaaaacggacgtggtacggcgtacgacacctatacgttcg

SEQ ID NO: 422604 - DNA, 564 bp, Homo sapiens
  misc_feature: GZ8MTXP02IPX6M.15.25.C03.1.454.CMB.2.raw
  modified_base (257)..(257): a, c, t, g, unknown or other
  modified_base (361)..(361): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactntttggattggtacctgcagaagccagggcagtctccacaactcctgactctatttgggtctaagtccgggcctccggggtcccctgacgtaggttcagtcggcngtggactcgagctagtagtactttacactagaaactcgagagagagtaggtagtcgtagaggtacggtttaggggtttacttacgtgtctagttagacgtaacggtactaaccgaaacccgtagtacctaccgttcggacgacggacacggtacctaggacgtaactaacgaacgtggtacgcgtcgacctactactcgttcg

SEQ ID NO: 422605 - DNA, 626 bp, Homo sapiens
  misc_feature: GZ8MTXP02HMMDK.15.25.C03.1.454.CMB.2.raw
  modified_base (555)..(555): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtggggatattgtgatgactcagtctccactcctccctgcccgtcacccctggagacgccggcctccatcctcccgcaggtctagtcagacgccctccagcatactgatggatacaacttagttggattggtacctgacaagaacgccgaggcagtcctaccacaaccgtcagtattcgttagtttcggggttactaacggtccggggtcccgtccggggtcctcggacgtagggttcaggtggctaggtgatcgaggctaattagtaattttacaacttaagaaaactcgagacgagaggtggaggcgtagggtagggtacgggtttaggggttattacgtgtcaagtcgtacgaacggtacctaaaccgaaacccccgtatacccgtaccgtcgggaccggacgggaccnccggtaccgtagggaaacgtaaacgtaaacgtacgttcggtcgactacgacctactacgttcttacgttcc

SEQ ID NO: 422606 - DNA, 559 bp, Homo sapiens
  misc_feature: GZ8MTXP02F8OHE.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcaccctggagagccggcctccatctcctgcaggtctagtcagagcctccagcatactgatggatacaactattggattggtacctgcagaagccagggcagtctcacaactcctgatctatttgggtctaagtcgggcctcccggggtccctgacaggttcagtggcagtggatcgaggcatagtatttacactagaaatcagcagagtggagctgaggtacggttggggtttattacgtgactatacgacgtaaggtacctaaaccgaaaccccgtataccgtaacccgttaccggacccggagggaccaaccggaccctagggaaacgtaacgttaaaacgaacgttggtggactcggaccacctaatccg

SEQ ID NO: 422607 - DNA, 589 bp, Homo sapiens
  misc_feature: GZ8MTXP02I9D8D.15.25.C03.1.454.CMB.2.raw
  modified_base (381)..(381): a, c, t, g, unknown or other
  modified_base (425)..(425): a, c, t, g, unknown or other
  modified_base (436)..(436): a, c, t, g, unknown or other
  modified_base (519)..(519): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtccaccccgtggacgacgcccggcctccatcctcctgcaggtctagtcagacgcctccagcatactgatagaactactaacttgtttaggattcggtacctgacaggaacgccgaggcagtccaccaacctactcctagtattcttagtttcggtactaacggtccggtaccgtccgggtcccctgaccgtggtcnggtgcaggtcgatacgagtactagtagttactttaacacgtaanaaactcgaganaggtaggtggaaggtgtaggtagggttaggtttagggtttaatacgtgactagtacgacgtaacgtaccaaaccgaacccgtntaccgaccgtcgacggacggacacgacgtaggacgtaaacttaacgagtgtacgctacgacactctctac

SEQ ID NO: 422608 - DNA, 550 bp, Homo sapiens
  misc_feature: GZ8MTXP02H0T63.15.25.C03.1.454.CMB.2.raw
  modified_base (355)..(355): a, c, t, g, unknown or other
  modified_base (394)..(394): a, c, t, g, unknown or other
  modified_base (404)..(404): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctcacaactcctgatctatttggtctaagtcggggcctccggggtcccctgaccaggttcagtggcngtggatcgaggcatagtattttacactagaaaatcaganagagtggagngtgaggtaggttagggtttagttagtgtgtagtagacgaacgtacgtaaccgaaacccgactactaccgtaccggacggacggacgacgacgtacggacgtaacgtaaacgtaacgtaacgtacggacgtcgacgactactactcg

SEQ ID NO: 422609 - DNA, 718 bp, Homo sapiens
  misc_feature: GZ8MTXP02FW5GM.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcaccccgtggagacgccggcctccatcctcccgcaggtctagtcagacgcctccagcatactgatggatacaatattggattggtacctgacagaacgccgagggcagtctccacaactcctagattcgttagttttcggggtacttaaacggtccggggtcccgttccgggggtcccctaggtaccgtaggtttcaggttggacgtaggtggaactcgagggtactaagttaagtactttttaacaacttaagaaaactcgaagacgtaaggtaggtaggggaaggtcggttagggtaaacggggttacgggttttagggggttttaattaacgtcggtactagttacgggacgtaaacgggttacctaaaccgaaaccccggtacttacccgtaacccggttaccggggacccggtaaacggggacccgtaaccgggtaccggttaagggaaacgttaaaaccgttaaaaacggaaccgttagggtcggtaccgtacggaccctaaccgtaacgttaccgtacggtttacc

SEQ ID NO: 422610 - DNA, 545 bp, Homo sapiens
  misc_feature: GZ8MTXP02FH9NF.15.25.C03.1.454.CMB.2.raw
  modified_base (343)..(343): a, c, t, g, unknown or other
  modified_base (352)..(352): a, c, t, g, unknown or other
  modified_base (398)..(398): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctccagcatactgatggatacaacttattggattggtacctgcagaagcagggcagtctccacactcctgatctattgggttctaagtcggccgtccggggtcccctgacngtcagtgcngtgatcgagcatagtatttacactagaaatcagcagagtggacggngtaggaggtacggttagggtttattacgtgacagtagacgaacggtactaaaccaaaccccgataccgtaccgttccggaccggaacgggaccaccgccgtaggaacgtaacgtaaacgaacgtgtggctcgaccactactcttacg

SEQ ID NO: 422611 - DNA, 532 bp, Homo sapiens
  misc_feature: GZ8MTXP02GSUJ4.15.25.C03.1.454.CMB.2.raw
  modified_base (354)..(354): a, c, t, g, unknown or other
  modified_base (403)..(403): a, c, t, g, unknown or other
  modified_base (433)..(433): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggtctaatcgggctccggggtcccctgacaggttcagtggcngtggatcgaggcatagatttactactagaaatacagcagagtaggaggngtagaggtaggttagggtttagttagtganagtagacgacgtactaacgaaccgactactacgtacgacgacggacgacgacgacgacgaacgtaaacgtaacgtaagtgcgtacgacactactactcg

SEQ ID NO: 422612 - DNA, 544 bp, Homo sapiens
  misc_feature: GZ8MTXP02G6SR1.15.25.C03.1.454.CMB.2.raw
  modified_base (342)..(342): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctcacactctgatctattggtctagtcggcctcgggcccctgacagtcagtgcngtgatcagcatagtatttacactagaaatcagcagagtggagcgtaggagggtacggtttgggggtttattacgtagctagttgacgtaaggtactaaccgaaacccgtataccgaccgttccggaccggacgggaccaccggaccgtaggacgtaaacgttaaacgaaacgtggtaggctacggaccaactactacgttcg

SEQ ID NO: 422613 - DNA, 614 bp, Homo sapiens
  misc_feature: GZ8MTXP02F2G07.15.25.C03.1.454.CMB.2.raw
  modified_base (295)..(295): a, c, t, g, unknown or other
  modified_base (300)..(300): a, c, t, g, unknown or other
  modified_base (357)..(357): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagacgcctccagcatactgatggatacaattattggattggtacctgcagaagccaggcagtctccanactcngatctagttggtactaagtccgggtccgtccggggtcccctgactaggtctagtgcngtggatcgagcagtagtatttacatagaaatcagacagagtaggaaggtcgtaggtagggttacggtttagggggtttaacttacgtggtactagtacggaccgtaacgggttaacctaaaccgtaaaaccccggtacttaacccgtacccggttaccgggacccgggaacgggtaaccaccggtaccgtaagggaaacgttaaacgttaaaacggaaacgttcggtacggtctacggacctacctacgtcctttcg

SEQ ID NO: 422614 - DNA, 599 bp, Homo sapiens
  misc_feature: GZ8MTXP02FWACC.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctccagcatactgatggatacaacttattggattggtacctgcagaagccgagggcagtctccacaactcctgatctagtttgggttctaagtcgggccgtccggggtcccctgactaggttcaggtggcaggtggatcaggcattagtatttacactagaaaatcagcaggagtggaggctaggaggtacggtttggggtttaattacgtgactagtgacgtaacggtacctaaacccgaaaaccccgatacccgtacccgttaccgggacccggaacggggaaccgaccggaccgttagggaaacgtaaacgtttaaaaccggaaacgttgggtacgggacttacggaccaacctacgtctttcg

SEQ ID NO: 422615 - DNA, 565 bp, Homo sapiens
  misc_feature: GZ8MTXP02FXQOU.15.25.C03.1.454.CMB.2.raw
  modified_base (289)..(289): a, c, t, g, unknown or other
  modified_base (357)..(357): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaatattggattggtacctgcagaagccagggcagtcnccacaactcctgatctatttgggttctaagtcgggcctccggggtccccctgacgaggttcagtggcnggtcggatcgaggcagttagtatttacactagaaatcagcagagtggagctaggaggtacggttgggtttagttagtgtacgtagtagacgtaggtactaaccgaaacccgtaacgtactaccgtacggtaccggacggaacgaccgacgtcggtaacgtaacgtaaacgtaaacgtaacgtacggcgtacgaccactactactttcg

SEQ ID NO: 422616 - DNA, 530 bp, Homo sapiens
  misc_feature: GZ8MTXP02GQWCZ.15.25.C03.1.454.CMB.2.raw
  modified_base (353)..(353): a, c, t, g, unknown or other
  modified_base (400)..(400): a, c, t, g, unknown or other
  modified_base (426)..(426): a, c, t, g, unknown or other
  modified_base (457)..(457): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactctgatcttattggtactaagtcggcctcggggtcccctgactaggttcagtggcnggtgatcgagcaatagtatttacatagaaaatcagcagagtggaggngtagaggtaggtttaggttatagtgntagagacgtaacggtacctaaccgaaacccntaccgaccgtcggacggaggacacgtcgagaacgtaaacgtaaacgacgtggacgctacgaccactactctcg

SEQ ID NO: 422617 - DNA, 605 bp, Homo sapiens
  misc_feature: GZ8MTXP02HAV9Y.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatcctcctgcaggtctagtcagagcctccagcatactgatggatacaactatttggattggtacctgcagaagccgagggcagtcctaccacaactcctgacttctagtttgggttactaagtccgggccgtccggggtccccctgactaggttcaggtggcaggtgatcgagcagtagtatttacactagaaatcagacagagtggagactaggagggtaggtttaggggtttaattacgttgacgtagtacgtacgtaacggttacctaaaccgaaaaccccggtatacccgtaccggttaccgggaccggtacggggaaccaccggaccgttaagggacgtaaacgttaaaaccggaacgtggttacggactacggaccacctagttacttccgg

SEQ ID NO: 422618 - DNA, 685 bp, Homo sapiens
  misc_feature: GZ8MTXP02H9ML0.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcaccctggagacgcccggcctccatcctcctgcaggtctagtcagacgcctccagcatactgagtaggaataccaattagtttggattcggtacctgacaagaacgccgagggcacgtcctaccaactaactcctagtattctttagtttcggttactaacggtccgggtcccgtccggggtcccctaggacgtacggttcgaggtcggacgtaggtcgggatccggaggtactaagttaagttaactttaaccaagtaaaggtaaaactccgaagacgtaaggaggtagggtaggcggttaggtaaggggttacgggttttaggggtttacttacgtgactaggtcgtaaacgtacggtaaccctaaaacccgtaaaccccggacttacccggtaccgttaccgggaccggaacgggacccaccggtaccggtaaggaaacgtaaaacgtttaaaccggagtcggtcggtactaccggaccaaccttacgttcgttccg

SEQ ID NO: 422619 - DNA, 548 bp, Homo sapiens
  misc_feature: GZ8MTXP02GJ7MM.15.25.C03.1.454.CMB.2.raw
  modified_base (359)..(359): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctcagcatactgatggatacaactattggattggtacctgcagaagccagggcagtctccacaactcctgatcttatttgggttactaagtcgggccttccggggcccctgactaggttcagtggcnggtggatcgagcatagtatttacactagaaatcagcagagtggaggcgtagaggtacggtttggggtttattacgtgacagtgacgtaaggtactaaccgaaaccccgataccgaccgttcggaccggacgggacacgccgtaggacgaacgttaaacgactaaggtcggactcggacacctagtcgtg

SEQ ID NO: 422620 - DNA, 705 bp, Homo sapiens
  misc_feature: GZ8MTXP02GLSXO.15.25.C03.1.454.CMB.2.raw
tcagtctacgtagccacgaccggtgctcgatttagtagtgtagatttgggtttgggggatcgggactcctcagttcaccttctcacaatgaggctccctgctcagctcctggggctgctaatgctctgggtctctggatccagtggggatattgtgatgactcagtctccactctccctgccccgtacacccctaccggaggacgccggcccgtccctactcttcctcgtcgacggtacgtacgtacgtacgaggcctcccacgacactactagagtggagtaactaactaactttggtagttaggttaccgttacgcacgaagaccacgggacgacgtccgtcctaccaactacctcgtatcttatttagggtttcgttaataccgggtcccggtccgggtcccggtccgtacgacgttcgtacgttggtcgagtgggtagtacacggcatagtattttactactagtaaatacagtacgagaggtagggtaggacgttagagggtaacggtttgggggtttaagtttaacttcggtgaacgtggtacgaacggttacgttacccgaaaacccccgaacgttcgtaccccttacggggcccgaaacgggggcccaacggtccccgttaggggacgtaaaacgtttaaaaccgtaaacggtggttaacggggctaccgacgaccccaatttacgttcggtttacc

SEQ ID NO: 422621 - DNA, 579 bp, Homo sapiens
  misc_feature: GZ8MTXP02IS8ZE.15.25.C03.1.454.CMB.2.raw
  modified_base (364)..(364): a, c, t, g, unknown or other
  modified_base (481)..(481): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtcctaccacaacctctgattcttatttgggttctaagtccgggccgtccggggtcccctgactggttcaggtggcnggtgatcgaggcatagtatttacatagaaatcagacgagagtggaggtcgtaggagggttacggtttaggggtttattacgtgactagtgacgtaacggtactaaccgaaacccgtntaccgacccgttacgggaccggacgggacgtaccgccgtacgggaacgtaaacgttaaacgaacgttggtacggcgttacgacacctagttacgttcg

SEQ ID NO: 422622 - DNA, 582 bp, Homo sapiens
  misc_feature: GZ8MTXP02GEWAO.15.25.C03.1.454.CMB.2.raw
  modified_base (291)..(291): a, c, t, g, unknown or other
  modified_base (363)..(363): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagccctcagcatactgatggatacaactattggattggtacctgcagaagccgagggcagtcnccacaactctgatcttagtttgggtactaagtccgggccgtccggggtcccctgactaggttcaggtcggcnggtgactcgaggctatagtatttacatagaaatcaagcagaggtggaggtcgtagggagggttacggtttagggggtttattacgtgactagtacgacgtaacggtacctaaccgaaacccgtataccgtaccggttacggaccggaacgggaccaccggtaccgtaggaacgtaacgttaaaacgaacgtggtacggcgtacgaccactactacgtcg

SEQ ID NO: 422623 - DNA, 558 bp, Homo sapiens
  misc_feature: GZ8MTXP02HV6NJ.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatcctcccgcaggtctagtcagagcctccagcatactgatggatacaactattggattggacctgcagaagccaggcagtctccacaactcctgatctagtttgggttctaagtcgggcctccggggtcctgactaggttcaggtggcagtggatcgaggcatagtattttacactagaaaatcagcagagtggaggcgtggaggtacggtttaggggtttattacgtgctatgacgtaaggtctaaaccgaaacccgactacctaccgttcggaccgacgggaccacgccgtaggaacgtaacgttaaacgaacgtggtaacggcgtacgacacctactcttcgttacc

SEQ ID NO: 422624 - DNA, 520 bp, Homo sapiens
  misc_feature: GZ8MTXP02G3R55.15.25.C03.1.454.CMB.2.raw
  modified_base (349)..(349): a, c, t, g, unknown or other
tcagtctacgtagccacgaccggtgctcgatttagtagtgtagatttgggtttgggggatcagggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacactattggattggtacctgcagaagccagggcagtctccacactctgatctatttgggtctaagtcgggcctcggggtcccctgacagtcagtgcngtgatcagcatagatttacactagaaatcagcagagtggagctgaggtacgttgggttatacgtgcagtgacgtaaggtctaacgaacccgtataccgacgttcggacgacgggacaaccgtccgtaggacgaacgttaaacgaacgtgtacgctacgcacctatcgttcg

SEQ ID NO: 422625 - DNA, 644 bp, Homo sapiens
  misc_feature: GZ8MTXP02IJ0EU.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatcctcccgcaggtctagtcagagcctccagcatactgatggatacaatattggattggtacctgacaagaagccgagggcagtcctccacaactctgatcttagtttgggtctaacgtccgggtcctccggggtcctggactagttcagtggacagtgatcgagctagtagtacttttacactagaaatcagcagagtggagacgtggaggtacggtttaggggtttaattacgtagtacgtagtacggtaacgtaacggttaaccgtaaaccgtaaaccccgtaacttaccgtacccgttaccgggacccggtaacgggaaccgtaacccggtacgttaaacgggaaacgtaaaacgtttaaaaccggtaaacgttacggtaacggtacgttaaccggaccgtaaacccttacgttaccgtttacgtttaacccg

SEQ ID NO: 422626 - DNA, 642 bp, Homo sapiens
  misc_feature: GZ8MTXP02FZ7PM.15.25.C03.1.454.CMB.2.raw
  modified_base (424)..(424): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctccagcatactgatggatacaacttattggattggtacctgcaagaacgccgagggcagtcctaccacaacctcctgattcttagtttcgggttactaaacgtccggggtcccgttccggggtccccctgaccgtaggttcaggtggcaggtggatcgaggctaagtagtatttacactagaaatcgaganaggagtaggaggcgtaggagggttacgggtttgggtttaaggttacgtgtacgtagtacgacgtaacggtacctaaacccgtaaaccccgtacgtacccgtaacccggttccgggaaccgggacgggaccgaccggtaccggtaacgggtaaacgtaaacgttaaaaccggtaaacgtcggtacggtaccgttacgaccgtaccgtacttacgtttcg

SEQ ID NO: 422627 - DNA, 510 bp, Homo sapiens
  misc_feature: GZ8MTXP02F3KSV.15.25.C03.1.454.CMB.2.raw
  modified_base (357)..(357): a, c, t, g, unknown or other
  modified_base (453)..(453): a, c, t, g, unknown or other
  modified_base (478)..(478): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccccctgacaggttcagtggcngtggatcagcatagattttacactagaaaatcagcagagtggaggctgaggtacggttggggtttattactgcatgcaaggtctaacaaaccccgntcaccttcggccgagggacacgccnggacgactaaacgaactgtgctgcacatctcg

SEQ ID NO: 422628 - DNA, 618 bp, Homo sapiens
  misc_feature: GZ8MTXP02IQXWW.15.25.C03.1.454.CMB.2.raw
  modified_base (279)..(279): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaanccagggcagtctccacactctgatctatttggtctaagtcggcctccggggtcccctgactaggttcagtggcaggtgatcgagcagtaagtatttaacacttagaaaatcaagtcgagagtagggaggtacgtaggaagggttacggtttaggggtttaattacgttgacgtagtacgacgtaacggtacctaaaccgaaaccccgtatacccgtaacccgttccgggaccggaacggggaccaacccggtaccggtaggtaaacgtaaaacgtttaaaaccggaaccgttgggttacggaccgttacggacccgtaaccctaggtttacctttaccg

SEQ ID NO: 422629 - DNA, 633 bp, Homo sapiens
  misc_feature: GZ8MTXP02JPWE6.15.25.C03.1.454.CMB.2.raw
  modified_base (305)..(305): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactagttggattggtacctgcagaagccagggcagtctaccactaactcctnatcttagtttggtactaagtccgggcctccggggtcccctgaccgtaggttcaggtcggactagggtggactcgaggctaagtagttaactttaacactaagtaaaatcgaagcgagaggtagggacggacgttagggaacgggttacgggtttagggggtttaacttacggtaggactaggttacgacgtaaacggttacccgtaaacccgaaacccccgtagtacccgtaaacccgttccgggaacccggacgggtaccacggtccgtaaggtaacgtaaacgttaaaacggacgtggtacggctaccggacaccgtactcgttcg

SEQ ID NO: 422630 - DNA, 601 bp, Homo sapiens
  misc_feature: GZ8MTXP02GT1GK.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagcccggcctccatctcctgcaggtctagtcagagcctccagcatactgatggatacaacttattggattggtacctgcagaacgccgagggcagtctaccacaactcctgatctagtttgggttactaagtccggggcccgtccggggtccccctgacgtaggttcaggtcggcaggtggatcgaggcagtagtatttacactagaaatcagcagagtggagtcgagtagggtacggtttggggtttaattacgtgacgtagtacgtacgtaaacggttacaaacccgaaaccccgtactaccgtaccgttaccggacccggacgggaaccaccggtccgtagggaacgtaacgttaaaacggaaccgttggtacgacgtacggaccacccgtattacgtttcg

SEQ ID NO: 422631 - DNA, 590 bp, Homo sapiens
  misc_feature: GZ8MTXP02I236V.15.25.C03.1.454.CMB.2.raw
  modified_base (361)..(361): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaatattggattggacctgcagaagccagggcagtctccaacactctgatctagtttggttctaagtccggggccttccggggtccccctgacgtaggttcaggtcggcnggtggatcgaggctatagtactttacacttagaaatcagcgagaggtgggagcgtaggaggttacgggtttggggtttacttacgtgacgtagtaggacgtaaggtacctaaaccgtaaaccccgtatacccgtaccgttcggaccggacgggaccacggaccgtaggaacgtaaacgttaaaccgaacgttcggtacggtacgtacggacctaacctactacgtttcg

SEQ ID NO: 422632 - DNA, 602 bp, Homo sapiens
  misc_feature: GZ8MTXP02HNSHV.15.25.C03.1.454.CMB.2.raw
  modified_base (356)..(356): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctccagcatactgatggatacaactattgattggtacctgcagaagccagggcagtctccacaactcctgatcttagtttggtactaagtccgggcctccggggtcccctgactggtcagtgcngtgatcgagcatagtatttacatagaaaatcagacagagtggaggcgtaggaagggtacggtttagggggtttaattacgttgcgtaagtgacgtaaacggtacctaaaccgaaaccccgtagttacccgtaacccggttcccgggaccggaacgggtaccgaccggtaccgttaaggtaacgtaaaacgttaaaacggaaacgttggtacggtaccgtacggacctaaccgtaactttcgttacg

SEQ ID NO: 422633 - DNA, 624 bp, Homo sapiens
  misc_feature: GZ8MTXP02IO3Q2.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtccacccctggagacgccggcctccatcctcctgcaggtctagtcagacgcctccagcatactgatggaatacaatattggattggacctgacagagccgaggcagtccaccactaacctctgattcttagtttggttactaacgtcgggcccgtccggggtcccctgacgtaggttcaggtggctagggtggtaatccgaggtactagtaaacgttactttaacaactaaagtaaaatcgagacgtaaaggtaggtagggagcgtagggtaacgggtacggttttaggggtttacttacgtgactagtgacgtaaacggtacctaaaccgaaacccgtatacccgtacgttaccggacggtacgggaccaccgtaccgtaggtaacgtaaacgttaaacgaacttggtacgacgttacgacaaccttactacgttacg

SEQ ID NO: 422634 - DNA, 601 bp, Homo sapiens
  misc_feature: GZ8MTXP02IONBD.15.25.C03.1.454.CMB.2.raw
  modified_base (349)..(349): a, c, t, g, unknown or other
  modified_base (361)..(361): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgacagaagccagggcagtcaccacaactcctgatctagtttgggttactaagtcgggccgtccggggtcccctgacnggttcagtggcngtggatcgagcagtagtactttacactagaaatcagcgagagtggaggcgtaggagggtacggtttggggtttaattacgtgactagtgacgtaaacggttacctaaaccgaaaccccgtactacccgtaacccgttcgggacccggacgggaaccgacggtacccgtaggaacgtaaacgttaaaaccggtaacgttaacggtcggtaccttacggaccaaccgtacgttaccgttccg

SEQ ID NO: 422635 - DNA, 586 bp, Homo sapiens
  misc_feature: GZ8MTXP02GF66T.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagacggcctccatcctcccgcaggtctagtcagacgcctccagcatactgatggatacaactattggattggtacctgcagaacgccgaggcagtctccacactctgatctagtttgtcgggggtaatccgggccgtccggggtcctcgacgtagttcaggtggcagtggatcgaggactatagtattttacaactagaaatcagacagagtgggagcgtaggagggtacggttaggggtttattacgtgactagtagacgtaacggtacctaaccgaaacccgtactaccgtaaccgttcgggaccggacgggaccgacggtaccgtaggaacgtaacgttaaaacgacgtggtaacggtacgtacgacctaccgtactcgtacgttcc

SEQ ID NO: 422636 - DNA, 602 bp, Homo sapiens
  misc_feature: GZ8MTXP02HR2PX.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagagccggcctccatctcctgcaggtctagtcagagcctccagcatactgatggatacaactattggattggtacctgcagaagccagggcagtctccacaactcctgatctatttggtctaagtcgggcctccccggggtcctgacaggttcaggttggcagtggatcgaggcatagtatttacactagaaatcagcagagtggaggctaggaggtacggtttggggtttattacgtgacagtgacgaacgggtactaaaccgaaaccccgtacgtaccgtaaacccggtttccgggacccggtaaacggggaacccacccgggtaccggttacgggaaacgtaaacgtttaaaacccggaaacgttacggttacgggccttacggacccaaccgtaactttcccg

SEQ ID NO: 422637 - DNA, 598 bp, Homo sapiens
  misc_feature: GZ8MTXP02JH7IJ.15.25.C03.1.454.CMB.2.raw
  modified_base (360)..(360): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccgagggcagtctaccacaactcctgatcttagtttggttactagtcgggcctccggggtcccctgactagttcagtggcngtgatcgagcatagtatttaacactagaaaactcgagtcgagaggtgggaagtcgtagggaaggttacgggtttgggggtttaattacgtgtactagtggaaccgtaaggttaccctaaacccgaaaccccgtatacccgtaacccgttccgggaccggacgggaccaccggtccgtagggaacgtaacgttaaaaccggaacgttggtcgtacgtacgaccaccctatccgtttacg

SEQ ID NO: 422638 - DNA, 566 bp, Homo sapiens
  misc_feature: GZ8MTXP02JVE6O.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacactcctgatctatttggtctaagtcgggcctccccggggtcctgacaggttcagtgcagtggatcgagcatagatttacatagaaatcagcagagtggagctggaggtacggtttaggggtttattacgtgactagtgacgtaagggtctaaccgaaaccccgtatacccgaacccggttccgggacccggacggggaccacgtcccgtagggtaacgtaacgttaaaaccgaacgttcggtacggcctaggacctaccgtacgtttccg

SEQ ID NO: 422639 - DNA, 579 bp, Homo sapiens
  misc_feature: GZ8MTXP02ISAVA.15.25.C03.1.454.CMB.2.raw
  modified_base (254)..(254): a, c, t, g, unknown or other
  modified_base (524)..(524): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatgatacatnttgattgactgcagagccaggcagtctccacaactcctgatctagtttggtactaagtccgggcctccggggtcccctgactcggtacaggtcgctgggtgactcgagtactaagttacgttaactttaacgactaagtaaactcgagtacgaggtaggtagggaggtcgtagggtagggttaggggttttagggtttaactacggtacgtactagtacgacgtacgtaccgtaaccaaaccgtctaccgtaccgtacggacgacggacncgtacgtagacgtaaaacgtaacgtaagtggtcgacgtacgactactactcttcg

SEQ ID NO: 422640 - DNA, 568 bp, Homo sapiens
  misc_feature: GZ8MTXP02G96X8.15.25.C03.1.454.CMB.2.raw
  modified_base (342)..(342): a, c, t, g, unknown or other
  modified_base (347)..(347): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatcctcccgcaggtctagtcagagcctcagcatactgatggatacaactattggattggtacctgacagaagccgagggcagtcctccacaactcctgatctatttgggtctaagtccgggtcctccggggtccnggacnggttcagtggcagtggatcgaggcagttagtacttttacactagaaaatcagcagaggtggaggtcgtagggtaggtacggtttaggggtttattacgtggtacagttcgacgtaacggtactaaaccgaacccgactccgtaccgttccgggaccgacgggacacggaccgtaggaacgtaacgtaaacgaacgtgtgcgtacgcactactctcgtttcg

SEQ ID NO: 422641 - DNA, 578 bp, Homo sapiens
  misc_feature: GZ8MTXP02F1R9B.15.25.C03.1.454.CMB.2.raw
  modified_base (286)..(286): a, c, t, g, unknown or other
  modified_base (407)..(407): a, c, t, g, unknown or other
  modified_base (418)..(418): a, c, t, g, unknown or other
  modified_base (447)..(447): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatcctcccgcaggtctagtcagacgcctccagcatactgatggaatacaatagtttggattggtacctgcaaggaacnccgagggcagtcctaccacaactcctagattctagtttcggtctaagtccgggcctccggggtcctgactaggttcaggtcggctaggtgatcgaggcatagtatttacatagaaatcagnagagtggaggntaggaggtacggtttaggggttatagtgnagtgacgacgtacaacgaacccgtactacgtaccgtcggaccggaacggaccgaccgaccgtagggaacgtaaacgttaaaacgacgttagaacggtcgtacgtaccaccgtacttccgttacggtttacc

SEQ ID NO: 422642 - DNA, 558 bp, Homo sapiens
  misc_feature: GZ8MTXP02GG2J4.15.25.C03.1.454.CMB.2.raw
  modified_base (258)..(258): a, c, t, g, unknown or other
  modified_base (348)..(348): a, c, t, g, unknown or other
  modified_base (393)..(393): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctccagcatactgatggatacaactnttggattggtacctgcagaagccagggcagtctccacaactctgatctatttggtctaagtcggcctcgggtcccctgactgtcagtgcngtgatcgagcatagtatttacatagaaatcagcgagagtggacgngtaggaggtacggtttaggggtttattacgtgactagtcgacgtaacggtacctaaaccgaaaccccgtagtacccgtaaccgttccgggaccgaacgggaccgacgtacccgtaggacgtaaagtaaaccgaacgtggtacggactcgacctactactcgttcg

SEQ ID NO: 422643 - DNA, 596 bp, Homo sapiens
  misc_feature: GZ8MTXP02HMFOS.15.25.C03.1.454.CMB.2.raw
  modified_base (371)..(371): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagagcctccagcatactgatggatacaactattggattggtacctgcagaacgccgagggcagtcctccaacaactcctgattcttagtttgggttactaagtccggggtccctccggggtccccctgactaggttcagtggcngtggatcgagcagtagtatttacactagaaaatcagcagaggtaggaggcgtaggaggtacggtttggggtttaattacgtgacagtgacgtaacggtactaaaccgaaaccccgataccgtaacccgttcggaccggaacgggacctaaccggaccgttagggaacgtaacgtttaaaaccggaaccgtggtacggacgtacgaccgaccctaagttcctttcg

SEQ ID NO: 422644 - DNA, 634 bp, Homo sapiens
  misc_feature: GZ8MTXP02IQUBA.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccaggtggggatattgtgatgactcagtatccactctccctgcccgtcacccgtggagacgccgcctccatctcctgcaggtctagtcagacgcctcagcatactgatggatactaacttagttggattcggtacctgacgagaacgccgaggctagtcctaccaactactctagtacttcgttagtttcgggtactacggtccggggtacccgttccccggggtcctagacgtaggttcgaggttggcgtaggttggactcgaggtctaaagttacgttaactttacaacgttagaaatcgaagacgaggtaggtagggagtcgtagggtagggttacggtttagggtttaattacgtggactagtacgacgtacgtaacctaaccgaacccgtataccgtaccgtacgggacgacgggtaccacggtaccgtagggtaaacgtaaacgtaaacggtaacgttcggacggtctacgtaccaccgtactttccg

SEQ ID NO: 422645 - DNA, 534 bp, Homo sapiens
  misc_feature: GZ8MTXP02JSLGE.15.25.C03.1.454.CMB.2.raw
  modified_base (354)..(354): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctccagcatactgatggatacaactatttggattggtacctgcagaagccaggcagtctcacactctgatctattgggtctaagtccgggcctccggggtccccctgactaggttcagtgcngtggatcgagcatagtatttacactagaaatcagcagagtggaggcgtagaggtacggtttggggtttatacgtgacagttgacgtaacggtcctaaaccgaaacccgataccgaccgttccggacggacggacacgaccgaggacgaacttaaccgagtgcggctcgaccacactctcg

SEQ ID NO: 422646 - DNA, 589 bp, Homo sapiens
  misc_feature: GZ8MTXP02HYSNQ.15.25.C03.1.454.CMB.2.raw
  modified_base (290)..(290): a, c, t, g, unknown or other
  modified_base (338)..(338): a, c, t, g, unknown or other
  modified_base (348)..(348): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtcncacactctgatctatttggtctagtccgggcctccggggtccctgacnggtcagtgcnggtgatcgagcatagtatttacactagaaaatcagcagagtggagcgtagaggtacggtttaggggtttattacgttgactagtacggacgaaacggtacctaaaccgaaaaccccgtagtaacccgtaacccgtttccggggacccggaacggggaacccgaccggcccgttagggaacgtaaacgttaaaaccggtaaacgtggttacggcttacggacctaaccgtactttactttcg

SEQ ID NO: 422647 - DNA, 597 bp, Homo sapiens
  misc_feature: GZ8MTXP02HY50N.15.25.C03.1.454.CMB.2.raw
  modified_base (269)..(269): a, c, t, g, unknown or other
  modified_base (276)..(276): a, c, t, g, unknown or other
  modified_base (287)..(287): a, c, t, g, unknown or other
  modified_base (296)..(296): a, c, t, g, unknown or other
  modified_base (346)..(346): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcaccctggagagccggcctccatctcctgcaggtctagtcagagcctccagcatactgatggatacaatattggattggtacngcagaancgaggcagtcnccacactcngatctatttggtctagtccgggcctccgggcccctgactaggtcagtgcngtgatcgagcatagtactttacactagaaaatcagcagaggtggaggctaggagggtacggtttaggggtttaatcgtgctagtcgacgtaacggtacctaaaccgaaacccgtagtaccgtaacccggttaccggggacccgtaagggggtaaccctaaaccggcccggtaaaggtaaacgtaaaacgtttaaaaccggtaacgtcggttacgggaccttcggacctaaacccgtttcgtttaccgtacg

SEQ ID NO: 422648 - DNA, 627 bp, Homo sapiens
  misc_feature: GZ8MTXP02HA26Z.15.25.C03.1.454.CMB.2.raw
  modified_base (446)..(446): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagagccggcctccatcctcctgcaggtctagtcagacgcctccagcatactgatggaatacaacttagttggatttcggtacctgacagaacgccgagggctagtcctaccactaactcctagtacttcttagtttcggtactaacggtccgggtccgtccccggggtcctagacgtggttcaggtggcgtagtggactacgagtactagtacgtatttacactagaaatcagtacgaggagtgggaacgngtagggtagggttacgggttttagggttattacgtcgagtaagtcgtaacgtaacggtacctaaacccgaaccccggtatacccgtacccggttaccggaccgggtacggaccgacggaccggtaggtaaacgtaacgttaaaaccggtggtcgtacgtacgtacgtaccgtacgtactcg

SEQ ID NO: 422649 - DNA, 555 bp, Homo sapiens
  misc_feature: GZ8MTXP02GFMIP.15.25.C03.1.454.CMB.2.raw
  modified_base (286)..(286): a, c, t, g, unknown or other
  modified_base (344)..(344): a, c, t, g, unknown or other
  modified_base (350)..(350): a, c, t, g, unknown or other
  modified_base (352)..(352): a, c, t, g, unknown or other
  modified_base (354)..(354): a, c, t, g, unknown or other
  modified_base (356)..(356): a, c, t, g, unknown or other
  modified_base (358)..(358): a, c, t, g, unknown or other
  modified_base (363)..(363): a, c, t, g, unknown or other
  modified_base (377)..(377): a, c, t, g, unknown or other
  modified_base (380)..(380): a, c, t, g, unknown or other
  modified_base (382)..(382): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagagccggcctccatctcctgcaggtctagtcagagcctccagcatactgatggatacatattggattggactgcagaagccaggcagtcnccacactcctgatctatttggttctaatcggtccgtccccgggtccgtcgacagtcgngtgggngngngngngaganatatattactatanaananagagagagtaggaggagtaggtagggttagggttagggtttagttagtagtacgtagtacgacgtaacgtacgtaaccgaacccgtactacgtaccgtaccggaccggacggaccgaccgacgtacggaacgtaacgtaaacgtaacgtacgtacgtcgtacgacactactcg

SEQ ID NO: 422650 - DNA, 615 bp, Homo sapiens
  misc_feature: GZ8MTXP02GJF7S.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgccccgtccacccctggagacgcccggcctccatcctcccgcaggtctagtcagacgccctccagcatactgatggatacaactattggattggtacctgacagaacgccagggcagtctccacaactctgtatctagtttggtactagtccgggcctccggggtcctgacgaggttcagtggacagtggatcgaggctatagtattttacactagaaatcagacagaggtggaggcgtaggagggtacggtttaggggtttattacgtgacagtcgacgtaaggtacctaaccgaaacccgtactaccgtaccgttaccgggaccggacgggaccgaccggtacccggtaagggtaaacgtaaaacgttaaaacggaaaccgttaggttaacgggccttacggaccctaaaccgtacttccgttacgtttaccc

SEQ ID NO: 422651 - DNA, 570 bp, Homo sapiens
  misc_feature: GZ8MTXP02JQ3I5.15.25.C03.1.454.CMB.2.raw
  modified_base (100)..(100): a, c, t, g, unknown or other
  modified_base (423)..(423): a, c, t, g, unknown or other
  modified_base (564)..(564): a, c, t, g, unknown or other
tcagtctacgtagccacgaccggtgctcgatttagtagtgtagatttgggtttgggggatcaggactcctcagttcaccttctcacaatgaggctcccgntcagctcctggggcgtgctaatgctctgggtctctggatccagtggggatattgtgatgactcagtctccactctccctgcccgtcacccctggagagccggcctccatctcctgcaggtctagtcagagcctccagcatactgatggatacaactattgatggtacctgcagaagccagggcagtctaccacaactcctgtatctttagtttgggttactaaacgtccggggtccctccggggtccctgacgtagggttcaggtggcgagtggggatcgaggctatagtattttacatagaaaatcagcaagagtcggagtntaggaggtaggtttagggttattacgtgctagtgacgtaaggtacctaacaaaccccggtataccgtaaccgtcggaccgacgggacaccggccgtaggaacgtaacgtaaacggactggtggactcgacacctattcgtntttacc

SEQ ID NO: 422652 - DNA, 539 bp, Homo sapiens
  misc_feature: GZ8MTXP02INF0H.15.25.C03.1.454.CMB.2.raw
  modified_base (343)..(343): a, c, t, g, unknown or other
  modified_base (353)..(353): a, c, t, g, unknown or other
  modified_base (366)..(366): a, c, t, g, unknown or other
  modified_base (378)..(378): a, c, t, g, unknown or other
  modified_base (382)..(382): a, c, t, g, unknown or other
  modified_base (384)..(384): a, c, t, g, unknown or other
  modified_base (388)..(388): a, c, t, g, unknown or other
  modified_base (399)..(399): a, c, t, g, unknown or other
  modified_base (428)..(428): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggacctgcagaagccagggcagtctccacaactcctgatctatttgggttctaaatcgggctcggggtccccctgacnggtcagtgcngtgatcagcatanatttactataanaaananaganagagtggaggngtgaggtaggttagggtttagttagtagnatagagaagtacgtaacaaacccgaactacacgtacgtaccggacggacgacgacgtacggacgtaacgtaaaacgtaaacgtaagtacggtacgtcgacaccactactcg

SEQ ID NO: 422653 - DNA, 525 bp, Homo sapiens
  misc_feature: GZ8MTXP02FP71V.15.25.C03.1.454.CMB.2.raw
  modified_base (355)..(355): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactcctgatctatttgggttctaagtcgggcctcggggtccccctgacaggttcagtgcngtgatcagcatagtatttacactagaaaatcagcagagtggaggcgtagaggtacggtttggggtttattacgtgacagtgacgaaggtcctaacaaacccgatccaccgttcggccgagggacacgcctaggaagaacttaaacgaactgtacgctacgcaccatctcg

SEQ ID NO: 422654 - DNA, 514 bp, Homo sapiens
  misc_feature: GZ8MTXP02FSHHX.15.25.C03.1.454.CMB.2.raw
  modified_base (355)..(355): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggacctgcagaagccagggcagtctccacaactcctgatctatttgggttctaagtcgggcctcggggtccccctgacaggttcagtggcngtgatcaggcatagatttacactagaaaatcagcagagtggagctgaggacgttggggtttattacgtgcatgcgaaggtctacgaaaccccgatacaccgttcggaccgagggacacgcctggacgaactaacgaactgtaggctcgctacactctcg

SEQ ID NO: 422655 - DNA, 555 bp, Homo sapiens
  misc_feature: GZ8MTXP02GNQXG.15.25.C03.1.454.CMB.2.raw
  modified_base (288)..(288): a, c, t, g, unknown or other
  modified_base (337)..(337): a, c, t, g, unknown or other
  modified_base (346)..(346): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagagccaggcagtcnccacactcctgatctatttgggtctaagtcggcctcgggtcccctgacngtcagtgcngtgatcgagcatagtatttacactagaaatcagcagaggtggaggcgtaggagggtacggtttggggtttattacgtgactagtgacctaagggtactaaaccgaaaccccgtatacctaccgttcggaccggacgggaccacgtccgtaggaacgtaaacgttaaacgaacgttcggtcggacgtacggacctaccgtactcgttacg

SEQ ID NO: 422656 - DNA, 661 bp, Homo sapiens
  misc_feature: GZ8MTXP02GKF7O.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcaccctggagacgccggcctccatctcctgcaggtctagtcagagcctccagcatactgatggaatactaactatttggattcggtacctgcaagaagccgagggcagtctaccacaactcctgattctagttttggtactaacgtccgggccgtccccggggtcctgactaggttcaggtgcgtagtggatcgagggctaagtagtatttacactagaaaatcagacgaggtagtagggaggtacgtagggtaaacggggttagggttttaacgggggttttaatttaccgtagtacgtaagttacggaacgttaaacgggtaaccctaaaacccgtaaaacccccggtacttaccccgtaacccggtttaccgggacccgggaacgggtaaccgaccggtaccgtaacgggaaacgtaaacgttaaaaccgaaacgttcggtacggtacgtacggaacctaccgtactttccg

SEQ ID NO: 422657 - DNA, 587 bp, Homo sapiens
  misc_feature: GZ8MTXP02F25KW.15.25.C03.1.454.CMB.2.raw
  modified_base (290)..(290): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccctcacccctggagagccggcctccatctcccgcaggtctagtcagacgcctccagcatactgatggatacaactattggattggtacctgcagaagccagggcagtcnccaacaactcctgacttctagtttggtctaagtccgggcctccggggtccctgactaggttcaggtgcaggtgatcaggcattagattttacactagaaaatcaagcaagagtggaaggcgtagagggtacggtttaggggtttaattacgtgtactagtagacgtaaacggtacctaaacccgaaaccccgtatcccgaccgttccggaccgaacggaccgacgacccgtaggaacgtaaacgttaaaaccgaacgtcggtaacggctacggaccaacctactaccttcgtttacc

SEQ ID NO: 422658 - DNA, 620 bp, Homo sapiens
  misc_feature: GZ8MTXP02IXZVJ.15.25.C03.1.454.CMB.2.raw
  modified_base (358)..(358): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagagccgagggcagtctccacaactctgatctagtttggtactaagtccggggcctccggggtcccctgacgtggttcagtggcnggtgatcgagcatagtatttacatagaaatcgagacgagaggtaggaggcgtaggtagggtacggtttaggggtttatacgttgctagtcgacgtaacggttacctaaaccgtaaaaccccgacttaccgtacccgttaccgggacccggtaacggggaacccgaccggtacccggtagggtaaacggtaaaacgtttaaaaccgggtaaacgttcgggtacggtaccgttacggacctaacccgtactttaccgtttaccg

SEQ ID NO: 422659 - DNA, 638 bp, Homo sapiens
  misc_feature: GZ8MTXP02J416M.15.25.C03.1.454.CMB.2.raw
  modified_base (197)..(197): a, c, t, g, unknown or other
  modified_base (273)..(273): a, c, t, g, unknown or other
  modified_base (315)..(315): a, c, t, g, unknown or other
  modified_base (392)..(392): a, c, t, g, unknown or other
  modified_base (408)..(408): a, c, t, g, unknown or other
tcagtctacgtagccacgaccggtgctcgatttagtagtgtagatttgggtttggggatcaggactcctcagttcaccttctcacaatgaggctccctgctcagctcctgggtctgctaatgctctgggtctctggatccagtgggatattgtgatgactcagtctccactctccctgccccgtcacccctggaganccggcctccatctcctgcaggtctagtcagagcctccagcatctgatggatacaacgtattagttggtatacgtcngacagacgcggacggtacacgttccaccaactacctacggtntaattcgtttagttttcggactttaacgggtccggtccgtccccgtcggggtccctagtacgtgtacgtggtgtacnggtcggatacgcgtanacttaatattaaatactaacgggaaacaaatacgagacgaggttaagggtagggtacgggtacttagtacggtagtcggggtttagtacggtttgtacgtacgtacgtacgtaacgtactaccgaccgtaaacccggtctaacccggaacctaccggaaccgtaccgtacccgacggtaccggtaccggaaccgtacggtaccggactaggtaccgtaagtaacccgtcg

SEQ ID NO: 422660 - DNA, 559 bp, Homo sapiens
  misc_feature: GZ8MTXP02H5I1X.15.25.C03.1.454.CMB.2.raw
  modified_base (353)..(353): a, c, t, g, unknown or other
  modified_base (355)..(355): a, c, t, g, unknown or other
  modified_base (392)..(392): a, c, t, g, unknown or other
  modified_base (405)..(405): a, c, t, g, unknown or other
  modified_base (435)..(435): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctcagcatactgatggatacaatatttggattggtacctgcagaagccgaggcagtctcacaactctgatcttagttggtctaagtccggccgtccgggtcccctgacaggttcagtggcngnggatcgagctagtagtatttaacatagaaaatcgaancgagaggtggagngtagagggtacgttagggtttatacgttgnagtgacgaaggtacctaaccgaaacccggtactaccgtaccgttaccggaccggaaacgggaccgaccgtaccgaggaacgaacgttaaacgacgtaagtacggactacgacaccaattctacg

SEQ ID NO: 422661 - DNA, 602 bp, Homo sapiens
  misc_feature: GZ8MTXP02IKES7.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgttctgggtctctggatccagtggggatattgtgatgactcagtctccactctccctgcccgtcacccctggagagccggcctccatctcctgcaggtctagtcagacgcctcagcatactgatggatacatattggatggtactgcagaagccaggcagtctaccacaactcctgatcttagtttgggttctaagtccgggcctccggggtcctgactgttcagtggcagtggatcgaggacagtagtattttacaactagaaatcagcagagtgggaggacgtggagggtacggtttaggggtttaattacgtgtctagtgacgtaacggtacctaaaccgaaacccgtacgtaccgtaccgttaccggacccggtaacggggaaccgaccggaccggtaggaaacggttaaacgttaaaaccggtaaccgttagggtaacggtcgttaccggactaccacgtttacgttcgtttacc

SEQ ID NO: 422662 - DNA, 792 bp, Homo sapiens
  misc_feature: GZ8MTXP02H0I3Z.15.25.C03.1.454.CMB.2.raw
  modified_base (246)..(246): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtccacccctggagagccggcctccatctcctgcaggtctagtcagacgcctccagcatacngatggatacaactattggattggtacctgacaggaacgaccgaggggcaacggtcctaccaacctaaccttcctagtactttactttaagtttttcggggtttactaaacggttccggggacccgttccccgggggttccccctaggtaccgtacgggttaccgagggttcggggaccgtaggggtcgggtacttaccggaacggggtaccttaaagttaagggtttaaacgtttttaaacctaaaccgttaaagtaaaaacgttaccgaaggtaccgtaaaggggtaacgggttagggggaacggggtaccggttaggggaaacgggggtttaaaccggggttttaggggggtttttaaagtttaacggttggtacgtaggttacgtacgtaaacgggtaccttaaaccgaaaccccgtactaccgtaacccgttaccggggaccggaacggggtaccgaccggtaccgtagggtaaacgtaaacgtttaaacggaaacgttcggttaacggccgttacggacctaccgtactttacggtttccg

SEQ ID NO: 422663 - DNA, 654 bp, Homo sapiens
  misc_feature: GZ8MTXP02IFHO2.15.25.C03.1.454.CMB.2.raw
  modified_base (547)..(547): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctccagcatactgatggatacaatattggattggtacctgcagacgccgaggcagtctccacaactcctgattcttagtttgggttactaacggtccggggtcccgttcccggggtccccctaggaccgtacgggtttcacggttcgggctaggggtggtaacgtcgagggctaagttagttaactttttaaccgaactagaaaaatcgaagcgaaggaggtagggaaggtcgtagggagggtaacgggttttagggggtttaattacgttggtactagtcggaacgaagggttaccaaaccgtaaacccccgtntaccgtaccgtttccgggaccggagggaccgaccgtaccggtagggtaaacgtaaacgtttaaaacgaacgtcggtcggacgtacggacctaaccgtatacgtttcg

SEQ ID NO: 422664 - DNA, 603 bp, Homo sapiens
  misc_feature: GZ8MTXP02IAH3L.15.25.C03.1.454.CMB.2.raw
  modified_base (361)..(361): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgacagaagccgagggcagtctccaacaactcctgatcttatttggttctaagtccgggcctccggggtcccctgactaggttcagtggcnggtggatcgaggcaagtagtatttacatagaaaatcagacgagaggtggaggtcgtaggagggttacggtttaggggtttattacgtgacgtagtgacgtaaggtacctaaccgaaaccccgtataccgtacccgttaccgggacccggacggggaccgaccggaccgttagggaaacgtaaaacgttaaaaccggtaaacgttcggtacgggtcttacggaccgaccgtaacgttctttcg

SEQ ID NO: 422665 - DNA, 608 bp, Homo sapiens
  misc_feature: GZ8MTXP02FYQ4Z.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatcctcctgcaggtctagtcagacgcctccagcatactgatggatacaacttagttggattcggtacctgacaagaacgccgagggcagtcctaccaactaacctcctagtacttctttagtttcggggtttactaaacgtccggggcccgttcccggggtcccctaggacgtaggtttcaggtggactggtggactcgagctaagtagtatttacactagaaatcagacagagtggagcgtaggaggttacggtttagggttaattacgtagctagtgacgtaacggtacctaaaccgaaacccgtgtaccgtacccgttcggaccggacggaccgaccggtaccgtaggaacgtaaacgtaaacgaaccgtggtacggctacgaccactagttcttcg

SEQ ID NO: 422666 - DNA, 617 bp, Homo sapiens
  misc_feature: GZ8MTXP02GAL1R.15.25.C03.1.454.CMB.2.raw
  modified_base (261)..(261): a, c, t, g, unknown or other
  modified_base (388)..(388): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactctccctcgcccgtccacccgtggacgacgccggcctccatcctcctgcaggtctagtcagacgcctccagcatactgatggatacaatnttgattcggtactgacaagacgcgaggcagtcctacaacaactcctagtacttcttagtttgggttactaaggtccgggtccgtccggggtcccctagacgtaggtcgaggtggctggtgatgacgntaagtagttactttaacactaagaaatcagcgaaggagtaggagcgtaggagggttacggtttagggttactacgtgactagtgaacgtaacggtacctaaacccgtaaacccgtgtacccgtacgttaccgggaccggtaacgggaccgtacggtaccgtaagggaacgtaaaacgttaaaccggaacgttaagggtacggactaccggacctaactacgttcttacg

SEQ ID NO: 422667 - DNA, 559 bp, Homo sapiens
  misc_feature: GZ8MTXP02JCOLW.15.25.C03.1.454.CMB.2.raw
  modified_base (290)..(290): a, c, t, g, unknown or other
  modified_base (336)..(336): a, c, t, g, unknown or other
  modified_base (345)..(345): a, c, t, g, unknown or other
  modified_base (549)..(549): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggacctgcagaagccagggcagtcnccacaactctgatctatttggtctagtcggcctcgggcccctgacngtcagtgcngtggatcgaggcatagtatttacactagaaaatcgagacaggagtgggagcgtaggagggttacggtttggggtttattacgtgcgtattgacgtaagggtacctaaaccgaaaccccatccgtaacccgttcgggaccggagggaccaccggtacgtacggaacgtaacgttaaaagaccgtggtacggctacgacctaaccncttaccttcg

SEQ ID NO: 422668 - DNA, 623 bp, Homo sapiens
  misc_feature: GZ8MTXP02FZ6U6.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccgagggcagtctccaacaactcctgatcttagtttggggttactaagtccggggccgttcccggggtccccctgactaggttccaggtggcaggtggatcgaggctaatagtatttacactagaaaatcagcgagagtggaggctagggaggtacggtttagggggtttaattacgtgtactagtacgtacgtaaacgggttacctaaacccgaaaaccccgtactaccgtacccgttaccgggaccgggaacggggtaaaccaccggtaccgtagggaacgtaaaacgttaaaaccggtaaacgtggttacggcgttacggaccgtaacctacttacgtttcg

SEQ ID NO: 422669 - DNA, 591 bp, Homo sapiens
  misc_feature: GZ8MTXP02F4E5A.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgacagaacgccagggcagtctccacaactcctgatcttagtttcgggttctaagtccgggccgttccggggtcccctggactaggttcagttcggcaggtgatcgaggctagttagtatttacactagaaatcagtacagagtggagtcgtggaggttacggtttaggggtttatacgtgctagtgacgaacggtactaacccgaaacccgtactaccgtaccgttccggaccggacgggaccaccggtaccgtaggaacgtaaacgttaaacccggtaagttaacggtacggtctacggcctaaccgtacttcgttcg

SEQ ID NO: 422670 - DNA, 705 bp, Homo sapiens
  misc_feature: GZ8MTXP02GQ84G.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactcctccctgcccgtcacccctggagacgccggcctccatctcctgcaggtctagtcagagcctccagcatactgatggaatacaacttattggattcggtacctgacagaacgccgagggcagtcctaccaacaacctcctgtacttcgttagttttcggggttactaacgtcccggggtcccgttccggggtccccctaggacgtacgggttcagggtcggacaggttgggaatcgaaggtctaagttacgttaacttttaacaacgttaaaggaaaaactcgaaggacgtaagggacgggtagggtagggcgttagggtaaggggtttaacgggttttagggggttttaaacttacgttagtacgtaagttcggaacgtaacggtacctaaacccgaaaccccgtacttacccgtacccggttaccgggaccggacggggtaacccgaccggtaccggtaagggtaaaccgtaaacgttaaaaccggtacgttaaggtacggacgtaccgacctaaccgtctttacgttccg

SEQ ID NO: 422671 - DNA, 643 bp, Homo sapiens
  misc_feature: GZ8MTXP02G12OL.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagagccggcctccatctcctgcaggtctagtcagagcctccagcatactgatggatacaactatttggattggtacctgcagaagccgaggcagtcctccacaactcctgatcttagtttggttctaagtccggggtccgtccccgggggtccctgacgtaggttcgacggttggcgaggtggatcgaggctagtagttaatttacactagaaatcgaagagaggaggtgggaggtacgtaggtaagggttacgggttttagggggtttactttacgtagacgtagtacggacgtaacggtaccttaaacccgaaaccccgtaacgttaccgtaacccggttaccggggaacccgggacgggaaaccgtaccggaccggttacggggaaaacgttaaacgttaaaaccggaagtttacggacggtacgtcggacctacctactttccg

SEQ ID NO: 422672 - DNA, 514 bp, Homo sapiens
  misc_feature: GZ8MTXP02IHORZ.15.25.C03.1.454.CMB.2.raw
  modified_base (353)..(353): a, c, t, g, unknown or other
  modified_base (378)..(378): a, c, t, g, unknown or other
  modified_base (382)..(382): a, c, t, g, unknown or other
  modified_base (384)..(384): a, c, t, g, unknown or other
  modified_base (386)..(387): a, c, t, g, unknown or other
  modified_base (392)..(392): a, c, t, g, unknown or other
  modified_base (397)..(397): a, c, t, g, unknown or other
  modified_base (399)..(399): a, c, t, g, unknown or other
  modified_base (422)..(422): a, c, t, g, unknown or other
  modified_base (424)..(424): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatgatacaactattggattggtacctgcagaagccagggcagtctccacaactctgatctatttgggtctaaatcgggctccggggtccccctgacaggttcagtggcngtgatcaggcatagatttactatanaaananannagagnggagngngaggtagttagggttagttatgnanagcgagtactaacaaacccactactactcggacgacggacgacgacgacgacgaacgtaaacgaacgtaagtgacgtcgcacactactcg

SEQ ID NO: 422673 - DNA, 583 bp, Homo sapiens
  misc_feature: GZ8MTXP02F74ND.15.25.C03.1.454.CMB.2.raw
  modified_base (365)..(365): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctccagcatactgatggatacaactattggattggtacctgcagaagccgagggcagtctccacaactcctgatcttagtttgggttactaagtccgggccgtccggggtccccctgactaggttcaggtgcnggtgatcgagcatagtatttacactagaaatcagcagagtggagcgtagaggtacggtttggggtttaattacgtgactagtgacgtaacggtacctaaaccgaaaccccgtataccgtacccgttcgggaccggtaggggaccaccggtaccgtacgggaagtaaaacgttaaaccgaacgttcggacggtctacggacctaccgtattcgtttacg

SEQ ID NO: 422674 - DNA, 563 bp, Homo sapiens
  misc_feature: GZ8MTXP02IPWMF.15.25.C03.1.454.CMB.2.raw
  modified_base (288)..(288): a, c, t, g, unknown or other
  modified_base (347)..(347): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggacctgcagaagccaggcagtcnccacaactctgatcttagtttggtctagtccggctccggggtccctgactgtcagtgcngtgatcagctatagtatttacactagaaaatcagacgagaggtagggaggcgtaggagggttacggtttaggggtttattacgtgactagtacgacgtaacggtactaaacccgaaacccgtataccgtaccgttcgggaccggacgggaccaccgaccgtaggaacgtaaacgttaaaacgaacgtggtacgactcggacctactacgttcttcg

SEQ ID NO: 422675 - DNA, 616 bp, Homo sapiens
  misc_feature: GZ8MTXP02FKHNL.15.25.C03.1.454.CMB.2.raw
  modified_base (371)..(371): a, c, t, g, unknown or other
  modified_base (508)..(508): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatcctcctgcaggtctagtcagagcctccagcatactgatggatacaactattggattggtacctgcaagaacgccgagggcagtcctaccaacaactcctgatcttatttggggttactaagtcgggccctccggggtccccctggactggttcgagtggcngtggatcgagcagtagtacttttacacttagaaaatcagacgagaggtggaggtcgtaggagggtacgggtttaggggtttaacttacgtgacgtagtagtaccgtaaagggttccctaaaccgtaaaacccccgtntaacccgtaacccgttccgggacccggtaacggggaccaccggaccggttaggaacgtaaacgttaaaaccggaactgggtcgcgttacgaccaccgtagtcctttcg

SEQ ID NO: 422676 - DNA, 573 bp, Homo sapiens
  misc_feature: GZ8MTXP02JTQEO.15.25.C03.1.454.CMB.2.raw
  modified_base (351)..(351): a, c, t, g, unknown or other
  modified_base (396)..(396): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcagcatactgatggatacaactattggattggtacctgcagaagccaggcagtctccacaactctgatctagtttggtctaagtccgggcctccggggtcccctgactgtcagtggcngtgatcgagcatagtattacactagaaatcagcagagtggacggngtagaggtacggttgggtttattacgtgtactagtgactaacgggttactaaacccgaaaccccgtactaccgtaacccgtttcggacccggacgggacgaccggacccgttaggaaacgtaaacgttaaaacggaaccgttgggtacggtcgtacggacctaccgacttctttacg

SEQ ID NO: 422677 - DNA, 570 bp, Homo sapiens
  misc_feature: GZ8MTXP02HNZUM.15.25.C03.1.454.CMB.2.raw
  modified_base (359)..(359): a, c, t, g, unknown or other
  modified_base (370)..(370): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagagcctccagcatactgatggatacaacttagttggattggtacctgcagaagccgaggcagtctcacaactcctgatcttagtttggtctaagtcgggcctccggggtcccctgactaggttcagtggcnggtgatcgagntagtagtatttacactagaaatcagcagagtggagcgtagagggtacggttggggtttattacgtgactagtagacgtaaggtacctaaccgaaaccccgtataccgaaccgttcgggaccggtacgggaccaccggaccgttaggaacgtaacgtttaaaaccgacgttggtacggctacggaccaccgtattcgttcg

SEQ ID NO: 422678 - DNA, 570 bp, Homo sapiens
  misc_feature: GZ8MTXP02J4MWT.15.25.C03.1.454.CMB.2.raw
  modified_base (236)..(236): a, c, t, g, unknown or other
  modified_base (279)..(279): a, c, t, g, unknown or other
  modified_base (417)..(417): a, c, t, g, unknown or other
  modified_base (421)..(421): a, c, t, g, unknown or other
  modified_base (460)..(460): a, c, t, g, unknown or other
tcagtctacgtagccacgaccggtgctcgatttagtagtgtagatttgggtttgggggatcaggactcctcagttcaccttctcacaatgatgctccctgctcagctcctggggctgctaatgctctggtctctggatccgagtgggatattgtgatgactcacgtcctccactcctccctcgcccgtcacccgtggacgacgccgcctccatctcctgcaggtctagtcaacgcncctacagcatactgatggattacaacttgttggattggtaccngcagagcctaggcagtcctaccataactcctgtaactttcgttagttttcgggtctaacggtccggggacccgtccccggggtcctgacgtaggttcaggttggcagtgatcagctattagtatttacactagaaacngagngagtggtggaggtgtaggtaggttagttaggttatacgngacacgtacgacgtacgtacctaaccgacccgtacgtaccgtaccgtacggacggacggacgacgacgtacgtaacgtacgtaaacgcgtcgacgtctactctactactc

SEQ ID NO: 422679 - DNA, 556 bp, Homo sapiens
  misc_feature: GZ8MTXP02FPC2A.15.25.C03.1.454.CMB.2.raw
  modified_base (357)..(357): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctaccacaactcctgatctatttgggttactaagtcgggcctccggggtcccctgacaggttcagtgcngtgatcgagcatagtatttacactagaaatcagcagagtggagcgtagagggtacgtttggggttattacgtgacagtgacgtaacggtcctaaaccgaaaccccgtataccctaccgttcggaccggacgggacgaccggaccgtaaggaacgtaaacttaaaacggacgtggtacggctacgacactacgtcttacg

SEQ ID NO: 422680 - DNA, 568 bp, Homo sapiens
  misc_feature: GZ8MTXP02H8TJR.15.25.C03.1.454.CMB.2.raw
  modified_base (344)..(344): a, c, t, g, unknown or other
  modified_base (357)..(357): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcaccccctggagagccggcctccatctcctgcaggtctagtcagagcctccagcatactgatggatacaactatttggattggtacctgcagaagccagggcagtctccacaactctgatctatttggtctaagtccggcctccggggtcccctgacnggttcaggtggcnggtgatcgagctatagtatttacactagaaaatcagacagagtggagctgaggtacggttggggtttaatacgtgacagtgacgtaaggtcctaacgaaacccccgtatacccgaccgttccggaccggtacgggaacccgacggtacccgttaggaacgaaacgtttaaacgaaccgtaaggtcggtactcggacaccctaatttcgtcg

SEQ ID NO: 422681 - DNA, 545 bp, Homo sapiens
  misc_feature: GZ8MTXP02FF491.15.25.C03.1.454.CMB.2.raw
  modified_base (357)..(357): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactcctgatctatttgggttctaagtcgggcctccggggtccccctgacaggttcagtggcngtggatcagcatagattttacactagaaaatcagcagagtggaggctaggaggtacggtttgggggtttattacgtgcagtgacaaggtactaaccgaaaccccgataccaccgttccgggaccggacgggaccacgccgtaggaacgtaactaaaacgaacgtggtacggctcgacaccactcttcg

SEQ ID NO: 422682 - DNA, 619 bp, Homo sapiens
  misc_feature: GZ8MTXP02IOOHG.15.25.C03.1.454.CMB.2.raw
  modified_base (424)..(424): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcaccctggagacgccggcctccatctcctgcaggtctagtcagagccctccagcatactgatggatacaacttatttggattggtacctgcagaacgccgagggcagtcctaccacaactcctgtattcttatttgggttctaacgtccggggcccgttccccggggtccctgacgtaggttcaggttcggcgtagtggatcgaggcaattagtaatttacactagaaactcgacganaggtaggtagggaaggcgtagggtagggtacgggttttgggggtttaatttacgtagcgtattcggacgtaacggttactaaaccgaaaccccgtactaccgtacccgttccgggaccggacgggtaccaacggtccgtaggaaacgtaagttaaaccgtaaagtcggtacggtacgtacgacctactactttcg

SEQ ID NO: 422683 - DNA, 640 bp, Homo sapiens
  misc_feature: GZ8MTXP02HXJGY.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtggggatattgtgatgactcagtctccactcctccctcgcccgtccacccctggagacgcccggcctccatcctcctgcaggtctagtcagacgcctccagctatactgatggaatacaattagttggattggtacctgacagacgcgaggcagtcctaccaacactcctagactttcgttagtttggttactaacgtcccgggtcccgtccggggtcccctagaccgtggttcaggtcggactaggggtgtatccgaggtactagtaacgtttactttaaccaaagttaagtaaaactcgagacgtaaggaggtagggaggtcgtagggtacgggttaggtttggggtttatacgtgtactagtcgaaccgtaacggtacctaaccgaaacctcgtaccgtaccggtaccggacggaacggacgtacccgtcggtaacggtaaataaacggttaaacgacgtggtacggctacgacctacctagtttccgtaccg

SEQ ID NO: 422684 - DNA, 646 bp, Homo sapiens
  misc_feature: GZ8MTXP02GE0IW.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatcctcccgcaggtctagtcagagcctcagcatactgatggatacaactattggattggtacctgcagaagccagggcagtctccacaactcctgatctagtttggtctaagtccgggccgtccggggtcctgactaggtcagtggcaggtggatcgaggcagtagtattttacactagaaaatcagacagagtggagtcgtaggagggtacggtttaggggtttattacgtgtactagttacggacgtaaacgggttacctaaacccgtaaaacccccggtagttaccccgtaacccggtttacccggggaacccgggtaaacggggtaacccgaaaccgggtcccggttaaaggggaaacgtaaacgtttaaaaaccggaacgttacgggtaacgggtcctacgaccgtaaccgtaacttaccgttcggtttacccg

SEQ ID NO: 422685 - DNA, 570 bp, Homo sapiens
  misc_feature: GZ8MTXP02JVCIZ.15.25.C03.1.454.CMB.2.raw
  modified_base (297)..(297): a, c, t, g, unknown or other
  modified_base (352)..(352): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcagcatactgatggatacaactatttgattggtacctgcagagccaggcagtctcacactctgntctagtttggtactagtccggccgtccgggtcccctgacgtaggttcaggtggcnggtcgatcgagctatagtatttacactagaaatcagacgagagtaggaggtcgtaggtaacggttacgggtttagggtttagttacgtgactagtagacgtacggtactaaccgaaaccgctacgtaccgtcggtacccggacgggaccacggccgtaggtaacgtaacgttaaacgagttcggacggtactacggacctaccgtactcggtttaccg

SEQ ID NO: 422686 - DNA, 561 bp, Homo sapiens
  misc_feature: GZ8MTXP02FJQUF.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggacctgcagaagccagggcagtctccacaactcctgatctagttttgggtctaagtccggggcctccccggggtccctgactaggttcagtggcagtggatcaggcatagtatttacactagaaaatcagcagagtggagcgtggagggtacggttaggggtttattacgtgactagtgacgaacggttacctaaccaaaccccgtataccgaccgttccgggacccggagggaccaccggccgtaggaacgaacgttaaaacgaacgtggtacggctacgaccacctacttccg

SEQ ID NO: 422687 - DNA, 586 bp, Homo sapiens
  misc_feature: GZ8MTXP02IAM4C.15.25.C03.1.454.CMB.2.raw
  modified_base (350)..(350): a, c, t, g, unknown or other
tcagtctacgtagccacgaccggtgctcgatttagtagtgtagatttgggtttggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacatatttggattggtacctgcagaagccagggcagtctccacaactctgatctatttgggtctaatccgggctccggggtcccctgactaggtcagtgcngtggatcgagcagtagtactttacactagaaaatcagacaagaggtggaaggtcgtaggaggtacggtttggggtttaatacgttgactagtagacgaaggtcctaacgaaacccccgtataccgtaacccgttccggaccggtacgggacctaccggacccgttagggaaacgtaacgttaaaccggaaacgtaacggttcgggacttacggaccctaccgaactttcgttaccg

SEQ ID NO: 422688 - DNA, 633 bp, Homo sapiens
  misc_feature: GZ8MTXP02FYREG.15.25.C03.1.454.CMB.2.raw
  modified_base (538)..(538): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggataacaacttatttggattcggtacctgcaagaacgccagggcaagtcctccaacaacctcctgacttcttagtttcgggtttactaagtccgggtccccgtcccggggtccccctaggacctaggttctaggtcggactgggtggactcgaggctaagttaagtacttttacgactaagaaaatcgagtacgaagaggtaggacggcgtaggagggttaacggtttaggggtttaacttaaccgttgacgtaagtacgtaacgtaaggtacctaacccgaaaaccccgntacccgtaaccgttccgggaccggaacgggacctacggaccgtaaggaagtaaacgttaaaccgaacgtgtacgactacgactaccatcgttacg

SEQ ID NO: 422689 - DNA, 610 bp, Homo sapiens
  misc_feature: GZ8MTXP02F48EC.15.25.C03.1.454.CMB.2.raw
  modified_base (292)..(292): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagacgccggcctccatctcctgcaggtctagtcagagcctccagcatactgatggatacaactatttggattggtacctgcagaagccaggcagtcnccacaactcctgattctagtttgggttactaagtccggggcctccccggggtccctgactaggttcaggtggcgagtggatcgagacatagtatttacactagaaatcgagacgagaggtgggaggcgtaggagggttacggtttaggggtttacttacgtgactagttacgacgtaacgggttacctaaaccgaaaccccgtacgtacccgtaacccggttccggggaccggaacggggaccgaccggtaccgtagggtaacgtaaacgtttaaaacggaacgttggtacggccgttacggaccaaccgttacgtcg

SEQ ID NO: 422690 - DNA, 609 bp, Homo sapiens
  misc_feature: GZ8MTXP02GQ2Q0.15.25.C03.1.454.CMB.2.raw
  modified_base (291)..(291): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagagccggcctccatctcctgcaggtctagtcagacgcctccagcatactgatggatacaacttattggattggtacctgcagagccaggcagtcnccacaactcctgatcttagtttgggttactaagtccgggccttccggggtcccctagacgtaggttcaggtggcagggtgatcgaggctatagtatttacactagaaaatcgagacgagaggtaggagcgtagggtaacggttacgggtttaggggtttaacttacgtgcgtagttgacgtaaacggtccttaaaccgaaaccccgtatacccgtaccgttaccggaccggaacgggtaccaccggtccgtaaggaacgtaaaacgttaaacggaaacgtggtacggacttacggacctaacctacgttacgtttccg

SEQ ID NO: 422691 - DNA, 605 bp, Homo sapiens
  misc_feature: GZ8MTXP02JIUTV.15.25.C03.1.454.CMB.2.raw
  modified_base (416)..(416): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatcctcctgcaggtctagtcagagcctccagcatactgatggatacaactattggattggtacctgcagaagccgagggcagtcctccacaactcctgatcttagtttgggttactaagtccggggccgtccggggtccccctgactaggtcagtggcagtgatcgaggcagtagtactttacactagaaatcagacagagtggacggngtaggacggttaggttaggggtttatacgtgacagtagacgtaaggtacctaaaccgaaacccgtactaccgtaccgtaccgggaccggtaacgggaccaccgggtaccgtaagggtaaacgtaaacgtttaaaaccggaaaccgtggttacggaccgtacggaccgtaaccgtaacttcggtttaccg

SEQ ID NO: 422692 - DNA, 591 bp, Homo sapiens
  misc_feature: GZ8MTXP02F4CNJ.15.25.C03.1.454.CMB.2.raw
  modified_base (353)..(353): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgacagaagccagggcagtctccacaactctgatctatttgggtctaagtcgggcctccggggtcccctgcaggtcagtggcngtgatcgagcatagtatttacatagaaatcaagcaagagtagggaggtctaggtaggtacggtttaggggtttattacgtggactagtaggactaacgggttacctaaaccgaaaacccccgtatacccgtaccgttaccgggaccgggtaacgggaccaccggaccgttagggaaacgtaaacgttaaaaccggtaacgtggtacgggacttacggacctaacctattaccgtttcg

SEQ ID NO: 422693 - DNA, 641 bp, Homo sapiens
  misc_feature: GZ8MTXP02JPAUD.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagacgcccggcctccatcctcccgcaggtctagtcagacgccctccagcatactgatggatacaactattggattggacctgcagaagccgaggcagtctccaacaactcctgtatctttagtttcggttactaacgtccggggtcctccggggtcctggacgtaggttcgaggtggactaggtggactcgaggactaagttagtacttttacaactagaaaatcgagacgagagtggaggcgtaggaggtacgggtttagggttattagtgtacgagtacggacgtaaacggtacctaaacccgaaacccgtactacccgtaacccgttaccgggaccggtaacgggacccgtaccgggtacccgtaagggtaaacgtaaacgtttaaaaaccgacgttacggcggtacgtaccggtaccaaccgtaacgttcgtacgtttcccg

SEQ ID NO: 422694 - DNA, 667 bp, Homo sapiens
  misc_feature: GZ8MTXP02ILZC0.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatcctcctgcaggtctagtcagagcctcagcatactgatggatacaattattgattggacctgacagacgccgaggcagtcaccaacaactctagtactcttagtttcggtactaacgtccggggccttccggggtcccctagacgtaggttcaggttgacgtaggtgatccgagctaagtaagttatttaacacgtaagaaaactcgaagacgtaaggaggtagggaagggtacgtagggtaagggttacgggttttaggggtttaatacgttgcgtagtacgacgtaaacggtaccctaaaccggaaacccctagttacccgtaaccggttacccgggaaccgggtaacgggaccgtaaccgggtacgttaacggggaaacgttaaaaacgttaaaccgtaaacggttcggttacggaccgttacggaccctaaacccgtttacgttaccgtttacg

SEQ ID NO: 422695 - DNA, 527 bp, Homo sapiens
  misc_feature: GZ8MTXP02I2NZ6.15.25.C03.1.454.CMB.2.raw
  modified_base (356)..(356): a, c, t, g, unknown or other
  modified_base (456)..(456): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatcttatttgggtctaagtcgggcctccggggtcccctgacaggttcagtgcngtgatcagcatagatttacatagaaaatcagcagagtggagcgtagaggtacggtttggggtttaattacgtgcagtgacaaggtctaacgaaaacccgntaccgtacgttcggaccgaggacacgacctaggacgaacttaacgaactgtacggctacgcaccatcttcg

SEQ ID NO: 422696 - DNA, 663 bp, Homo sapiens
  misc_feature: GZ8MTXP02HOZJW.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactcctccctgcccgtcacccctggagagccggcctccatcctcctgcaggtctagtcagagcctccagcatactgatggatacaactagtttggattcggtacctgacagaagccgagggcagtcctaccaacaactcctagtacttcgttaagtttgggttactaaacgttccggggcccttcccgggggttcccccctaggaccgtagggtttccaggttcgggctagggttgggacttccgagggtactaagttaagttaacttttaccaacttaacggaaaaattcaaggacaaggaggtagggaggcgtagggagggttacgggtttagggggttttaattacgttgacgtagtacgacgtaaacggttacctaaacccgaaaccccgtaactaccgaacccgttcggaacccggtagggaccaccggccgtaggaacgtaacgttaaaacgaacgtgtacggctacgaccacctacgttaccgttcg

SEQ ID NO: 422697 - DNA, 594 bp, Homo sapiens
  misc_feature: GZ8MTXP02GSDL4.15.25.C03.1.454.CMB.2.raw
  modified_base (360)..(360): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctaccacaactctgatcttatttgggttctaagtccgggccgtcggggtcccctgactaggttcaggtggcnggtgatcgagcagtagtatttacactaagaaactcgagacgaggtaggtgggaggcgtagggaacgggttacgggtttaggggtttaattacgtgtactagtagacgtaaaggtacctaaaccgaaaccccgtatacccgtaccgttaccggaccgggacgggtacgaccggtccgtaggaacgtaaacgtaaacgacgtcggtcggacgttacggacctactacttcgttacg

SEQ ID NO: 422698 - DNA, 590 bp, Homo sapiens
  misc_feature: GZ8MTXP02IQJIH.15.25.C03.1.454.CMB.2.raw
  modified_base (256)..(256): a, c, t, g, unknown or other
  modified_base (265)..(265): a, c, t, g, unknown or other
  modified_base (283)..(283): a, c, t, g, unknown or other
  modified_base (344)..(344): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagacgccggcctccatctcctgcaggtctagtcagagcctccagcatactgatgatacatnttgatgacngcagagccgaggcagtcncacactctgatcttagtttggtactagtccgggcctccggggtccctgactagtcagtgcngtgatcgagcatagtatttacatagaaatcagacagaggtggagtcgtaggtagggttacggtttaggggtttaactacgttgactagtacggacgtaacggtacctaaaccgtaaaaccccgtacttaccgtaccgtttaccgggaccggtacgggtaccgaccggtaccggtagggtaaacgtaaaccggttaaaacgtaaacgtcgggtacggcgtacggacctacccgtaagttacctttcg

SEQ ID NO: 422699 - DNA, 576 bp, Homo sapiens
  misc_feature: GZ8MTXP02FXAB7.15.25.C03.1.454.CMB.2.raw
  modified_base (258)..(258): a, c, t, g, unknown or other
  modified_base (355)..(355): a, c, t, g, unknown or other
  modified_base (402)..(402): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaacttnttggattggtacctgacagaacgccagggcagtctcacactctgatctagtttggttacaagtcgggcctccggggtcccctgacaggttcagtgcnggtgatcgagcatagtatttacactagaaatcagcaggagtggaagngtaggaggtacggtttaggggtttattacgtgacgtagtggtaacgtaagggtacctaaaccgaaaaccccgtactacgtaaccccgttcggaccggacgggaccgaccggacgtacggaacgtaaacgttaaacgtaaacgttggacgggactcggacctaacgcttcgttcg

SEQ ID NO: 422700 - DNA, 611 bp, Homo sapiens
  misc_feature: GZ8MTXP02GA5IZ.15.25.C03.1.454.CMB.2.raw
  modified_base (394)..(394): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagacgcctccagcatactgatggataacaactattggattggtacctgcagaagccagggcagtcctacaacaactcctgattctagtttgggtactaagtccggggtcctccccggggtccctgactaggttcaggtggctagtggatcgaggcatagtatttanactagaaatcagcagagtggagcgtaggagggtacggtttaggggtttacttacgtagactagtacggacgtaacgggttactaaacccgaaaccccgtatacccgtaacccggttaccgggaccggaaacggggaccgaaccggtacccggttagggtaaaacgtaacgtttaaaacggaaccgttggtacggcttacggaccaacctagtttccg

SEQ ID NO: 422701 - DNA, 582 bp, Homo sapiens
  misc_feature: GZ8MTXP02JSAAN.15.25.C03.1.454.CMB.2.raw
  modified_base (356)..(356): a, c, t, g, unknown or other
  modified_base (397)..(397): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagacgcctccagcatactgatggatacaactatttggattggtacctgcagaagccagggcagtcctaccacaactcctgatcttatttggtctaagtcggcctcgggtcccctgactagtcagtggcngtggatcgagcagtagtatttacactagaaatcagcagagnggagcgtaggaggtacggtttggggtttaattagtgtacgtagtacgacgtaacggtacctaaccgaaaccccgtatacccgtaaccgttccggggaccggtacgggaccacggtaccgttagggaacgtaaacgttaaaaccgtaacgtcggtacggccgtacgaccgtacctagtcctttacg

SEQ ID NO: 422702 - DNA, 571 bp, Homo sapiens
  misc_feature: GZ8MTXP02I2UM0.15.25.C03.1.454.CMB.2.raw
  modified_base (353)..(353): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacactcctgatctattggttctaagtcggcctccggggtcccctgacaggttcagtcggcnggtggatcgaggctaagtagtattttaacactaggaaaatcgaagcgaagaggttagggaggtcgtaggtagggtacggtttggggtttaattacgtgactagtgacgaaggtactaaccgaaaacccgtataccgtaccgttcggaccggacgggacgacgaccgtaggacgtaaacgttaaacgaaacgtggtacggcgtcgacacctactcttcg

SEQ ID NO: 422703 - DNA, 600 bp, Homo sapiens
  misc_feature: GZ8MTXP02FI77Z.15.25.C03.1.454.CMB.2.raw
  modified_base (291)..(291): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaacttattggattggtacctgcagaagccagggcagtcnccacaactctgatctatttgggttctaagtcggggcctcggggtccccctgacgaggttcagtggcaggtggatcgaggctagtagtattttacacttagaaaatcagcgtagaggtaggaggcgtagggagggtacgggtttggggtttaattacgtgctagtgacgtaaggtactaaaccgaaaccccgtataccgtaccgttaccgggacccggtaacggggacctaccgggacccgttaggggaaacgtaaacgttaaaaccggaacgtggtacggtcgtacggaccaaccgtacttcgtttacg

SEQ ID NO: 422704 - DNA, 578 bp, Homo sapiens
  misc_feature: GZ8MTXP02JRB5M.15.25.C03.1.454.CMB.2.raw
  modified_base (356)..(356): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagagcctccagcatactgatggatacaacttatttggattggtacctgcagagccaggcagtctcacaactctgatctagtttggtctaagtccggccgtccggggtcccctgacgtggttcagtggcngtcgatcgagcagtagtatttacactagaaaatcagacgagaggtggaggcgtaggagggttacggtttagggtttattacgtgcgtagtgacgtaacggtacctaaccgaaaccccgtactaccgtaccgttaccggaccggacgggaccgacggccgtagggaacgtaaacgttaaaccgaacgtaacggtacgtacgtacgaccaccgtagttcttacg

SEQ ID NO: 422705 - DNA, 562 bp, Homo sapiens
  misc_feature: GZ8MTXP02FQR95.15.25.C03.1.454.CMB.2.raw
  modified_base (260)..(260): a, c, t, g, unknown or other
  modified_base (368)..(368): a, c, t, g, unknown or other
  modified_base (409)..(409): a, c, t, g, unknown or other
  modified_base (480)..(480): a, c, t, g, unknown or other
tcagtctacgtagccacgaccggtgctcgatttagtagtgtagatttgggtttgggggatcaggactcctcagttcaccctctcacaatgaggctccctgctcagctcctggggctgctaatgctctgggtctctggatccagtggggatattgtgatgactcagtctccactctccctgcccgtcacccctggagacgccggcctccatctcctgcaggtctagtcagacgcctccagcatactgatggatacaacttnttggattggtacctgacaagaagccagggcagtcctccacaactctgatcttagtttcgggttactaagtccggggccttccggggtcccctgacaggttcagtggcngggtgatcgaggctaagtagtatttacattagaaaatcagnagagtggagcgtagaggtacggtttagggttattacgtgactagtgacgtaaggtactaaccgaaacccgntaccgtacgttcggaccgacgggacacggacgtaggaacgtaacgttaacgaacgtgtacggactcgacaactactcgttcg

SEQ ID NO: 422706 - DNA, 581 bp, Homo sapiens
  misc_feature: GZ8MTXP02I581K.15.25.C03.1.454.CMB.2.raw
  modified_base (341)..(341): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcccgcaggtctagtcagagcctccagcatactgatggatacaactattggattggtacctgcagaagccagggcagtctccacaactcctgatctatttgggttctaagtccggcctcggggtcctgacnggttcagtggcagtggatcgaggctatagtattttacaactagaaaatcagcagagtggaggcgtaggagggtacggtttaggggtttattacgtgtactagtgacgtaaggtacctaaccgaacccgtactccgtaccgttacggaccggacggggactaccggccgtaggaacgtaaacgttaaaacgtaacgttcgggtaaggtctacgacccgtaacgtacgttcttacgtttacc

SEQ ID NO: 422707 - DNA, 499 bp, Homo sapiens
  misc_feature: GZ8MTXP02FF6J9.15.25.C03.1.454.CMB.2.raw
  modified_base (357)..(357): a, c, t, g, unknown or other
  modified_base (451)..(451): a, c, t, g, unknown or other
  modified_base (466)..(466): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggacctgcagaagccagggcagtctccacaactcctgatctatttggggttctaagtcgggcctccggggtccccctgacaggttcagtggcngtggatcagcatagattttacactagaaaatcagcagagtggagctgaggtacggttggggttattacgtgcatgcaaggtctacgaacccgancactcggcgaggacncgctgacgataacgactgtgctgcacactctcg

SEQ ID NO: 422708 - DNA, 710 bp, Homo sapiens
  misc_feature: GZ8MTXP02FZHOO.15.25.C03.1.454.CMB.2.raw
  modified_base (257)..(257): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctcagcatactgatggatacaattnttgattggtacctgcagaacgcgagggcagtcctaccaactaacctcctgattcttagtttcgggttactaacgtccgggtcccgttccggggtccccctaggacgtaggttcgaggtcggactaggggtgacgtacgagggtacctaagtaaggttaatttttaacaacgttaaagtaaaaacgttacgaaacggtacgaaagggtaggtacggggtaaggtaccggttaggggtaacgggtttaaccggggtttttagggggttttaaactttaccggttaggtccgtaagtacggtaaccgtaacggttaaccgtaaacccgtaaaaccccgtacgtaacccgtacccggttacgggaccggacgggtaccgacggtaccggtaggtaaacgtaaacgttaaaaccggtacgtaacggtacggacgtacgacctactacttacgtttccg

SEQ ID NO: 422709 - DNA, 592 bp, Homo sapiens
  misc_feature: GZ8MTXP02IF040.15.25.C03.1.454.CMB.2.raw
  modified_base (256)..(256): a, c, t, g, unknown or other
  modified_base (358)..(358): a, c, t, g, unknown or other
  modified_base (390)..(390): a, c, t, g, unknown or other
  modified_base (393)..(393): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaatnttggattgtacctgcagagccagggcagtctccacaactctagatcttagtttgggttctaagtccggggcctccggggtccccctgactggttcagtggcnggtcgatcgagcatagtatttacatagaaatnagngagagtggaggctaggaggtacggtttaggggtttattaacgtgacgtatcgaacgtaacggtactaaccgaaaacccgtcttaccgtaaccgttccgggacccggtaaggggaccaccggtacccgtagggtaacgtaaaacgtttaaaccggaacgttggtacgggtactcggaccgtaacccgtacgtactttccg

SEQ ID NO: 422710 - DNA, 705 bp, Homo sapiens
  misc_feature: GZ8MTXP02GPECH.15.25.C03.1.454.CMB.2.raw
  modified_base (383)..(383): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtgggatattgtgatgactcagtctccactctccctgcccgtccaccctggagacgccggcctccatcctcctgcaggtctagtcagacgcctccagcatactgatggatacaacttatttggattcggtacctgacaaggaacgccgagggcacgtcctaccacaacctctgacttcgttagtttggttactaaggtccggggccgttccggggtcccctagacgtggttcaggtgcgnggtggactcgaggctaagttagttaacttttaacacgttaaaggaaaactcgaacgacgtaagggtaggtagggacggtacgtagggtaagggggtttacgggttttagggggttttaaacgttacggttagtactaacggtcgtaaaccggtaaacgggttaccctaaaacccgaaaacccccgggtactacccggtaacccgggttccgggaacccggggtaacgggaccgaacccggtaccggtaagggtaaacgttaaaacggttaaaacggtaccggtaaggtacgggcttacggacctaacctacgttctttaccg

SEQ ID NO: 422711 - DNA, 606 bp, Homo sapiens
  misc_feature: GZ8MTXP02F8X03.15.25.C03.1.454.CMB.2.raw
  modified_base (293)..(293): a, c, t, g, unknown or other
  modified_base (356)..(356): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctccagcatactgatggatacaattattggattggtactgcagaagccaggcagtctccanaactctgatcttagttggttactagtccgggccgtccggggtcccctgacgtaggtcagtgcngtgatcgagcaatagtatttacactaagaaatcagacaaggaggtagggaggtcgtaggggtacgggttaacgggttttagggggtttaatttacgtagtacgtagtacgaacgtaacggtacctaaaccgaaaccccgtagtacccgtaccgttaccgggaccggacgggaaccacggtaccgtagggaacgtaaaacgttaaacggaacgtggtacggtacgtacggacctaccgtacgttcgttacg

SEQ ID NO: 422712 - DNA, 626 bp, Homo sapiens
  misc_feature: GZ8MTXP02HJHCA.15.25.C03.1.454.CMB.2.raw
  modified_base (286)..(286): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcaccctggagagccggcctccatctcctgcaggtctagtcagagcctcagcatactgatggatacaatattggattggacctgcagaagccaggcagtcncaacactctgatctatttggtctaagtccgggcctcccggggtccctgacaggttcaggtcgcagtgatcgaggcaattagtactttacactagaaatcgagacagagtaggaaggcgtaggaggtaacggtttggggtttaatttaacgtcgtactaagtggtaacctaaagggtacctaaaaccgaaaaccccgtaagtcccgtaaacccggtttaccgggacccggtaaacgggggaaccaaccgggtacccgttaacgggaaaacggttaaaaccttaaaaaccggtaaaccgttaaggtcgggtaccctaggacccgtaaacctaactttacccg

SEQ ID NO: 422713 - DNA, 584 bp, Homo sapiens
  misc_feature: GZ8MTXP02HS0ZC.15.25.C03.1.454.CMB.2.raw
  modified_base (353)..(353): a, c, t, g, unknown or other
  modified_base (366)..(366): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagagccggcctccatctcctgcaggtctagtcagacgccctccagcatactgatggatacaactatttggattggtacctgcagaagccgagggcagtctaccacaactcctgactcttatttgggtctaagtccgggcctccggggtccccctgacnggttcaggtggcngtggatcgaggacagttagtatttacactagaaaatcagcagagtggagcgtaggaggtacggtttaggggtttattacgtagctagtcgagaacggtactaaaccgaaacccgtactccgtaaccgttccggaccggtaacgggaccgacggaccgttaggaacgtaacgttaaaaccggacgtcggtacggactacgaccaaccgtacttcgttcg

SEQ ID NO: 422714 - DNA, 631 bp, Homo sapiens
  misc_feature: GZ8MTXP02HF86Q.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctccagcatactgatggatacaactattggattggtacctgacagaagccagggcagtctccacaactctgatcttagtttgggtactaagtccggggcctccggggcccccctaggactaggttcagtcggactggtggatcgaggcaagtacgtaattttacaactagtaaaatcgagacgagtaggtagggaggtcgtaggtacgggtacgggttaggggttttatacgttagacgtagtagacgtaacgggtacctaaaccgtaaaacccgtactaccgtaaccgttaccgggtacccgggaacggggaaccgtacccggaccggtaaggaacgtaaaacgttaaaccggaaaagtcggtaacggtctacggaccgtaacctacttacgtttacg

SEQ ID NO: 422715 - DNA, 595 bp, Homo sapiens
  misc_feature: GZ8MTXP02HH4IZ.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattcggtacctgcaagaacgccgagggcagtccaccacactcctgactcttagtttgggttactaacgtccgggccgttccgggtccccctgactaggtcaggtgcaggtgatcgaggtctagtagtatttaacacgtaagaaaactcgagacgaggtagtgggaagtcgtaggacggtttacgggttaggggtttaactacgtgtcagtacgacgtaacggtacctaaaccgaaaccccgtatccgaaccgttcgggaccggtacggaccgacgccgttaggaacgtaacgtaaaccgagttggacgtcgtacgacctacgtactcgtttacg

SEQ ID NO: 422716 - DNA, 610 bp, Homo sapiens
  misc_feature: GZ8MTXP02F98JR.15.25.C03.1.454.CMB.2.raw
  modified_base (407)..(407): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatcctcccgcaggtctagtcagacgcctccagcatactgatggatacaacttattggattggtacctgacagaagccgagggcagtctccaacactcctagatcttagtttggtactaagtcgggcctccggggtcctgacgaggttcagtgcagtggatcgaggcaagtagtactttacaactagaaaatcaagcaagnggtgggaggtcgtaggagggttacggtttagggggtttattagtgacgagttggaaccgaacggtaccttaaacccgaaaccccgtatacccgtaccggttaccgggacccggaaacgggaccgaccggtccgttagggaaacgtaaacgtaaaacggtaaccgtaggtcggactcggtaccacgtaacttccgtagtttccc

SEQ ID NO: 422717 - DNA, 612 bp, Homo sapiens
  misc_feature: GZ8MTXP02G2Q82.15.25.C03.1.454.CMB.2.raw
  modified_base (195)..(195): a, c, t, g, unknown or other
  modified_base (428)..(428): a, c, t, g, unknown or other
  modified_base (443)..(443): a, c, t, g, unknown or other
tcagtctacgtagccacgaccggtgctcgatttagtagtgtagatttgggtttgggggatcaggactcctcagttcaccttctcacaatgaggctccctactcagctcctggggctgctaatgctctgggtctctggatccagtgggatattgtgatgactcagtctccactctccctgcccgtcacccctgganacgccgcctccatcctcctagcaggtctagtcaagcgcctccagctatactgatggatactaacttgttgacttggtaccctgacagaacgccgaggtcagtcctaccacactcctagacttcttagtttcggtactacggtccgggtcccgtccggggtcctgaccgtgttacgaggtgcgaagtcgggctagacggtctaagtacgtatttaaccaagtaagtaaacctanagagagtaggtaggnggtacgtacggtaggttacggttaggttacgttacgtagtacgtagtacgtacgtaacgtaccgtaaccgtaaccgtacgtacgtaccgtacgacgacggacgacgtacgtacggtaacgtaacgtaacgtacgtagtcgtcgtacgtactacgtacgtacgtacgtcg

SEQ ID NO: 422718 - DNA, 584 bp, Homo sapiens
  misc_feature: GZ8MTXP02J1YMI.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagagccggcctccatctcctgcaggtctagtcagacgcctccagcatactgatggatacaactattggattggtacctgcagaagccagggcagtctccacaactcctgatctagtttgggtctaagtcgggcctcccggggtccctgacgtaggttcagtggcaggtggatcgaggctatagtattttacactgaaatcagcagagtggaggctgagggtacgtttggggttattacgtgctagtgacgtaacgggtacctaaccgaaaacccccgtataccgtacccgtttccggggacccggacggggaccgacccggacccgtaggaacgtaaacgtttaaaaccggaacgttggtacgggccttacggaccaaccgtatttccg

SEQ ID NO: 422719 - DNA, 580 bp, Homo sapiens
  misc_feature: GZ8MTXP02II8EQ.15.25.C03.1.454.CMB.2.raw
  modified_base (290)..(290): a, c, t, g, unknown or other
  modified_base (347)..(347): a, c, t, g, unknown or other
  modified_base (356)..(356): a, c, t, g, unknown or other
  modified_base (389)..(389): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagagccgagggcagtcnccacaactcctgattcttagtttggttactaagtccgggcctccgggtcccctgacngtcagtgcngtgatcgagcagtatatttacatagaaatcagnagagtggagcgtagaggtacggtttagggtttaattacgtgactagtacgacgtaaggtacctaaccgaaaaccccgtataccgtaccgttccggaccggacgggtaaccgacggtaccgtaaggtaacgtaaactttaaaacggaacgttaaggtacggacgttacggacctacctacgtttacgttacg

SEQ ID NO: 422720 - DNA, 556 bp, Homo sapiens
  misc_feature: GZ8MTXP02I7W5X.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcaccctggagagccggcctccatctcctgcaggtctagtcagagccctccagcatactgatggatacaactatttggattggtacctgcagaagccagggcagtctccacaactcctgatctatttgggtctaagtcgggcctcccggggtccctgactaggttcagtgcagtcggatcgagcatagatttacactgaaatcagcagagtggagctggaggtacggtttggggtttattacgtgcatgacgtaaggtactaaacgaaaccccgataccgaaccgttcggaccggaagggaccgacggaccgtagggaacgtaacgttaaaacggaacgtttggacggacgtggaccaaccgtaatttccg

SEQ ID NO: 422721 - DNA, 600 bp, Homo sapiens
  misc_feature: GZ8MTXP02GYMEM.15.25.C03.1.454.CMB.2.raw
  modified_base (235)..(235): a, c, t, g, unknown or other
  modified_base (422)..(422): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtctccactctccctgcccgtcaccccgtggagacgcccggcctccatcctcctgcaggtctagtcagancctcagcatactgatggaatacaattagtttggattggtactgacagaagccgaggcacgtcctccaacactcctagacttcgttagtttcgggtactaacggtccggggtcctccccggggtccctagacgtaggttcaggttgcgtaggtgtatcgagctatagtatttaacacgtaagaaactnaagacgaggagtagggaggtcgtaggtaggggttacggtttaggggtttattacgtgtacgtagtacggtacgtaacgtacctaaaaccgaacccgtatacccgtaccgttacgggacggtacggaccgacgacggtagaacgtaactaaccgaagtgtacggcacgtcactacttcg

SEQ ID NO: 422722 - DNA, 620 bp, Homo sapiens
  misc_feature: GZ8MTXP02HBVLG.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagacgcctccagcatactgatggatacaactatttggattggtacctgacagaagccgagggcagtctccacactctgatctagtttggtactaacgtccgggccgtccggggtcccctagaccgtaggttcaggtcggcaggtgatcgaggctaagttagtactttaacacgttaagaaaatcgaagacgaggaggtagggacggtacgtaggtaggggttaacgggtttaggggtttaacttacgtgtacgtagttacgacgtaaacgggtacctaaaccgaaaccccgtataccgtaccgttaccgggaccggaacgggacaccggtaccgtaagggacgtaaacgttaaacgtaacgtggtacgacgtcggacctactacgtacgttcg

SEQ ID NO: 422723 - DNA, 524 bp, Homo sapiens
  misc_feature: GZ8MTXP02F800C.15.25.C03.1.454.CMB.2.raw
  modified_base (254)..(254): a, c, t, g, unknown or other
  modified_base (282)..(282): a, c, t, g, unknown or other
  modified_base (322)..(322): a, c, t, g, unknown or other
  modified_base (374)..(374): a, c, t, g, unknown or other
  modified_base (376)..(376): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccgtggagagccggcctcatctcctgcaggtctagtcagagcctccagcatactgatgatacattntgatgactgacagagcaggcagtcacanactcagatctattgggtactaagtcggcctccgggtcccngacaggttcaggtgcaggtgatcgagctaatagtactttacatagaaataananagagagagagagtagaggtaggttaggttagttagtagtagtagtagacgtacgtaacgtaaccgaaccgactacgtacgtacgacggacggacgacgacgtacgtacgtaacgtaacgacgtaagtcgacgacgacactactactcg

SEQ ID NO: 422724 - DNA, 507 bp, Homo sapiens
  misc_feature: GZ8MTXP02JXJDX.15.25.C03.1.454.CMB.2.raw
  modified_base (231)..(231): a, c, t, g, unknown or other
  modified_base (289)..(289): a, c, t, g, unknown or other
  modified_base (292)..(292): a, c, t, g, unknown or other
  modified_base (301)..(301): a, c, t, g, unknown or other
  modified_base (308)..(308): a, c, t, g, unknown or other
  modified_base (336)..(336): a, c, t, g, unknown or other
  modified_base (338)..(338): a, c, t, g, unknown or other
  modified_base (340)..(340): a, c, t, g, unknown or other
  modified_base (342)..(342): a, c, t, g, unknown or other
  modified_base (344)..(344): a, c, t, g, unknown or other
  modified_base (346)..(347): a, c, t, g, unknown or other
  modified_base (352)..(352): a, c, t, g, unknown or other
  modified_base (363)..(363): a, c, t, g, unknown or other
  modified_base (365)..(365): a, c, t, g, unknown or other
  modified_base (368)..(368): a, c, t, g, unknown or other
  modified_base (370)..(370): a, c, t, g, unknown or other
  modified_base (372)..(373): a, c, t, g, unknown or other
  modified_base (382)..(382): a, c, t, g, unknown or other
  modified_base (407)..(407): a, c, t, g, unknown or other
  modified_base (409)..(409): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagancctcagcatactgatggatacaatatttggattggtacctgcagaagccaggcagtcncanactctgatntattgtntaatcggcgtccggtccccgtgcagtgngngngngngnngaganatatattatananaananannagagagagngagaggtaggttaggttagtatgananagagacgtactaaccaaccactactacgtacggacggacggacgacgacgacgacgtaacgtaaacgtaagtaagtcgacgtacgacactactactcg

SEQ ID NO: 422725 - DNA, 643 bp, Homo sapiens
  misc_feature: GZ8MTXP02HGW73.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtgggatattgtgatgactcagtctccactctcctgcccgtcaccctggagacgccggcctccatctcctgcaggtctagtcagacgcctcagcaatacgtgagtggaataactaacttagtttaggattcggtacctgacaagaacgccgagggctagtccaccaacactctagtattcgttagtttgggtactaacggtccggggccgttccggggtcccctagacgtacggttcgaggtggcgtaggtggaactcgaggtactaagttaagtttaactttaaccgaataaaggtaaaatcgagacgtagaggtgggagtacgtggtaagggttacgggtttagggtttaattacgtagacgtagtagtaacgtaaacggtaccaaaccgtaaaccccgtataccgtaccgtaccggacggacggaccgacgaccgtaaggtaacgtaaaacgttaaacggaacgtggtacgactacggacctacgtaacttcgttcg

SEQ ID NO: 422726 - DNA, 590 bp, Homo sapiens
  misc_feature: GZ8MTXP02H1WHO.15.25.C03.1.454.CMB.2.raw
  modified_base (265)..(265): a, c, t, g, unknown or other
  modified_base (281)..(281): a, c, t, g, unknown or other
  modified_base (289)..(289): a, c, t, g, unknown or other
  modified_base (293)..(293): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtggggatattgtgatgactcagtctccactctccctgcccgtcaccctggagacgccggcctcatctctgcaggtctagtcagacgcctcagcatactgatgatacatagttgattggacngcagagcaggcagtcncacactcngatnttagtttggtactaagtccggggccgtccggggtcccctaggactaggttcaggtggctaggtcggatcgaggactaagtagtactttaacaactaagaaaatcgaagcgaggagtagggagcgtaggtagggtaggtttaggggtttatacgtgacgtagtcgacgtaacggtacctaaccgaaacccgtataccgtaacccgttacgggaccggaacgggaccacggtaccgtagggaaacgtaaacgttaaaaccggaacgtggtacggacgtacggaccacctattacgttcg

SEQ ID NO: 422727 - DNA, 630 bp, Homo sapiens
  misc_feature: GZ8MTXP02F5JF2.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagacgccggcctccatctcctgcaggtctagtcagacgcctccagcatactgatggatacaacttatttggattggtacctgcagaagccagggcagtctccacaactctgatcttagtttgggttactaagtccggggtcctccccggggtccctagactaggttcaggtggcaggtgatcgagcagtagtatttacactagaaatcagcagagtggagcgtaggaagggttacggtttagggggtttaatttacgtagtacgtaagtacgacgtaacggtaccctaaaaccgaaacccccgtagtacccgtaacccgttaccggggacccgggaacgggaacccgaccggtaccgtacgggtaaacgtaaacggttaaaaccgtaaccgttacggtacggggtaccttacggacctaacccgtagtttacccg

SEQ ID NO: 422728 - DNA, 636 bp, Homo sapiens
  misc_feature: GZ8MTXP02F4W9W.15.25.C03.1.454.CMB.2.raw
  modified_base (245)..(245): a, c, t, g, unknown or other
  modified_base (355)..(355): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagccctccagcatacngatggatacaactatttggattggacctgcagaagccagggcagtctccacaactcctgatctatttgggtctaatcgggcctcccggggtccctgacaggttcagtgcngtggatcaggcatagtatttacactagaaaatcagcagagtaggagcgtgaggtacggtttagggggtttacttacgtgacgtagtacggtacgtaaacgggtaccttaaacccgaaaacccccggtaactacccgtaacccggtttacccggggtacccgggaaacgggggaacccgaaccgggtaccccgttaacgggggtaaacgtaaacgtttaaaaaccggaaaaccggttgggttacgggaccgttacggacccgtaacccgtaacgtttacccg

SEQ ID NO: 422729 - DNA, 539 bp, Homo sapiens
  misc_feature: GZ8MTXP02HJ2YV.15.25.C03.1.454.CMB.2.raw
  modified_base (381)..(381): a, c, t, g, unknown or other
  modified_base (383)..(383): a, c, t, g, unknown or other
  modified_base (425)..(425): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatatgtgatgactcagtctccactctccctgcccgtcaccctggagagccgcctccatctcctgcaggtctagtcagagcctcagcatactgatggatacaactattggattggtacctgcagaagccaggcagtctccacaactctgatctatttggtctaaagtcggctccggggccccctagacaggtcagtggcagtggatcagcatagtatttacatagaaaatacananagagaggaggagtagaggtaggttagggtttagttagttagngatagagaacgtactaaccgaaacccgaactaccgtaccgtacgacggacggacgacgacgtacgacgtaaacgtaaacgtaacgtaacgtacgacgtacgacactactactcg

SEQ ID NO: 422730 - DNA, 765 bp, Homo sapiens
  misc_feature: GZ8MTXP02IMRGB.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcaccctggagagccggcctccatctcctgcaggtctagtcagagccctccagcatactgatggatacaacttatttggattggtacctgacagaacgccgagggcagtctacccacaactcctgtattcttagtttcgggtttacctaacgtccgggggtccccgttccccgggggttaccccctaggtaccgtacggggtttaccaacgggttcgggaccggttagggtgggtaaccgttccgaacgggggtctaaagtttaaacggttaactttttaacaaccgttaaggtaaaacttacgaaacgtacgtaagggtaagggtagggggtaacgggtacgtaggggtaaacgggggtttaaccgggggtttttaaggggggtttttaacttttaaccggtttggtaccgttaaggtacggtaaccgtaacggggtttaacctaaaaccccgtaaaccccggtaactacccgttaacccggtttaccggggtaccgggaacggggaccgtacggaccgtaggaaacgtaacgttaaaacgtaacgtacggtcggtactacggacctaccgtacttccg

SEQ ID NO: 422731 - DNA, 575 bp, Homo sapiens
  misc_feature: GZ8MTXP02IU9RN.15.25.C03.1.454.CMB.2.raw
  modified_base (349)..(349): a, c, t, g, unknown or other
  modified_base (383)..(383): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacatattgattgactgcagagccaggcagtctccaacaactctgatctatttggtactaagtcgggcctccggggtccctgactaggttcagtcggacnggtgatcgagcatagatttacatagaaatcaganagagtggagcgtaggaggtacggtttggggtttatacgttgactagtagacgtaaggttactaaccgaaaacccgtactaccgtaccgttacgggaccggaacggggacctaccggtaccgtaagggtacgtaaaacgttaaaccgaaacgtggtacggtacgtacgacctaaacccgttacttacgttacg

SEQ ID NO: 422732 - DNA, 597 bp, Homo sapiens
  misc_feature: GZ8MTXP02HF5KT.15.25.C03.1.454.CMB.2.raw
  modified_base (406)..(406): a, c, t, g, unknown or other
  modified_base (580)..(580): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagacgcctcagcatactgatggatacaacttattggattggtacctgcaagaacgccgaggcagtctaccacaactctagtattcttagtttggtactaagtccggggtcctccccggggtcctgacgtaggttcagtcggctagtggactcgaggtacattagtatttaacacgtanaaaactcaagtacgagaggtagggagcgtaggtagggtacggtttaggggttactttacgtgcgtacgtaggtacgtaaggtacctaaaccgtaaacccgtataccgaccgttacggacggacggacgtaccgacgtacggaacgtaacgttaaaacgaacgtaggtcggtacncgtaccacgtacttccg

SEQ ID NO: 422733 - DNA, 608 bp, Homo sapiens
  misc_feature: GZ8MTXP02HUKB0.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagacgccggcctccatctcctgcaggtctagtcagacgcctccagcatactgatggatacaacttattggattggacctgcagaagccagggcagtcctaccacaactcctagattcttatttgggtctaagtccgggcctccccggggtcctgacgaggttcaggttggcgagtgatccgaggctagttacgtatttacgactagaaatcagacaggtagtggagcgtaggaagggtttacggtttaggggtttaactttacgtggtactagttcgaacgtaacggtacctaaaccgaaaccccggtatacccgtacccgttaccggaccggtaaacgggacctacggacctaggggaaacgtaacgttaaaaccgaaggttcggaggtaccgtcgacctaccgtagttccg

SEQ ID NO: 422734 - DNA, 588 bp, Homo sapiens
  misc_feature: GZ8MTXP02GPYYZ.15.25.C03.1.454.CMB.2.raw
  modified_base (373)..(373): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatcctcctgcaggtctagtcagagcctccagcatactgatggatacaacttattggatggtacctgcagaagccgagggcagtctaccaacaacctcctagattcttagtttcgggttactaacgtccgggccgtccggggtcccctgactaggtcaggtcggcnggtgatcgagcatagtatttacactagaaaatcagacgaagaggtaggaggtcgtagggacgggttagggtttaggggtttattacgtgctagtgacgtaacggtacctaaccgaaaccccgtactaccgtaccgttccgggaccggacgggacgaccgaccgtaggaacgtaaacgtaaacgacgtggtacgcgtacgacctacgactcgttcg

SEQ ID NO: 422735 - DNA, 562 bp, Homo sapiens
  misc_feature: GZ8MTXP02I5GMD.15.25.C03.1.454.CMB.2.raw
  modified_base (346)..(346): a, c, t, g, unknown or other
  modified_base (358)..(358): a, c, t, g, unknown or other
  modified_base (468)..(468): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcaccccctggagagccggcctccatctcctgcaggtctagtcagagcctccagcatactgatggatacaactatttggattggtacctgcagaagccagggcagtctccacaactcctgatctatttgggttctaagtcgggcctccggggtcccctgacnggttcagtggcngtgatcgaggcatagtatttacactagaaatcagcaggagtggaggctggagggtacggtttgggggtttattacgtgcagtacgcaacggtactaaccgaaacccggtntaccgtaccgttccggaccggacggggacaccggaccgtacggacgtaacgttaaaccgaacgttgtcggtacgtcgactaccacgttcgttcg

SEQ ID NO: 422736 - DNA, 623 bp, Homo sapiens
  misc_feature: GZ8MTXP02FSNBE.15.25.C03.1.454.CMB.2.raw
  modified_base (256)..(256): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaatnttggattggtacctgcagaacgccgagggcagtcctccacaactcctgattcttagtttgggttactaacgtccggggccgttccggggtcccctgaccgtaggttcaggtggcaggtgatcgagcaagttagtattttaacactagaaaatcagacgagaggtaggaggtcgtagggtaagggttacgggtttaggggtttaacttacgtagtacgtagtaggtacgaacggttacctaaacccgtaaaaccccggtactaccgtacccgttaccggggaccggaacggggtaaccaccggtaccgtagggaacgtaaaacgtaaacgtaacgtggtcggacgtacggacctactacgtctttacg

SEQ ID NO: 422737 - DNA, 642 bp, Homo sapiens
  misc_feature: GZ8MTXP02FX7G7.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtggggatattgtgatgactcagtctccactctccctgcccgtcacccctggagagccggcctccatctcctgcaggtctagtcagacgcctccagcatactgatgatacaactattgattggacctgcagagccgaggcagtctccacactctgatctagtttgggttactaagtccgggtccgtccggggtccccctaggacctagggttcaggtcggcgtaggtgggactcggaggctaagttaagttacttttaacgaactaagtaaaactacgaagcgaaggaggttagggaggtcgtagggtagggttaacggggtttaggggttttaacgttacgtgtacgtaagtgtaaccgtaacgggtacctaaacccgtaaaacccccgtagttacccgtaacccggtttcgggaccggtaacgggaccgaaccggaccgttagggaacgttaaacgtaaaacgtaacgtggtacgcgtacgacgtacacttcgttcg

SEQ ID NO: 422738 - DNA, 668 bp, Homo sapiens
  misc_feature: GZ8MTXP02H8LXZ.15.25.C03.1.454.CMB.2.raw
  modified_base (241)..(241): a, c, t, g, unknown or other
  modified_base (262)..(262): a, c, t, g, unknown or other
  modified_base (423)..(423): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactcctccctgcccgtcaccctggagacgccggcctcatctcctgcaggtctagcagacgcctcagcatacngatgatacatattgatggacngcagagcgaggcagtcacacactctagattcgttagtttcggtactaagtccggggtccgtccggggtcccctaggtacgtacggtcgaggtcggacgtaggtggatccgagggtactaagttaaacgttaactttaaccgaagtaagtaaaactcgaagngtaaggtagggtagggaaggtcgttagggagggttacgggttttaggggtttaatacgttagactagtcggtaacgtaaacggttaccctaaacccgtaaacccggtactacccgtacccgggttacccggggaaccggtaaacggggacccgaaccggttaccggagggtaaaaccgtaaaacgttaaacccggtaacgttgggttacggaccgtacggacccttaccggtaatttccgttacg

SEQ ID NO: 422739 - DNA, 660 bp, Homo sapiens
  misc_feature: GZ8MTXP02FO6XO.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctcagcatactgatggatacaacttagttgattggtacctgacagaacgccgagggcagtcctaccaactaactcctgtattcttagtttcggggttactaacgtccgggtccgtccggggtcccctagacgtaggttcaggtggactggtgactcgaggtctaagttaagttaacttttaaacgaacgttaagaaaagtacgagacgtaaggaggtagggaaggtcgttaaggggtaacgggtttacggggtttagggggttttaacttacgtgtacgtaaggtacgtaacgtaaacggtacctaaaacccgaaaccccgtactaccgtaccgttaccgggacggtaacgggaccgacggacgtacgggaacgtaaaacgtaaaccggtaacgttggacggtactcgacctaccgtacttcgttacg

SEQ ID NO: 422740 - DNA, 692 bp, Homo sapiens
  misc_feature: GZ8MTXP02FU5PE.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactctccctgcccgtccaccccgtggacgacgcccggcctccactcctcccgcaggtctagtcagacgcctcagcatactgatggaatactaacttagttggattcggtacctgacgaagaacgccgaggcacgtcctaccaactaaccttccgtagtacttctttagtttcggtaccttaacggtccggggtacccgttccggggtccctacgacgtacggttcaggtgacgaggtgatccgaaggactaagttaacgtaacttttaacaacgttaagtaaaactcgaaagacgtaaggtaaggtgggaacggtaccgttaggggtaacggggttacgggttttaggggtttaactaccgtagtacgtagtacggaacgtaaccggtacctaaacccgaaaccccgtactacccgtacccgttacgggaccggaacggtaccaccggtacgttaaacggaaacgttaaacgtaaaacgtacgtacgaacgtacgtaccgaccactacgtccttacttacccg

SEQ ID NO: 422741 - DNA, 557 bp, Homo sapiens
  misc_feature: GZ8MTXP02FZ71J.15.25.C03.1.454.CMB.2.raw
  modified_base (289)..(289): a, c, t, g, unknown or other
  modified_base (404)..(404): a, c, t, g, unknown or other
  modified_base (509)..(509): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcagcatactgatgatacaactattggattggtacctgacagaagccaggcagtcncacactcctgatctagtttgggtactaagtcgggtcctcccggggtcctgactaggttcagtgcagtggatcgaggcatacgtatttacgactagaaaatcagcagagtggacgngtggaggtacggttggggtttatacgtgcgatgacgtaaggtactaaccaaacccgtactacgtaaccgttccgggacggacgggaccacggacctacgggtaanaacggtttaaaaccgaagttcggtaggtcgtagacctaccgatttccg

SEQ ID NO: 422742 - DNA, 641 bp, Homo sapiens
  misc_feature: GZ8MTXP02F5BLY.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctccagcatactgatggatacaacttattggattggtacctgacagaagccgagggcagtcctccacaactcctgatcgttagtttgggttactaaagtccggggtccgtccggggtccccctggacgtaggtttcaaggtcgggcagggttgggaactcgaagggctaagttagtacttttacaacttagaaaatcaagcaagaggtaggaggcgtaggacggttacgggtttgggtttaacttacgtgactagttagacgtaaacggtacctaaaccgaaaaccccgtactaccgtaacccgttacgggaccggaacgggaccaaccggtaccggttagggaacgtaaaacgttaaaacggaaacgttcggtacgggtacctcggaccctacctacttaccgtttcg

SEQ ID NO: 422743 - DNA, 638 bp, Homo sapiens
  misc_feature: GZ8MTXP02IK12D.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcaccctggagcgccggcctccatctcctgcaggtctagtcagacgcctcagcatactgatggataacaacttatttggatttcggtacctgacaagacgccgagggctacgtcctaccaaccaaccttcctagtatttacgtttagttttacgggtaccttaaggtcccggggtccgttcccccggggtccctagacgtggttcgaggtcggcgaggtggtactccgaagtcaagttagttaacttttacgaacttaagaaattcagacgaaggtaggtggaggcgtagggtagggttacgggtttaggggtttattacgtgtcagtcgaacgtaaacggtacctaaaccgaaacccacgtacctacccggttacgggaccggacgggaccacggtaccgtaggaacgttaaacgtaacgaacgtggtacggactacgactaccgtactccg

SEQ ID NO: 422744 - DNA, 630 bp, Homo sapiens
  misc_feature: GZ8MTXP02HXRFP.15.25.C03.1.454.CMB.2.raw
  modified_base (364)..(364): a, c, t, g, unknown or other
  modified_base (371)..(371): a, c, t, g, unknown or other
  modified_base (410)..(410): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatcctcctgcaggtctagtcagacgcctccagcatactgatggaatacaatattggattggtacctgcagaagccgaggcagtcctaccacaactcctgtacttcttagtttgggtactaacgtccgggccgttccggggtcccctgacgtggtcnggtggcnggtgatcgaggctagtagtactttacatagtaaatcagngtaaggaggtagggaggcgtagggagggttacgggtttaggggtttattacgtgactagtacgacgtaacgtacctaacccgaaacccgtacgtaccgtaccgttaccggaccggtaaacgggaccgacccggtaccggttaacgggtaaacgtaaaccgtttaaaaccgaacgttaacggtacggtaccgtacggaccctaacctaacgttacctttcg

SEQ ID NO: 422745 - DNA, 623 bp, Homo sapiens
  misc_feature: GZ8MTXP02FE0UN.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactctccctgcccgtcacccctggagacgccggcctccatctcctgcaggtctagtcagacgcctccagcatactgatggatacaacttattggattcggacctgacaaggaacgccgagggcagtcctaccaactaacctcctagacttccgttagtttcggggttacttaacgtccggggtccccgttccgggggtcccccctaggaccgtagggttccaggtcggactaggtcggatcgagtctaagtagtatttaacactaagaaaatcagacgagaggtggaggcgtaggtagggtacggtttagggttattacgtgactagtacgacgtaacgtacctaaaccgaaaccccgtacgtaccgtaccgtaccgggaccggacgggaccacggaccgtaggaacgtaacgtaaacgtaacgtaaggtcgacgtacgacaacctactcttcg

SEQ ID NO: 422746 - DNA, 549 bp, Homo sapiens
  misc_feature: GZ8MTXP02GW76B.15.25.C03.1.454.CMB.2.raw
  modified_base (354)..(354): a, c, t, g, unknown or other
  modified_base (401)..(401): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagagccaggcagtctcacactctgatcttagtttggttctaagtccgggcctccggggtcccctgactaggttcaggtgcnggtgatcgagcatagtatttacactagaaatcagcagagtggacggntaggaggtacggtttaggggtttattacgtgcagtgactaaggtactaaccaaacccgagtacctaccgttcgggaccgacgggacctacgaccgtaggaacgtaacgtaaaacgacgtgtacggtctacggacacctacgtcttacg

SEQ ID NO: 422747 - DNA, 625 bp, Homo sapiens
  misc_feature: GZ8MTXP02FY50N.15.25.C03.1.454.CMB.2.raw
  modified_base (302)..(302): a, c, t, g, unknown or other
  modified_base (344)..(344): a, c, t, g, unknown or other
  modified_base (400)..(400): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatcctcccgcaggtctagtcagagccctccagcatactgatggatacaactattggattggtacctgcagaagccagggcagtctcacaactccngatctatttgggtactaagtccgggcctccggggtcctgacnggtcagtggcagtggatcaggcatagtatttacactagaaatcagcagagtggagngtagagggtacggtttaggggtttaattacgtgacgtagtacggacgtaacggtacctaaaccgtaaacccccgtaagtacccgtaacccgttacggggacccggtaaacggggaccgtaaccggaccgttacgggaaacgttaaaaccgtttaaaaacccggacgttacgggttcggtaacgttacggaccctaaccgttaactttacccgttacgtttacccg

SEQ ID NO: 422748 - DNA, 525 bp, Homo sapiens
  misc_feature: GZ8MTXP02I9E1F.15.25.C03.1.454.CMB.2.raw
  modified_base (355)..(355): a, c, t, g, unknown or other
  modified_base (404)..(404): a, c, t, g, unknown or other
  modified_base (455)..(455): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggacctgcagaagccagggcagtctccacaactcctgatctatttgggtctaatcggggcctccggggtcccctgacaggttcagtggcngtggatcgaggcatagattttacactagaaaatcagcagagtggaggcngaggacggttggggtttattacgttgcatgacaaggtctaacaaaccccgntaccaccgttcggaccgaggacacgcctaggacgtaactaaacgaactggtcgactacgacaccatctcg

SEQ ID NO: 422749 - DNA, 693 bp, Homo sapiens
  misc_feature: GZ8MTXP02GY13D.15.25.C03.1.454.CMB.2.raw
  modified_base (242)..(242): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactctccctgcccgtcaccctggagagccggcctccatctcctgcaggtctagtcagacgcctccagcatacngatggatacaactattggattcggtacctgacagaacgccgagggcacgtcctaccaactaacctcctgtacttcgttagtttcgggttctaaaggtcccggggtcccgttccggggtcccccctaggtaccgtaggttccgaggttggcgaggttggacgtcgaagggtctaagttaagttaactttttaaaccgaacttaaaggtaaaataccgaagtaccgtaaggtagggtagggtaacgggtacgtagggtaacggggttaacgggttttagggggttttaacgttacggttacgtacgtagttacggtaaccgtaacggttacccgtaaacccgtaaaccccggtactacccgtaccggttacccgggacggtaacgggacgaccggtaccgtagggaacgtaacgtaaaccgaagtggtacggctacgacctactactcgtacg

SEQ ID NO: 422750 - DNA, 647 bp, Homo sapiens
  misc_feature: GZ8MTXP02F84U3.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgacagaacgccgagggcagtctccaacaacctcctgattcttagtttgggttactaacgtccggggccttccggggtcccctgactggttcaggtggctggtgatcgagcaagtagtaattttacactagaaaatcgagacgaagaggtggaaggtcgtaggagggttacggtttaggggtttaattacgttgactagtaggaaccgtaaagggttacctaaacccgtaaaccccgtacgtacccgtaacccggttacggggacccggtaacggggaaccctaccggtacccggttacgggaaacgtaaaacgtaaaaccggtaacggttaaggttacggaccgttacggaccgtaaccgtacttaccgtttccgg

SEQ ID NO: 422751 - DNA, 512 bp, Homo sapiens
  misc_feature: GZ8MTXP02HBB7M.15.25.C03.1.454.CMB.2.raw
  modified_base (351)..(351): a, c, t, g, unknown or other
  modified_base (384)..(385): a, c, t, g, unknown or other
  modified_base (423)..(423): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactctgatctatttggtctaaagtcggcctcggggtcccctgacaggtcagtggcngtggatcagcatagtatttacatagaaaatcannagagtaggagatgaggtacggttggggtttaatagtgnatagcaagtactaacaaacccgactacactacgaccgaggacgacgaccgacgagaataaacgaaacgtgtggacgcgacacactctcg

SEQ ID NO: 422752 - DNA, 621 bp, Homo sapiens
  misc_feature: GZ8MTXP02JUKHV.15.25.C03.1.454.CMB.2.raw
  modified_base (418)..(418): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcaccctggagacgccggcctccatcctcctgcaggtctagtcagacgcctccagcatactgatggatacaacttattggattggtacctgacagaacgccgagggctagtcctaccacaactccgtagtacttactttaagtttgggttactaacggttcccggggtccccgttccggggtccccctaggaccgtaggtttcgaggtcggatgggttacggaatcgaacggtntaagtattattaacagtaaataaacgtacgagagaggtaggtggagtacgtaggtagggttaggtttggttactgtgtacgtagtacgacgtacgtaccaaaccgtaaccgtactaccgtaccggtacggaccggtacggaccgacgtacgtaggtaaacgtaacgtaacgacgtcggtcgacgtacacctacgtactcgtcg

SEQ ID NO: 422753 - DNA, 562 bp, Homo sapiens
  misc_feature: GZ8MTXP02F04NV.15.25.C03.1.454.CMB.2.raw
  modified_base (294)..(294): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacactattggattggtactgacagaagccgagggcagtctccanaactcctgactcttagtttgggttctaagtccgggtccgtccggggtcccctgacgtaggttcaggttcggcaggtgatcgagtcaagtagtatttacactaagaaatcagcaggagtggagtcgtagtagggtacggtttaggggttattacgtgctagtagacgtaaggtacctaaccaaacccgtataccgtaccgtacggacgacggacacgcgtaggaacgtaacgtaacgaacgtgtacggctacgactacctagtcttacg

SEQ ID NO: 422754 - DNA, 584 bp, Homo sapiens
  misc_feature: GZ8MTXP02JR95N.15.25.C03.1.454.CMB.2.raw
  modified_base (254)..(254): a, c, t, g, unknown or other
  modified_base (412)..(412): a, c, t, g, unknown or other
  modified_base (476)..(476): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcagcatactgatgatacaatnttggattggtacctgcagaacgccagggcagtctccacaactcctgatcttagtttgggtctaagtccggccgtccgggtcccctgactaggttcaggtcggctggtgatcgaggctagtagtatttaccataagaaactcgagacgagaggtggagngtaggaggttacggttggggtttaatcgtgctagtcgactaacgggtactaaccgaaaacccgntaccgtaccgtacgggaccggagggaccgaccggtccgtaagggtaaccgtaacgttaaacggaacgttaaggtccgacggttaccgaccgtaccgtacgttcgtacg

SEQ ID NO: 422755 - DNA, 607 bp, Homo sapiens
  misc_feature: GZ8MTXP02GP6LL.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtccaccctggagacgccggcctccatctcctgcaggtctagtcagacgcctccagcatactgataggatacaacttatttggattcggtactgacagaagccgagggcacgtcctccaagtaacctcctgtattcgtttagtttcgggtttactaaagtccggggccgttccggggtccccctaggactgggtttacgagttggctggtcgatacgaggctagttagtaactttacactaagaaatcagcgagaggtggaggcgtaggtagggttacggtttagggtttagttacgtgtacgtagtgaacgtaacggtactaaccgaaacctcgtacgtaccgttacggacggtacggacgacggaccgtaggaacgtaacgtaaccggagttaacgcggacgtacgaccactcttacgttcg

SEQ ID NO: 422756 - DNA, 628 bp, Homo sapiens
  misc_feature: GZ8MTXP02JOGTD.15.25.C03.1.454.CMB.2.raw
  modified_base (255)..(255): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcaccctggagagccggcctccatctcctgcaggtctagtcagagcctcagcatactgatggatacaactnttggattggtacctgacagaagccgagggcagtcctccaacactctgattcttagtttggttactaacgtccggggtcccgtccggggtcccctagacgtaggttcgaggtggctgggtcgatcgaggctaatagtatttaacactaagaaactcaagagaaggtaggtagggacggtacgtagggtaagggttacgggtttagggggttttaattacggtcgtagtaagttacggaaccgtaacgggttaaccctaaaccgtaaaaccccgtgttaacccgtaccgttaccgggtacggacgggtaacgaccggtacgtaggaacgtaaacgttaaacgaacgtggtacggtcacgaccactactcgtttcg

SEQ ID NO: 422757 - DNA, 665 bp, Homo sapiens
  misc_feature: GZ8MTXP02H7E66.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcacccctggagagccggcctccatctcctgcaggtctagtcagagcctcagcatactgatggatacaacttatttggattggtacctgacagaagccaggcagtctccaacaactcctgattcttagtttggtactaacgtccgggcccgtccggggtcccctagtacgtaggttcagtggctagtggatcgagcagttagtactttacactagtaaaatcagacaggtaggtaggacgggacgtaggtacgggttaacgggtttaggggttttaagttaacgttggacgtagtacgtaaccgtaacgggttacctaaaccgtaaaaccccgtagtacccgtaacccggtttacccgggaaccggaacggggaaaccgaaccggtacccgtaggggtaaacgtaaaaccggtttaaaaccggtaaaccgttgggttacggaccggtaccgtaaccgtaacccgtaacgtttactttccg

SEQ ID NO: 422758 - DNA, 539 bp, Homo sapiens
  misc_feature: GZ8MTXP02I5QUD.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatcctcccgcaggtctagtcagacgcctccagcatactgatggatacaactattggattggtacctgcagaagccaggcagctccacaactcctgattctagtttgggtactaacgtcgggcccgtccggggtccctgacgtaggtcaggtggcagtgggactcgaggcataagtatttactactagtaaatcagcagagtggagcgtgaggtacgtttgggttattacgtgtcagtgacgaacgtcaacaacccgatcgaccgtcggcgagggacaccgacgtagacgtacgtaaaacgagtcgtaacgctacgtacacctactcgtcttc

SEQ ID NO: 422759 - DNA, 598 bp, Homo sapiens
  misc_feature: GZ8MTXP02IEYS0.15.25.C03.1.454.CMB.2.raw
  modified_base (294)..(294): a, c, t, g, unknown or other
  modified_base (475)..(475): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactctccctgcccgtcacccctggagagccggcctccatctcctgcaggtctagtcagagcctccagcatactgatggatacaacttatttggattggtacctgacagaacgccgagggcagtcnccacaactctgatctatttggtctaagtcggcctccggggtcccctgacaggttcaggtggctggtgatcgagcagtagtatttacatagaaatcagcagaggtggaggcgtaggagggtacggtttaggggtttattacgtgacgtagtcgtacgtaacggtactaaccgaaaacccgtntaccgaccgttccgggaccggaacgggacccgacggtacccgttagggaaacgtaaacgtttaaaacccggaaacgttaaggttacggccgtacggtaacccgaccgtaacttccgtttaccg

SEQ ID NO: 422760 - DNA, 527 bp, Homo sapiens
  misc_feature: GZ8MTXP02IB7VS.15.25.C03.1.454.CMB.2.raw
  modified_base (288)..(288): a, c, t, g, unknown or other
  modified_base (391)..(391): a, c, t, g, unknown or other
  modified_base (403)..(403): a, c, t, g, unknown or other
  modified_base (433)..(433): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctcctgcccgtcaccctggagacgccggcctccatctcctgcagtctagtcagagctcagcatactgatggatacaactattggattggtacctgcagaagccaagggcagtcnccaacaactcctgatcttaagttggtactaagtcgggcctcccggggtccctgacaggttcagtgtcagtgatcgaggcatagatttacactagaatacaganagagtaggaggngtagaggtaggttagggtttagttagtganatgacgaagtactacaaaccgactacgtacgtacgacgacggacgacgacgtacgacgtaagtaaacgaacgtagtacgtctacgacacactcg

SEQ ID NO: 422761 - DNA, 598 bp, Homo sapiens
  misc_feature: GZ8MTXP02GYC9H.15.25.C03.1.454.CMB.2.raw
  modified_base (348)..(348): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtctccactctccctgccccgtcacccctggagagccggcctccatctcctgcaggtctagtcagagcctccagcatactgatggatacaactattggattggtacctgcagaagccgaggcagtctccaacactcctgattctatttgggtactaagtccgggtcctcccggggtcctgacnggttcagtgcagtggactcgagcagtagtatttacactagaaatcgagacagagtgggacgtgtaggtaggttacgggtttagggtttattacgtggtactagtacgacgtaacggttactaaacccgtaaacccgacgtaccgtaacccgggtttccgggaccggacggggaccgaccgggtccgttacgggaacgtaacgttaaaacggtaaccgtggtacggacgttacgacctaccgtactttccg

SEQ ID NO: 422762 - DNA, 585 bp, Homo sapiens
  misc_feature: GZ8MTXP02HJAQJ.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctcagcatactgatggatacaactagtttggattggacctgacagaacgccgagggcagtcctaccaacaactcctgtattcttagtttgggtactaagtccgggcctccggggtcccctgacctaggtcagtggctagtggatcgaggctaatagtactttacaatagaaatcagcgagaggtggaggcgtaggtagggtacggtttagggtttaattacgttagctagtaggacgtaacggtacctaaaccgaaacccgactaccgaaccgttccggaccggacgggaccgacgacgtaacggacgtaacgttaaacgactggtacgcgtacgaccaccgtacgtacttcg

SEQ ID NO: 422763 - DNA, 636 bp, Homo sapiens
  misc_feature: GZ8MTXP02JPN2S.15.25.C03.1.454.CMB.2.raw
  modified_base (270)..(270): a, c, t, g, unknown or other
  modified_base (365)..(365): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaatattggattggtaccngcagacgccagggcagtcctccacaactcctgacttcttagtttggttctaagtccggggcctccggggtccccctgacgtaggttcagtcggcnggtggatcgagctagtagtactttacaacgtaagaaaactcgaagacgaagacggtagggaggtgtagggtaacgggttacgggtttagggggtttaacttacgttaggacgtagtacgtacgtaaacggtaccttaaaacccgaacccgtacgtaccgtacccgttaccgggacccggaacggggaccaccggtccggttaaacgggaacgtaaaaccgttaaaacggtacgttgggtacggtaccgtcgaccaaccgtactctttaccg

SEQ ID NO: 422764 - DNA, 627 bp, Homo sapiens
  misc_feature: GZ8MTXP02G6TG8.15.25.C03.1.454.CMB.2.raw
  modified_base (232)..(232): a, c, t, g, unknown or other
  modified_base (312)..(312): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagacgcccggcctccatctcctgcaggtctagtcagngcctccagcatactgatggatacaacttattggattggacctgcaagagccgagggcagtcctccacaactcctgacttnttagtttgggtactaagtccgggtcctccccggggtccctgactaggttcaggtggcaggtgatcgaggctatagtatttacactagaaaactgagacgaaggaggtaggagggcgtaggtacggggtaggtttaggggtttattacgtgactagtcgaacgtaaggtaccctaaaccgaaaccccgtactaccgtaacccgttacggggaccccggaaaggggtaccgaaccggtaccgttaaggggaactaaaacggtttaaaaccgaaaccgtttcgggagggttacctacggcctaacccgtaactttccg

SEQ ID NO: 422765 - DNA, 568 bp, Homo sapiens
  misc_feature: GZ8MTXP02GUH9R.15.25.C03.1.454.CMB.2.raw
  modified_base (293)..(293): a, c, t, g, unknown or other
  modified_base (349)..(349): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccaggcagtctccanactctgatctatttggttctaatcgggcctcggggtccccctgacagttcagtgcngtgatcgagcatagatttacactagaaatcagcagagtggagcgtagaggtacggtttggggtttaattacgtagtcgtagtgacgtaaaggtactaaccgaaaaccccgtataccgtaaccgttcgggaaccggacggggaccgaaccgcccgtacggaagtaacgttaaaaccggaacgtaaggtacggacttacggaccaacccgtattacgttcg

SEQ ID NO: 422766 - DNA, 593 bp, Homo sapiens
  misc_feature: GZ8MTXP02GHYA5.15.25.C03.1.454.CMB.2.raw
  modified_base (247)..(247): a, c, t, g, unknown or other
  modified_base (366)..(366): a, c, t, g, unknown or other
  modified_base (561)..(561): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctcgcccgtccaccctggagacgccggcctccatcctcctgcaggtctagtcagacgcctcagcatacngatagatacattattggattggtacctgacagaacgcgaggcagtcacacactctgtactcttagtttggtactacggtccggtccgtccgggccctgacgtgttcgaggtcggctggngactcgagctaagtacgttatttaaccgataaagaaatcgaaggctagggtaggtggaggtcgtaggggtaggtttacgggtttggtttaatcgtatacgtacgtcgaacggtaacggtaccctaaccgaaacctcgtaccgtaccggtacggacggaaccggtacaccgtacgtaggaactaacgtaaaccggngtaaggcgtacgtcacgtactacgtcgtttcg

SEQ ID NO: 422767 - DNA, 539 bp, Homo sapiens
  misc_feature: GZ8MTXP02FMA67.15.25.C03.1.454.CMB.2.raw
  modified_base (356)..(356): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactcctgatctatttgggttctaagtcgggcctccggggtccccctgacaggttcagtgcngtggatcgagcatagatttacactagaaatcagcagagtggagcgtagaggtacggtttggggtttattacgtgtcagtgacgaaggtactaacaaaccccgatactacccgttcggaccgagggaccacgaccgtaggacgtaacgttaaacgaacgtgtcggactcgacaccgatcgttcg

SEQ ID NO: 422768 - DNA, 609 bp, Homo sapiens
  misc_feature: GZ8MTXP02FWPOG.15.25.C03.1.454.CMB.2.raw
  modified_base (301)..(301): a, c, t, g, unknown or other
  modified_base (308)..(308): a, c, t, g, unknown or other
  modified_base (423)..(423): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctccagcatactgatggatacaacttattggattcggtacctgcaagaacgccgagggcagtctcccanaacctcngtatcttagtttgggttcaagtcgggcctcggggtcccctgacgtaggttcaggcggcaggtggatcgagtcagttagtatttaacataagaaaatcagtacagaggtaggacgngtaggagggtacggtttggggtttattacgtgcagtagacgtaacggtactaaccgaaaccccggtataccgtaccgttaccgggaccggaacggggaccaaccggtacccgttaggggaaacgtaaacgtttaaaaccgaaccgtaaggtcgggtaccgtaccgtacctaccgtacttaccgtcg

SEQ ID NO: 422769 - DNA, 603 bp, Homo sapiens
  misc_feature: GZ8MTXP02F5BG9.15.25.C03.1.454.CMB.2.raw
  modified_base (361)..(361): a, c, t, g, unknown or other
  modified_base (492)..(492): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctccagcatactgatggatacaactattggattggtacctgcagaagccagggcagtctccacaactcctgatctagtttgggttctaagtccgggccgtccggggtcccctgactaggttcagtggcnggtgatcgaggctaagtagtatttacactagaaaatcagacgagaggtaggaggtcgtaggtagggttacgggtttagggggtttaattacgtgtactagtagacgtaaggtacctaaaccgaaaacccgntaccgtaccgttaccgggaccggaacgggaccaccggtaccgtaagggtaacgtaaacgttaaaacggaacgttaaggtacggcgttacgaccaaccgtacgttactttcg

SEQ ID NO: 422770 - DNA, 688 bp, Homo sapiens
  misc_feature: GZ8MTXP02IPC4F.15.25.C03.1.454.CMB.2.raw
  modified_base (249)..(249): a, c, t, g, unknown or other
  modified_base (459)..(459): a, c, t, g, unknown or other
  modified_base (514)..(514): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtctccactcctccctgccccgtcacccctggagacgccggcctccatcctcctgcaggtctagtcagacgcctccagcatacngatggaatacaacttagttggattcggacctgacaggaacgccgagggctagtccctaccaaccaacttccgtagtacttcgtttagtttcgggtacttaacggtccggggtacccgttcccccggggtccctaggacgtaggttcaggttggcgtaaggtggaatcgaggtctaagtaagtaatttacaaacgtagaaaactgaacganaggtaaggtggaggtcgtagggtaagggttacgggttttagggtttaacttacgngtaacgagtacggaacgtaacggtaacctaaaccgtaaaccccgtacgtacccgtaaacccggttccggggaacccgggaacggggtaaccaacccgggtacccggtaaggtaaaaccgtaaacgtaaaaccgtaacgtcggtaacggtcgtaccgaccaaccgtttacgtccg

SEQ ID NO: 422771 - DNA, 650 bp, Homo sapiens
  misc_feature: GZ8MTXP02HKS3P.15.25.C03.1.454.CMB.2.raw
  modified_base (363)..(363): a, c, t, g, unknown or other
  modified_base (413)..(413): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagagcctccagcatactgatggatacaattattggattggtacctgacagagccaggcagtctccacactctgattcttagtttcggtactaacgtccgggccgtccggggtcccctgactacggttcaggtggcnggtgatcgaggctaatagtactttaacactaagaaactcgagtacgaagnggtaggaggacgtaggaagggttacggtttaggggttttaattacgttgacgtagtagaccgtaaaggttaccctaaaccgaaaaccccggtactacccgtaacccgtttaccgggtaccggaaccggggtaaccgaccggtacccggttagggtaaacgtaaaacgtttaaaaccggaacgttaacgggtacgggtaccttaacgggacctaacccgtaacgtttacctttaccgg

SEQ ID NO: 422772 - DNA, 594 bp, Homo sapiens
  misc_feature: GZ8MTXP02G970Y.15.25.C03.1.454.CMB.2.raw
  modified_base (356)..(356): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatcaagtggggatattgtgatgactcagtctccactctccctgcccgtcacccctggagacgccggcctccatctcctgcaggtctagtcagacgcctccagcatactgatggatacaactattggattggtacctgacagaacgccgagggcagtcctaccaacactctgatcttatttggtctaagtcggcctcgggtcccctgactagtcagtgcngtgatcgagcagtagtactttacactaagaaaatcgaagagaggtaggtacggaaggtcgtagggtaagggttacgggtttagggggtttaacttacgtgtacgtaagttcggaacgtaaacgggtacctaaacccgaaaccccgtatacccgaaccgttcgggaccggacggaccaccggtaccgtaggaacgtaaacgtaaacgaacgtgtacggctacgacaaccgtactcgtac

SEQ ID NO: 422773 - DNA, 552 bp, Homo sapiens
  misc_feature: GZ8MTXP02HSRYW.15.25.C03.1.454.CMB.2.raw
  modified_base (246)..(246): a, c, t, g, unknown or other
  modified_base (249)..(249): a, c, t, g, unknown or other
  modified_base (257)..(257): a, c, t, g, unknown or other
  modified_base (261)..(261): a, c, t, g, unknown or other
  modified_base (266)..(266): a, c, t, g, unknown or other
  modified_base (275)..(275): a, c, t, g, unknown or other
  modified_base (283)..(283): a, c, t, g, unknown or other
  modified_base (291)..(291): a, c, t, g, unknown or other
  modified_base (386)..(386): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtggggatattgtgatgactcagtctccactcctccctgccccgtcacccgtggagcgccggcctcatcctcctgcaggtctagtcagacgcctcagcatacngangatacatnttgntgacngcagagcgnggcagtcncacactcngatcttagtttggtctaagtccgggccgtcgggtcccctgacgtggttcaggtggcgtgtggatcgaggctagtataactttacaatagtaaaancgagagagaggaggaggtacggtaggtaggttagggtttaggttactacgtgtagagtacgaacgtaacgtacctaaaccgaacccgtacgtccgtaccgtacggacgacggacacgacgagaacgtaacgtaacgacgtggtcgacgtacactactacttcgtcg

SEQ ID NO: 422774 - DNA, 604 bp, Homo sapiens
  misc_feature: GZ8MTXP02G6ZMX.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagacgccggcctccatctcctgcaggtctagtcagacgcctcagcatactgatggatacaacttattggattggtacctgacagaacgccgagggcagtcctaccaactaactcctgattcttagtttcggtactaacgtccgggtccgtcccggggtccctgacgtaggttcaggttggctagtggactcgaggtctagtagtatttacactagtaaatcgagacgaggagtgggagtcgtaggtagggtcggtttaggggtttactacgtgactagtacgacgtaacggtcctaaaccgaaacccgtagtaccgtaaccgttcgggaccggacggtaccgacggtaccgtaggaacgtaacgttaaaacggtaacgtcggtacggactacggacaccgtacgttccg

SEQ ID NO: 422775 - DNA, 590 bp, Homo sapiens
  misc_feature: GZ8MTXP02HHEFQ.15.25.C03.1.454.CMB.2.raw
  modified_base (404)..(404): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagagccgaggcagtctaccacaactcctagatcttagtttggttactaagtccggggccgtccggggtcccctgactaggttcagtggcaggtggatcgagctagtagtatttacactagaaatcagcagngtaggagcgtaggaggtacggtttgggtttaattacgtgactagtacgacgtaacgtaccgtaaaccgtaaacccgtactaccgtaccgttaccgggaccggtaacgggaccgaccggaccgtaggaacgtaaacgttaaacggaaccgtggtacggtacgtacggacctacctacgttctttcgg

SEQ ID NO: 422776 - DNA, 667 bp, Homo sapiens
  misc_feature: GZ8MTXP02F05RE.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagcccggcctccatctcctgcaggtctagtcagagcctccagcatacgtgatggataacaattattggattggtacctgacgaagaacgccgagggctacgtcctaccaactaaccgtcctagtacttcttaagtttcggggttacctaaggtccggggtcccgttcccgggggttcccctaggaccgtagggtttccgaggtacggacgtggtgacgtacgagtactaagtttaacgttaactttaacgaaactaaagtaaactacgaacgaagaagtaggtaggtaggtacggtaggtacgggttacgggtttagggtttagttacgtagtacgtagtacgtacgtaacgtaaccgtaacccgtaacccgtaccgtaccgtaccgtaccggaccggacggacgaccgtacgtaacggtaacgtaaacgtaacgtacgtaacgtcgtacgtacgacgtactactacgtcg

SEQ ID NO: 422777 - DNA, 592 bp, Homo sapiens
  misc_feature: GZ8MTXP02JIATU.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagacgcctccagcatactgatggatacaacttattggattggtacctgacagaagccgagggcagtcctccaacaactcctgacttcttagtttgggttactaagtccgggccgtccggggtcccctgacgtaggttcaggtggcaggtggatcgagctagtagtatttacactaagaaaatcgagacgagaggtagggaacggtgtagggagggttacgggtttaggggtttaatacgtgactagtagacgtaaggtacctaaccgtaaacccgctaccgtaaccgtcgggaccggagggaccacggaccgtaggaacgtaaacgttaaaccgagtggtacggctacgaccaccgtatcgttac

SEQ ID NO: 422778 - DNA, 567 bp, Homo sapiens
  misc_feature: GZ8MTXP02F0F1K.15.25.C03.1.454.CMB.2.raw
  modified_base (359)..(359): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactcctgatctatttgggttactaagtcgggcctccggggtccccctgactaggtcaggtggcnggtgatcgagcagtagtatttacactagaaatcagacagagtggaggtctaggtaggtacggtttgggggtttaattacgtggctagtgacgtaacggtactaaaccaaaccccggtataccgtaaccgttcgggacccggagggaaccaccggtaccgtagggaacgtaacttaaacggaacgtgtacggctacgcactacgtctcg

SEQ ID NO: 422779 - DNA, 598 bp, Homo sapiens
  misc_feature: GZ8MTXP02JF86G.15.25.C03.1.454.CMB.2.raw
  modified_base (356)..(356): a, c, t, g, unknown or other
  modified_base (368)..(368): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccgagggcagtctccacaactctgatctatttgggttactagtccggcctccggggtcccctgacaggttcagtggcnggtgatcgaggnatagtatttaacactagaaatcagcgagagtggagcgtaggagggttaggtttaggggtttagttacgtgacgtagtcgtacgtaaacggtcctaaaccgaaaccccgtatacccgtaccgttaccgggaccggtaacggggaccgaaccggtaccgtaacgggtaaacgtaaaacgttaaaacgtaaccgtaaggtacggtcgtacgaccgtaaccacttcgtttaccg

SEQ ID NO: 422780 - DNA, 611 bp, Homo sapiens
  misc_feature: GZ8MTXP02ID5ZG.15.25.C03.1.454.CMB.2.raw
  modified_base (344)..(344): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccgaggcagtctccaacaactctgatcttagtttgggtactaagtccgggtcctccggggtccccngacgaggttcaggtggctggtgatcgaggcaagttagtacttttacactagtaaaatcgagacgaggaggtagggaaggtcgtaggagggttacggtttaggggtttacttacgtgactagtgacgtaaggtacctaaccgaaaccccgtactacccgtacccgttccgggaccggacgggaccgaccggtaccgtaacgggtaacgtaaacgttaaaacgaaacgtcggttacggaccgttacggaccgtaccgtacgttacttcg

SEQ ID NO: 422781 - DNA, 556 bp, Homo sapiens
  misc_feature: GZ8MTXP02IE30J.15.25.C03.1.454.CMB.2.raw
  modified_base (365)..(365): a, c, t, g, unknown or other
  modified_base (400)..(400): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactctccctgcccgtcacccctggagagccggcctccatctcctgcaggtctagtcagagcctccagcatactgatggatacaactatttggattggtacctgcaagaacgccgagggcagtctaccaacaacctctgatctagtttggtctaagtccgggcctccggggtcccctgaccgtaggtcagtggctgnggatcgagcagtagtactttacatagaaaatcagnagagtggagcgtagaggtacggtttgggtttatacgtgtacagtgacgtaaggtactaaccgaaacccgtatccgtaccgttaccggacgacggacgaccgaccgtaggacgtaaacgttaaaccgaagtcgtcggactcgacacctacttcgtcg

SEQ ID NO: 422782 - DNA, 627 bp, Homo sapiens
  misc_feature: GZ8MTXP02GA5GY.15.25.C03.1.454.CMB.2.raw
  modified_base (382)..(382): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgccagtctagtcagacgcctccagcatactgatggataacaacttagttggattcggtacctgacagaacgccgaggcagtcctaccacactctgtacttcgttagtttcggttactaacgtccggggtcccgttaccggggtcccctagacgtaggttcaggtcgcnggtgatcgagctatagttatttacataagaaactgaacgagagaggtaggaaggcgtagggaacgggttaacggtttggggtttaattaacgtgacttaaggtcgtaacgtaacggtacctaaacccgaaccgtacttaccgtaacccgttcgggaccggacggtaccacccggtacgtaaggtaacgtaaaacgttaaccggtaagtcggttacggacctacggacctaacgtactttacgtcg

SEQ ID NO: 422783 - DNA, 606 bp, Homo sapiens
  misc_feature: GZ8MTXP02IW18I.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagagccggcctccatctcctgcaggtctagtcagagcctccagcatactgatggatacaactatttggattggtacctgcagaagccagggcacgtctccacaactcctgattctatttgggtactaagtccgggcctcccggggtccctgactaggttcagtgcagtggatcaggcatagtatttacactagaaatcagcagagtggaggctaggaggtacggtttaggggtttacttacgtgtcgaagtcgagtaaacggttccaaaccgtaaacccccggattacccgaacccgtttaccggggacccggtaaacggggacccgaccggacccgtaggggtaaacgaacggtttaaaaaccgaaccgtagggttacggaccgttcggaaccctacccgtaactttccg

SEQ ID NO: 422784 - DNA, 571 bp, Homo sapiens
  misc_feature: GZ8MTXP02FHP65.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagagccggcctccatctcctgcaggtctagtcagagcctccagcatactgatggatacaactattggattggtacctgcagaagccaggcagtctccacaactcctgatctatttggttcaagtcgggtcctccccggggtccctgacaggttcagtggcaggtgatcgaggcatagtatttacactgaaatcagcagagtggaggcgtaggagggtacggtttagggggtttattacgtgtcagtcgacgtaaaggtacctaaccaaaaccccgacttaccgaacccgttcgggacccggacgggaaccacggtaccgtacgggaaacgtaacgttaaaacgaacgtggttacggactacgacaccctagttccg

SEQ ID NO: 422785 - DNA, 547 bp, Homo sapiens
  misc_feature: GZ8MTXP02JKA4G.15.25.C03.1.454.CMB.2.raw
  modified_base (399)..(399): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggataacaatattggattggtacctgcagaagccgaggcagtctccactactctgactcttagtttgggttactagtccggtccgtcggggtccccctgacctaggtcaggtgcgagtggatcgaaggcagtagtatttacactagaaaactnagcgagagtggagtgaggaggttacggttggggtttaattcgtagcatgacaacggtctaacgaacccgtatctaaccgttcggacgacggaccgacgtccgtacggagtaacgtaaacgacgtgtacggcacggctacacgttctcg

SEQ ID NO: 422786 - DNA, 635 bp, Homo sapiens
  misc_feature: GZ8MTXP02IHP9I.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtggggatattgtgatgactcagtctccactcctccctgcccgtccacccctggagacgccggcctccatcctcctgcaggtctagtcagacgcctccagcatactgatggatacaactatttggattgtacctgcaagaagccgaggcagtccaccacaactcctgattcttagtttggtactaacgtccggccgtccggggtcccctgacgtggttcaggtggcagggtgatcgaaggactagtaaagttactttaacaacgtaaagtaaaatcaaggacgaaggtaaggtagggacggtcgtagggtaagggttacgggtttaggggttttaaattacgttagactagtagtacgtaaacggtacctaaaccgaaaccccgtataccgtacccgtaccggaccggaacgggaaccgacgtaccggtaaggaacgtaaaacgttaaaacggacgtaacggtcggactacgactaccgtaattcgttaacg

SEQ ID NO: 422787 - DNA, 636 bp, Homo sapiens
  misc_feature: GZ8MTXP02G26HD.15.25.C03.1.454.CMB.2.raw
  modified_base (365)..(365): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatctgatggatacaactattggattggtacctgcagaacgccgagggcagtcctccaacaactcctgtatcttagtttgggttactaagtccgggcctccggggtcccctgacgtaggtcagtggcngtggatcgaggcaatagtatttacactagaaaatcgagacgaaggtaggtaggacgggtagtagggtaaggggtaacgggttttagggggttttaacttaaccgttggaccgtagtacggtaccgtaaacggttaccgtaaaccaaaaccccggtacttacccgtaaaccggttccgggaccggacggggaacctaccggtaccgttagggaacgtaaacgttaaaaccgacgttaaggtcggtacgtcggactaccgtactcgtttaccg

SEQ ID NO: 422788 - DNA, 636 bp, Homo sapiens
  misc_feature: GZ8MTXP02I0B86.15.25.C03.1.454.CMB.2.raw
  modified_base (392)..(392): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtggggatattgtgatgactcagtctccactcctccctgcccgtcacccctggagacggcccggcctccatcctcctgcaggtctagtcagacgcctccagcatactgatggatacaacttagttggattcggtactgacaggaacgccgagggctagtcctaccaactaacctcctagtacttcgtttagtttcggttactaacgtccggggtcccgttccggggtcccctagacgtaggtcagtgcnggtggatcgagctatagtatttacactagaaatcaagcgtaaggaggtaggaggtacgtagggtaagggttaacgggttttaggggtttaacttacggtgtactagtacgacgtaacggtacctaacccgtaaacccgtataccgtaacccgttcgggaccggtacgggaccgacggtaccgtagggtaacgtaaacgtaaaacggacgtggtacggaccgtacgaccacctacgttacgttcg

SEQ ID NO: 422789 - DNA, 659 bp, Homo sapiens
  misc_feature: GZ8MTXP02GYUX3.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagacgccggcctccatctcctgcaggtctagtcagacgcctccagcatactgatggatacaattattggattggactgacaagacgccgagggctagtcctaccaactaactcctagacttcgttagttttcgggttacctaacgtccggggtaccgttcccccggggtccctagtacgtaggttcaggtcgggctagtggatacgaggactagtagtactttacaatagaaatcaagcgaggagtgggacggtagtagggtaaagggttcgggttttagggtttactttacgaggtcgtaagttcgaacgtaaacgggttacctaaacccgaaaccccgtagtacccgtaacccggttacgggaacccggtacgggaaccgaaccggtacccggtaagggtaaaacgttaaaccgttaaaacggaagttacggacgggttacacggtaccaccgttacttccg

SEQ ID NO: 422790 - DNA, 602 bp, Homo sapiens
  misc_feature: GZ8MTXP02HI2UZ.15.25.C03.1.454.CMB.2.raw
  modified_base (291)..(291): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagagcctccagcatactgatggatacaactattggattggtacctgcagaagccgaggcagtcncacactcctgatcttagtttggttactaagtccgggccgtccggggtcccctgactaggttcaggtggctggtgatcgaggctagtagtactttaacactaagaaaatcgaagtcagtaggtggaggtacgtagggtacgggttagggtttagggggttttaatacgttgtactagtagacgtaacgggttacctaaaccgaaaccccgtatacccgtaacccgttcgggacccggaagggacctaccggtaccgtagggaacgtaaacgttaaaccgaagttcggtagctcgactacctagttccttacg

SEQ ID NO: 422791 - DNA, 581 bp, Homo sapiens
  misc_feature: GZ8MTXP02F29KC.15.25.C03.1.454.CMB.2.raw
  modified_base (415)..(415): a, c, t, g, unknown or other
  modified_base (480)..(480): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagagcctccagcatactgatggatacaacttattggattggtacctgacagaagccgagggcagtcctaccataacctcctgtatctagtttcgggtactaagtccgggcctccggggcccctgacctaggttcagtggactggtcggatcgagcatagtatttacatagaaatcagcagagtggagngtagaggtacggtttgggtttaatacgtgactagtgtacgaaggttaccaaccggtaaaaccccntacccgacgttccgggaccgaacggggaccacggtacccttagggaacgtaacgtaaaaccggaacgttggacggtcacggacccaactacgtcttaccgg

SEQ ID NO: 422792 - DNA, 727 bp, Homo sapiens
  misc_feature: GZ8MTXP02GBC28.15.25.C03.1.454.CMB.2.raw
  modified_base (701)..(701): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcaccctggagacgccgcctccatctcctgcaggtctagtcagacgcctccagcatactgatggatacacttagttggattggtacctgacagaacgccgagggcacgtctaccaactaacctctagtacttcgttagtttcggggtttactaacggttccggggtccccgttccgggggttcccccctaggaccgtacggggtttaccgagggttcggacgtaggggtcgggactacggaacggtctaagtttaacggtttaaacttttaaaccgtacgtttaaaggaaaaactcgaacggtaacgtaagggtaggttaggggacggtacggtacgggtaaggggttacggggttttagggggtttaacttacgtcggactacggtacgtaccgtaaacggttaacctaaacccgtaaaccccgtacgttacccgacccgttaccgggaccggtaacgggacgtacccggaccgtaaggtacgtaaaacgttaaaccgtaacgtggtaccggtacncggtacctaccgtaacgttctttccg

SEQ ID NO: 422793 - DNA, 577 bp, Homo sapiens
  misc_feature: GZ8MTXP02HS4AA.15.25.C03.1.454.CMB.2.raw
  modified_base (288)..(288): a, c, t, g, unknown or other
  modified_base (296)..(296): a, c, t, g, unknown or other
  modified_base (298)..(298): a, c, t, g, unknown or other
  modified_base (300)..(300): a, c, t, g, unknown or other
  modified_base (348)..(348): a, c, t, g, unknown or other
  modified_base (385)..(385): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactcctccctgcccgtcacccctggagagcccggcctccatcctcctgcaggtctagtcagagcctccagcatactgatggatacactattggattggtacctgcagagcaggcagtcncacactcngntntatttggtcaagtcgggcctccggggtcccctgacgaggtcagtggcnggtggatcgagctatagtatttacgatagaaatcagngaggagtaggaggcgtaggaggtacggtttgggtttacttagtgcagtggtacaacgggtacctaaccgaaacccgtactaccgtaccgttaccgggaccggaacggggtaccacccggacggttacgggaaacgtaaacgttaaaaccggaacgttggtacggtcgtcggacctaccgtacttccgtttcg

SEQ ID NO: 422794 - DNA, 613 bp, Homo sapiens
  misc_feature: GZ8MTXP02I4F2T.15.25.C03.1.454.CMB.2.raw
  modified_base (254)..(254): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatgatacatnttgatgacctgacagaagccaggcagtcacacactctgatcttagtttggtactaagtccggccgtccggggtcccctgaccgtaggttcaggtcggactaggtggaactcgaaggtctaagtaagttaacttttaacaacgttaagtaaaatccgaaggacaaaggtaggtagggaaggtcgtagggtaagggttacgggttttagggggtttaacttacggttagacgtagtacgacgtaaacggtacctaaaccgaaaccccgtatacccgtaaccgttccgggaccggaacgggaccgaccggtccgtaggacgtaaacgtaaacgacgtgtacgctacgaccacctatcgttcg

SEQ ID NO: 422795 - DNA, 636 bp, Homo sapiens
  misc_feature: GZ8MTXP02HCXFD.15.25.C03.1.454.CMB.2.raw
  modified_base (302)..(302): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagagccggcctccatcctcctgcaggtctagtcagagcctccagcatactgatggatacacttattggattggacctgcagaagccgagggcagtcaccacactccngtatctatttgggtactagtccgggtcctccccggggtcctgactaggttcagtggcagtggatcgagcatagtatttacactagaaatcagcagaggtggaggcgtaggtaagggtacggtttagggggtttacttacgtagtacgtagttacggaacgtaacgggttaacctaaacccgaaaaccccgtacgttacccgtaacccccggtttaccggggacccggaacgggggaacccaaccgggtacccgtagggaaaccgttaaacggtttaaaaacccggtaacgttacgggtacgggttcgaccggtaccgaaccgttacgtttaccg

SEQ ID NO: 422796 - DNA, 629 bp, Homo sapiens
  misc_feature: GZ8MTXP02JNOCE.15.25.C03.1.454.CMB.2.raw
  modified_base (243)..(243): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagagcctcagcatacngatggatacaactatttggattcggtacctgacaagaacgccgagggcagtctaccaacaactcctagattcttagtttcgggttactaaacgttccggggcccgtccggggtcccccctgacgtacggtttacaggtcggactaggtggactcgaggctaagtaagtactttaacactaagtaaaatcgagacgaagaggtaggaggctagggtaacgggttaggtttagggtttattacgtgtacgtagtcgaacgtaacggtacctaaaccgaaacccgtataccgtaccgttcggaccggaacgggaccaccgtaccgtaacggaagtaaacgttaaacgtaacgtcgtacggactacggtacctaccgtacgtactttccg

SEQ ID NO: 422797 - DNA, 619 bp, Homo sapiens
  misc_feature: GZ8MTXP02GGF59.15.25.C03.1.454.CMB.2.raw
  modified_base (353)..(353): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagacgccggcctccatctcctgcaggtctagtcagacgcctccagctatactgatggatacaactatttggatttggtacctgacagaacgtccgagggcagtcctccacaactcctgattcttagtttggtactagtccgggcctccccggggtccngacgtaggttcagttggcaggtggactgagacatagtatttacaactagaaatcgagagagaggtcggagacgtaggagggttacgtttggggtttattacgtgagagtacgacgtaacggtactaaaccctaacccggtactacccgtaacccggttccgggaccggacgggtacccgaaccggtaccgggtaacggggtaaaacttaacggtaaacgtcggtacggtccgtacggtaccgtacccgttaacttccggtttaccg

SEQ ID NO: 422798 - DNA, 562 bp, Homo sapiens
  misc_feature: GZ8MTXP02GUYGV.15.25.C03.1.454.CMB.2.raw
  modified_base (278)..(278): a, c, t, g, unknown or other
  modified_base (290)..(290): a, c, t, g, unknown or other
  modified_base (396)..(396): a, c, t, g, unknown or other
tcagtctacgtagccacgaccggtgctcgatttagtagtgtagatttgggtttgggggatcaggactcctcagttcaccttctcacaatgaggctccctgctcagcttctggggctgctaatgctctgggtctctggatccagtggggatattgtgatgactcagtctccactctccctgcccgtcacccctggagagcccggcctccatctcctgcaggtctagtcagagcctccagcatactgatggatacaactattgattggtacctgcagaanccgaggcagtcncacactctgatctatttggtctaagtcggcctcggggtcccctgacaggtcagtggcagtggatcgaggcatagtatttacacgtagaaatcagcagagtggaggngtaggaggtaggttaggtttattacgtgactagtagacgtaacggtacctaacccgaaacccgtactaccgtacccgttcggaccggaacggaccgacggtacgacggtaacgtaaacgtaaaacggtacgtggtacggacgtacgacctaaccgtacttccgtcg

SEQ ID NO: 422799 - DNA, 564 bp, Homo sapiens
  misc_feature: GZ8MTXP02HI68A.15.25.C03.1.454.CMB.2.raw
  modified_base (356)..(356): a, c, t, g, unknown or other
  modified_base (403)..(403): a, c, t, g, unknown or other
  modified_base (468)..(468): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactcctgatcttatttgggtactaagtccgggcctcggggtcccctgactggttcagtgcngtgatcgagctatagtatttacactagaaatcagcagagtcggaggntaggaggtacggtttggggtttattacgtgctagtgacgtaaggtacctaaccgaaaccccggtntaccgtaccgttcggaccggagggaccgaccggtccgtaggaacgtaacttaaacggaacgtggttacggcttacggacctacccgtatcgtttcg

SEQ ID NO: 422800 - DNA, 575 bp, Homo sapiens
  misc_feature: GZ8MTXP02JG0X5.15.25.C03.1.454.CMB.2.raw
  modified_base (363)..(363): a, c, t, g, unknown or other
  modified_base (391)..(391): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagacgcctccagcatactgatggatacaacttattggattggtacctgcagagccagggcagtctcactaactctagatctatttgggtctacgtcgggccgtccgggtcccctgactgtcagtgcagtgatgagnatagtatttacatagaaaatcagacagnggtaggacgtcgtagtagggtacggtttaggggtttactacgttggactagtcgacgtaacgtaccgtaaacccgtaacccgacttaccgtaccgttcccggaccggtacggacccgaccggtaccgtaaggaacgtaaacgttaaacgaacgttggtacgtcgacgtacaccgtatcgtttcg

SEQ ID NO: 422801 - DNA, 738 bp, Homo sapiens
  misc_feature: GZ8MTXP02I6OZ6.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctccagcatactgatggatacaattattggattcggtacctgcagaacgccgagggcagtcctccaacaacctcctagtacttctttagtttcgggttacctaacgtcccggggaccgttccccggggtcccctgaccgtgggttccgaggttcggcgtagggtgacgtcgaacggctaagttaagttaacttttaaccaagttaaagtaaaaactcgaaggacgtaagggacggtaggggaaggtccggttagggaaggggtttaaccggggtttttagggggttttaaactttaccggttaggtaccgttaaggttacggaacgtaaaaccggggttaccctaaaacccgtaaaacccccggtacttacccggtaaacgtttccccgggaccgggaaacgggaacccgtaccggtccgtaaacggggtaacgtaaaaccgtttaaaaccggaacgttaacgggtaacgggtcttaaccggacctaccgtaacttacgtttaccg

SEQ ID NO: 422802 - DNA, 667 bp, Homo sapiens
  misc_feature: GZ8MTXP02GFMDW.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtgggatattgtgatgactcagtatccactctccctgcccgtcacccctggagagccggcctccatcctcctgcaggtctagtcagacgccctccagcatactgatggatacaacttatttggatttcggtacctgacaagaacgccgagggcagtcctaccaacaactcctagacttcgttagttttcggtactaacgtccggggtcccgttccccggggtccctgaacgtaggtttcgaggttcggcaggttggacttcgaggtactaagtaagttaacttttaacgaacttaagaaaatcgaagacgagtaaggtggaggtacgtagggtaacgggttacggtttaggggtttaattacgtagtacgtagtacgacgtaacggtacctaaacccgaaaccccgtatacccgtaacccggttaccgggaccggaacggggaaccaccggtaccgtaggaaacgttaaacgttaaaaccggaaccgttaggtacggtacgtacggacctaaccgtactttccg

SEQ ID NO: 422803 - DNA, 675 bp, Homo sapiens
  misc_feature: GZ8MTXP02FXRDX.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctcagcatactgatggatacaacttattggattggtacctgacaggaacgccgagggcagtcctaccaactaacctcctagacttcgttagtttggggttacctaaggtcccgggtacccgttcccggggtcccctagaccgtagggtttcgaggttcggacgtaggtggactacgacgggtactaagttaagttactttttaacaacgttaagaaaactcgagtacgaggaggtaggaggtcgtagggtagggttacgggtttagggtttaattacgtagctaagtcgaacgtaacggttaacctaaccgtaaaaccccgtactacccgtaacccggttaccgggaccggtaacgggaccaccggtaccggtaacggtaacgtaaaaccgttaaaacgaacgttggtacggtacgttacgaccgtaccgtacttcgtttacg

SEQ ID NO: 422804 - DNA, 550 bp, Homo sapiens
  misc_feature: GZ8MTXP02GEYKP.15.25.C03.1.454.CMB.2.raw
  modified_base (300)..(300): a, c, t, g, unknown or other
  modified_base (330)..(330): a, c, t, g, unknown or other
  modified_base (334)..(334): a, c, t, g, unknown or other
  modified_base (338)..(338): a, c, t, g, unknown or other
  modified_base (343)..(343): a, c, t, g, unknown or other
  modified_base (379)..(379): a, c, t, g, unknown or other
  modified_base (451)..(451): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcagcatactgatggatacaactattggattggtacctgcagagccagggcagtctcacactctgatntatttggtcatcgggcctccggggtccccngacngtcngtgcngtgatcgagcatagtatttacatagaaatcagcagngtggaggctaggaggtacggttggggtttaatacgtgcagtcgacgtaacggtcctaaaccgaaaccccgtntaccgaccgttccgggaccggacgggacaccggcgtacgggaagtaaacgttaaacggacgttaaggtcggtaccgtagacccgtactatccgtttacg

SEQ ID NO: 422805 - DNA, 630 bp, Homo sapiens
  misc_feature: GZ8MTXP02JVLSH.15.25.C03.1.454.CMB.2.raw
  modified_base (380)..(380): a, c, t, g, unknown or other
  modified_base (387)..(387): a, c, t, g, unknown or other
  modified_base (412)..(412): a, c, t, g, unknown or other
  modified_base (421)..(421): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtggggatattgtgatgactcagtctccactctccctgcccgtcaccctggagcgccggcctccatctcctgcaggtctagtcagacgcctccagcatactgatggaatacaacttagttggattcggtactgacaaggaacgtccgagggctagtcctaccaactaacctcgtagtacttcgttagtttcggtactacggtccggccgttccggggtcccctgacgtgtcaggtgnaggtcgntcgagactatagtatttacagtaanaactcgagngagaggtgggagacgtagggtaggttacggggtttgggtttaatcgttaggatagtcggtaacgtaacggttaacctaaacccgaaaccccggttataacccgtaccggttacccggaccggtaacgggaccaccggtaccgtaaggtaacgtaaaacgttaaacgtacgtcggttacggtaccgtacgtacctaccgtacttcgtacg

SEQ ID NO: 422806 - DNA, 657 bp, Homo sapiens
  misc_feature: GZ8MTXP02HVPDK.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtgggatattgtgatgactcagtctccactctccctgcccgtcaccctggagagccggcctccatctcctgcaggtctagtcagacgcctccagcatactgatggatacaacttagtttggattggtacctgacaagaacgccgagggcagttccaccaactaacctcctagactttcgttagttttcgggttactaaacgtcccggggtacccgttcccggggttccccctaggtaaccgtagggtttccaggttcggactagggtggactcgaaggctaagtagttactttaacaactaagaaaatcagacgaaggagtggaaggcgtagggaacggttacgggttttggggtttaaacttacgtgacgtagtacgacgtaaacggtacctaaaccgtaaacccgtagtaccgtaaccgttaccggggaccggaaacgggtaccgaccggtaccggtaaggtaactaaacgttaaacgaacgttggtcgacgtcacaaccgtatttccgtcg

SEQ ID NO: 422807 - DNA, 644 bp, Homo sapiens
  misc_feature: GZ8MTXP02I6OIG.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagacgccggcctccatcctcctgcaggtctagtcagacgccctcagcatactgatggatacaacttattggattcggtacctgacaagaacgccgagggcacgtcctaccaactaactcctagtattcgttagttttcgggttactaacggtccggggtcccgttccccggggtccctggacgtaggttcaggttcggcgtagtggactcgagtctaagttacgtactttacgacttagaaactcgagtacgaggtaggtagggagtcgtaggtaagggttacgggttttaggggtttacttacgtgtacgtaagtcgacgtaacgtaccctaaaccgtaacccgtatacccgtaccggttaccgggaccggacgggtaccgaccggtacgtacggaaacgtaacgttaaacggaacgttggtacgtcgtacgacctacgtactttccg

SEQ ID NO: 422808 - DNA, 538 bp, Homo sapiens
  misc_feature: GZ8MTXP02FUWD9.15.25.C03.1.454.CMB.2.raw
  modified_base (355)..(355): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggatggtacctgcagaagccagggcagtctccacaactcctgatctattgggttctaagtcgggcctccggggtccccctgacaggttcagtggcnggtggatcgaggcaatagatttacactagaaaatcagcaagagtggaggctaggaggtacggtttaggggttattacgtgcagtgacaaggtacaacgtaaaccccgatacctaccgttcggaccggacggacacgacctaggaacgaacgttaaacgacgtaagtggctacgcacactctcg

SEQ ID NO: 422809 - DNA, 586 bp, Homo sapiens
  misc_feature: GZ8MTXP02FVOOA.15.25.C03.1.454.CMB.2.raw
  modified_base (164)..(164): a, c, t, g, unknown or other
  modified_base (414)..(414): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactnagtatccactctccctgcccgtcacccctggagagccggcctccatcctcctgcaggtctagtcagagccctccagcatactgatggatacaacttatttggatttggtacctgacaagaacgccgagggcacgtcctaccaacaactcctagattcttagtttggtactaagtccgggtccgtcccccggggtcctgacaggttcagtggcgagtggatcgagacatagtatttacatagaaatcaganagagtggagcgtggaggtacggtttagggtttactagtgacgtatcgacgtaacggtactaaacccgaacccgtacgtaccgtacccgttacggacgaacgggaccacgtaccgtaggaaacgtaacgttaaaacgaagttacggtacggtactacggacctaacctattcg

SEQ ID NO: 422810 - DNA, 575 bp, Homo sapiens
  misc_feature: GZ8MTXP02GTBVJ.15.25.C03.1.454.CMB.2.raw
  modified_base (287)..(287): a, c, t, g, unknown or other
  modified_base (347)..(347): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcagcatactgatggatacaactattggattggtacctgcagagccaggcagtcncacaactctgatctattggtctaagtccgggcctcggggtcccctgctaggttcagtgcngtggatcgagcaatagtatttaacactagaaaatcagactagagtagggaggctaggagggtacggtttggggtttaagttactgctagtgacgtaaacggtctaaaccgaaaccccgtataccgtaacccgttcccgggaccggaacgggacctaccggaccgtacgggaacgtaaacgtttaaacggaaccgtaaggttcggacgtcgaccacctacgtcgttacg

SEQ ID NO: 422811 - DNA, 688 bp, Homo sapiens
  misc_feature: GZ8MTXP02GOJ6Y.15.25.C03.1.454.CMB.2.raw
  modified_base (229)..(229): a, c, t, g, unknown or other
  modified_base (269)..(269): a, c, t, g, unknown or other
tcagtctacgtagccacgaccggtgctcgatttagtagtgtagatttgggtttgggggatcgaggactcctcagttcaccttctcacaatgaggctccctgctcagctcctggggctgctaatgctctggtctctggatccagtgggatatgtgatgactcagtctccactctccctgcccgtcacccgtggagacgccggcctcatctcctgcaggtctagtcagacncctcagcatactgatggatacacttattggattggtaccngacagacgcgaggctacgtcaccaactaactcgtagtacttcgtttaggtttcgggtactaacggtccggggtcccgtccggggtacccctagaccgtaggttcgaaggtcggacgtagggtgacgtacgaggtactaagtttaacgttaaatttaaacgaaacgttaaacgaaaacgtaacgaacgacgaggtaaggtaggtaggtacggtaggtacgggttaacgggtttacgggtttaacgttacgtacgtacgtacgtacgtaacgtaaccggtaaccgtaaacccgtaaaccccgtaaccgtaaccgtaccggtaccgggaccgggaacggaaccgaccggtaccgtacggtaacgtaaacgttaaacgtaacgtaacggtacggtacgtacgtaccgtacctacttacgttcg

SEQ ID NO: 422812 - DNA, 586 bp, Homo sapiens
  misc_feature: GZ8MTXP02F7AF5.15.25.C03.1.454.CMB.2.raw
  modified_base (363)..(363): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccgagggcagtctaccacaacctcctgatcttagtttcgggttactaagtccggccgtccggggtcccctgactaggtcagtgcngtgatcgagctatagtatttacactagaaatcagacgagagtgggaggcgtaggaaggttacggtttaggggtttattacgtgacgtagtaggacgtaaggtacctaacccgaaacccgtacgtaccgtaccgttcggaccggacgggaccacggtaccgtaggaacgtaacgtaaaaccgtaacgtaaggtacggtacgtacgaccacctacgttacgttcg

SEQ ID NO: 422813 - DNA, 602 bp, Homo sapiens
  misc_feature: GZ8MTXP02HT0UA.15.25.C03.1.454.CMB.2.raw
  modified_base (279)..(279): a, c, t, g, unknown or other
  modified_base (304)..(304): a, c, t, g, unknown or other
  modified_base (423)..(423): a, c, t, g, unknown or other
  modified_base (498)..(498): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtggggatattgtgatgactcagtctccactctccctgcccgtcacccctggagagccggcctccatctcctgcaggtctagtcagagcctcagcatactgatgaatacaactattggattggtacctgcagaacncgaggcagtcaccacactctgattntagtttggtctaagtccgggccgtccggggtcccctgacgtggtcaggtcgctaggtgatcgagactaagtacgttactttacaaactaagaaaatcgagacgaggtagggtaggaggngtagggtacgggttaagggtttggggtttaatacgtagactagtagtacgaacggttactaaaccgtaaacccgntacccgtaaccggttccgggaaccggacgggaccgaccgtacggtaacggaagttaaacgtaaacgaacgtcggtcggactacggacctacctagttcctttcg

SEQ ID NO: 422814 - DNA, 542 bp, Homo sapiens
  misc_feature: GZ8MTXP02J3D2T.15.25.C03.1.454.CMB.2.raw
  modified_base (180)..(180): a, c, t, g, unknown or other
  modified_base (374)..(374): a, c, t, g, unknown or other
  modified_base (471)..(471): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctncccgtcacccctggagagccggcctccatctcctgcaggtctagtcagacgcctccagcatactgatggatacaactatttggattggtacctgcagagccgagggcagtctccaacaactcctgattcttattttggggtttctaaagttccggggccctccgggggtaccccctggaccaggttcagtggcngtgatcgagcatagattttacactagaaatcagcagagtggaggctaggaggacgtttggggtttaattctgcatgcaaggtctacaaacccccggntccgaccttccgggaccgaggggaccacgccgtaggaacgacttaacgactgtcggctgcaccatcgttcg

SEQ ID NO: 422815 - DNA, 745 bp, Homo sapiens
  misc_feature: GZ8MTXP02FSCT1.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatcagtgggatattgtgatgactcagtctccactctccctgcccgtccaccccgtggagacgcccggcctccactcctccccgcaggtctagtcagacgccctcagcatactgatggactaacaacttagtttggattcggtaacctgacaagaacgccgagggcacgtcctaccaacaactcctagtacttcgtttagtttcgggttaccttaacggtcccggggtcccgttaccccgggggttccctacggtaaccgtacgggtttacgaagggttcggaccgtaagggttgggaactaccggaagggtacctaaagttaacggttaaactttttaaaccaaacgttaaagtaaaaactcgaaagtacgaaggtaaggtagggaaggtacggtagggtaaacggggttacggtttaggggtttaattaacgtggacgtagtacggaacgtaaacgtacctaaacccgaaacccgtactacccgtaacccgttcgggaacccggaacgggaccgtaccggtaccggtaggtaaaacgtaaacgttaaaaccggtaacgtagggttcggactaccggtaaccacccgttattaccgttacgtttaccc

SEQ ID NO: 422816 - DNA, 522 bp, Homo sapiens
  misc_feature: GZ8MTXP02FYF1I.15.25.C03.1.454.CMB.2.raw
  modified_base (353)..(353): a, c, t, g, unknown or other
  modified_base (361)..(361): a, c, t, g, unknown or other
  modified_base (390)..(390): a, c, t, g, unknown or other
  modified_base (393)..(393): a, c, t, g, unknown or other
  modified_base (400)..(400): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactcctgatctatttgggttctaagtcggccgtcggggtcccctgacagttcagtgcnggtggatnaggctatagtatttacactagaaatcagnagngtggagngtagaggtacgttggggttatcgtgcatgacgtaggtacaccgaaacccactacgtaccgtcggacgacgggacacgccgtggacgtaacgtaaacgactggtacgctcgcactactacctg

SEQ ID NO: 422817 - DNA, 649 bp, Homo sapiens
  misc_feature: GZ8MTXP02FKG7Y.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctcgcccgtccacccctggagacgccggcctccatcctcctgctaggtctagtcagacgcctccagcatacgtgagttggaataacaacttagtttggattacggtacctgacaagaagccgagggcagtcctacactacctcctgtacttcttagtttgggttactaacgtccgggtcccgtccgggtccccctaggactaggttcgaggtcggcgtggtgggactacgagactagtaagttatttaacactaagaaaatcgagacgaggaggtaggaggtctagggtagggttacgggtttaggggtttaatacgtgtactaagttgaacgtaacggtacctaaacccgtaaacccgtagtacccgtaccggtaccggaccggaacggggacctaccggtaccggtaaggaacgttaaaacgtaaaacggaccgttaaggtcggactaccgactacctacgtctttccgg

SEQ ID NO: 422818 - DNA, 661 bp, Homo sapiens
  misc_feature: GZ8MTXP02GV6AD.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcaccctggagacgccggcctccactctcccgcaggtctagtcagacgcctccagcatactgatggatacaacttagttggattcggtacctgacagaagccgagggcagtcctacccaacaacctcctagtacttcgttagttttggggttacctaaacggtccgggtccccgtacccggggttccacggactacggttaccgaggttcggcgtaggtggggaactcggaggctaagttagtaacttttacaacgtagaaaatcgaagtacaggaggtgggaggtcgtagggtagggtacggtttagggggtttacttagtgtacgtagttacgacgtaacggtacctaaccgaaaccccgtacgtaccgtacccggtcgggaccgggaaccgggaccaccggtacgtaggtaacgtaaacgtaaaccggtatacgggtaagtccgtacgacaaccgtacgtccgttcgtttacc

SEQ ID NO: 422819 - DNA, 607 bp, Homo sapiens
  misc_feature: GZ8MTXP02HI786.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagagccggcctccatctcctgcaggtctagtcagacgcctccagcatactgatggatacaacttattggattggtacctgcagaacgcagggcagtctccacaactcctgattctagtttgggtactaagtccggggtccgtccccggggtccctaggactaggttcaggtcggcgaggtggatcgaggtctatagtatttacactagaaatcagacgagaggtagggaggtcgtagggtagggttacggtttaggggtttactttacgtgtacgtagttacgacgtaacggtacctaaaccgtaaaccccgtactaccgtaccgttacgggacccggtacggaccgacggtccgtacggaacgtaaacgttaaacgtaacgtcgtacggtctacgacctaccgtacttccg

SEQ ID NO: 422820 - DNA, 630 bp, Homo sapiens
  misc_feature: GZ8MTXP02I08WO.15.25.C03.1.454.CMB.2.raw
  modified_base (346)..(346): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcaccccctggagagccggcctccatctcctgcaggtctagtcagagcctccagcatactgatggatacaactatttggattggtacctgcagaagccagggcagtctccacaactcctgatcttatttgggtctaagtcggcctccggggtccccctgacnggttcagtcggcaggtggatcgagggtcaattagtacttttaacactagaaaatcagcagaggtggaggcgtaggagggtacgtttagggggttttattacgtgtacgtagtacgacgtaagggtactaacgtaaaaccccgtacttaaccgtacccgtttaccgggaccgggacggggaaccgtaccggaccggttaacgggtaaacgtaaaacgttaaaaccggtaaaccgttaaggggtacgtccggttacggacccgtaacccgtattccgttttaaccg

SEQ ID NO: 422821 - DNA, 725 bp, Homo sapiens
  misc_feature: GZ8MTXP02HXN5J.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcaccccgtggacgacgccggcctccatcctcctgcaggtctagtcagacgcctcagcatactgatggatacaacttagttggattcggtacctgcagaacgcgagggcacgtcctaccaacactcctagtacttcttagttttcggttactaacgtcccggggcccgttcccggggtcccctggtaccgtaggttacgaggttcggcgtagggttaggatacgaggggtactaagttaaggttaactttttaaccgaaagttaagtaaaactcgaacggacgtaaagggtaggtagggaagggtcggtaaggggtacggggttaacgggttttagggggttttaaaccttaggttacgacgttaagtacgggaaccgtaaacgggttaacccttaaaaccccgaaaccccgttacgtaccccgtaaccgggttacccgggacccgggtaaacgggacctaacccggtccggttaaagggaacgttaaacgtaaaaccggtagtaaggttcggactacggaccacggtacttcgtttccg

SEQ ID NO: 422822 - DNA, 592 bp, Homo sapiens
  misc_feature: GZ8MTXP02F2WKM.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagagccggcctccatctcctgcaggtctagtcagagcctccagcatactgatggatacaactatttggattggtacctgcagaagccagggcagtctccacaactcctgatctagtttgggtctaagtcgggcctccccggggtccctgactaggttcagtggcagtggatcgaggcatagtatttacactagaaatcagacagaggtggaggacgtggtagggtacggtttaggggtttaattacgtgtacgagtacgacgtaacggtcctaaaccgaaaccccgtatacccgtacccgttaccggaccggaacgggaccgaccggtaccgtacgggaacgtaacgttaaaaccgaacgttacggtacggtcctacgacctaacccgtagttaccg

SEQ ID NO: 422823 - DNA, 624 bp, Homo sapiens
  misc_feature: GZ8MTXP02JSTLH.15.25.C03.1.454.CMB.2.raw
  modified_base (291)..(291): a, c, t, g, unknown or other
  modified_base (300)..(300): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcaccccgtggagacgccggcctccatctcctgcaggtctagtcagacgcctccagcatactgatggatacaactattggattggtacctgcagagcgaggcagtcnccacactcngtatcttagttggtactaagtccgggtccttccggggtccccctggacgtacggttcaggttcggacgtaggtcgactacgaggctaagttaacgttactttaacacgttaaagaaaactcgaagtacgtaaaggtaggtaggggtacggtacggttagggtaacggggtttaacggggttttagggtttaaacgttacggtgtacgtaggtacgacgtaacggtacctaaacccgaaacccgtgtacccgtacgtccggacgtacggaccacggtacgtacggaactaacgtaaacgcgtaaggcgactcgacactctcttcg

SEQ ID NO: 422824 - DNA, 666 bp, Homo sapiens
  misc_feature: GZ8MTXP02IU952.15.25.C03.1.454.CMB.2.raw
  modified_base (301)..(301): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagacgccggcctccatctcctgcagtctagtcagacgcctccagcatactgatggataacaacttattggattggtacctgcagaacgcgagggcagtctcccaanactcctgattcttagtttgggttactaacgtccggggtccgtccccggggtccctgacgtacggttcgaggttcgcgagtggactcgagggactagttagtacttttaacgactagaaacttcaagcgaggtaggtcgggaaggtacgtagggtacggggttaacgggtttagggggttttaaacttacgtcggtacgtaagtcggtaacgtaaacgggttacctaaaaccccgaaaccccgttaacgtacccgtaacccggtttaccggggaccggaaccgggggaaccttaccgggaccgtaggggaaaaccgttaacgtaaaacggtaacgtcggttacggacgttcgacctacgtacttcg

SEQ ID NO: 422825 - DNA, 620 bp, Homo sapiens
  misc_feature: GZ8MTXP02H4ISH.15.25.C03.1.454.CMB.2.raw
  modified_base (371)..(371): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgccccgtcacccctggagacgcccggcctccatcctcctgcaggtctagtcagacgcctccagcatactgatggataacaactagtttggattggtactgcagacgccgagggcagtcctccactaacctctgattcttagtttggtactacgtccgggccgtccgggtcccctgacgtaggtcagtggcnggtggatcgagctaagtagtatttacatagaaatcagcgaggtaggtagggagtcgtagggtagggttacgggttttaggggtttattacgtgactagtgaacgtaacgtacctaaaccgaaacccgtacgtaccgtaccggttccgggaccggtacggtaaccgtaccgtaccggtaaggtaacgtaaaacgttaaacccgtaaggttcggtacggacgttacggacctacccgtagttcctttaccg

SEQ ID NO: 422826 - DNA, 639 bp, Homo sapiens
  misc_feature: GZ8MTXP02JQDMM.15.25.C03.1.454.CMB.2.raw
  modified_base (498)..(498): a, c, t, g, unknown or other
tcagtctacgtagccacgaccggtgctcgatttagtagtgtagatttgggtttggggtgatcagggactcctcagttcaccttctcacaatgaggctccctgctcagctcctggggctgctaatgctctgggtctctggatccagtggggatattgtgatgactcagtatccactctccctgcccgtcacccctggagacgcccggcctccagtctcctgcaggtctagtcagacgcctcagcatactgatgatacacttagttgattggacctgacagaacgcgaggcatcctaccacaactcctagtacttacgttagtttcggtactaagtcccggggtaccgttcccccggggtacctaggtaaccgtaggttcgaaggtcggacgtagggttaggactaccgaggtactaagttaaacgttactttaacaactagaaactcgagagaggaggtaggacgtgtagggtaaaggttacggtttgggttacttagngtacgatacgacgtaaacgttcaaaacccgaacccgtagtcccgtaccgtacgggaccggaacggacgaacgtccggtaaggaacgttaaacgttaaaccgaacgtggttaccggacgtaaccgaccgtaactctttaccg

SEQ ID NO: 422827 - DNA, 650 bp, Homo sapiens
  misc_feature: GZ8MTXP02JMOKN.15.25.C03.1.454.CMB.2.raw
  modified_base (502)..(502): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcaccctggagcgccggcctccatcctcctgcaggtctagtcagacgccctcagcatactgatggactactaacttagtttggatttcggtacctgacgagaacgccgaggctagtccaccaacaactcctagtattaccttagttttcggttactacggtccggggccgttcccccggggtccctaggactagggttcacggtgcgtaggtggtactcgagggtactagttaagttactttacgactagaaatcgaagacgaggaggtagggagacggtaggtaggggttacggtttagggggtttactttacggngtacgtagtacgaacgtaacggtacctaaacccgaacccgtacgtaccgtacccggtaccggacgggaacggaccgtacggtaccgtaaggtaaacgtaaacgttaaacgtaacgttcggtacgtccgtacgacctaacgtacgttcg

SEQ ID NO: 422828 - DNA, 686 bp, Homo sapiens
  misc_feature: GZ8MTXP02HI4N4.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcaccctggagacgccggcctccatctcctgcaggtctagtcagacgcctccagcatactgatggatacaactagttggattggtacctgacagaagccgaggcagtctaccacaactcctagatcttagtttggtactaacggtccggggtcccgttcccggggtcccctaggtacgtagggtttccaggttcgggacgtagggttcgggaacttcggaacgggtactaagttaaacggtttaaactttttaaaccgaacttaaacggtaaaaaattccgaaaggacgaaggtaaggggttgggaaacgggtcgttagggaaggggttaaccgggttttaggggtttaacttacgttgactagtgacgtaacggtacctaaaccgaaacccgtactaccgtaccgttacgggaccggaacgggaccgtaccggaccgttaagggaaacgttaaacgttaaaacgacgttgtacggacgtacgaccaaccgtatcggttacg

SEQ ID NO: 422829 - DNA, 696 bp, Homo sapiens
  misc_feature: GZ8MTXP02IEYNW.15.25.C03.1.454.CMB.2.raw
  modified_base (437)..(437): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactctccctgcccgtcacccctggagacgccggcctccatcctcccgcaggtctagtcagacgcctccagcatactgatggaatacaactattggattggtacctgacagaacgccagggcagtctaccacaactctgatctttagtttggttctaacgtccggggtcccgtcccggggtcctaggaccgtaggttcgaggtcggccgtaggttcggggaattccgagggtacctaagttagtacttttaacaacgttaagaaaactnacgagtaagaggtacgggaagcgtagggtagggttaggtttagggggttttaaacttccgtggtaccgtagtagggtaaccgtaaacggggttacctaaaacccggaaaccccggtaattcccgtaaacccgggttccgggacccgggtaacggggaaccaccggtacccgttaaaggggaaacttaaaccgtaaaacggtaccgtggttaacgggccgttagaccccctaaacgtaccgtttacgtacgttttccccg

SEQ ID NO: 422830 - DNA, 687 bp, Homo sapiens
  misc_feature: GZ8MTXP02J1WHX.15.25.C03.1.454.CMB.2.raw
  modified_base (387)..(387): a, c, t, g, unknown or other
  modified_base (396)..(396): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtccacccgtggacgacgcccggcctccactcctcctgcaggtctagtcagacgccctcagctatactagatagataactaacttgttggtattcggtacctgacaaggacgccgaggcacgtccaccaactacctctagtacttcgttagtttcggttactacggtccgggtccggtccgggtcccctagacgtacgttcgnggtcgacgnggtcgactcgagtattaagttagttactttaacgaacgtaaagaaactacgacgtagtagggtaggtagggggtacggtacggttaggggtaacggggtttaccggggttttaggtttaaacgtcgtaggtacgtacgtacggtaaaccgtaacggttacccgaaaaccccgttacccgcgtaacccgtaccgggtcggaaccggtaacggtaccgaccgtaacggtaggaaacgtaaacggtaaccgtagggtcgtacggtactcgtaccaccgttacgttctttacccg

SEQ ID NO: 422831 - DNA, 585 bp, Homo sapiens
  misc_feature: GZ8MTXP02IZCNZ.15.25.C03.1.454.CMB.2.raw
  modified_base (350)..(350): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatactctgggtctctggatccagtggggatattgtgatgactcagtctccactctccctgcccgtcacccctggagagccggcctccatctcctgcaggtctagtcagagcctccagcatactgatggatacaactattggattggtacctgcagaagccagggcagtctccacaactcctagattctagtttgggttactaagtccgggtccgtccggggtcctgacgngttcagtggcagtggatcaggcatagtattttacaactagaaaatcagacagagtggaaggctaggaggtaggtttaggggttaattcgtagtacgagttagacgtaaggtacctaaccgaaaccccgagtaccgaccgttccggaccggacgggaccaccggaccgtaggaaacgtaacgttaaaaccgaacgtggtaacgaccgtacggacctaccgacgttactcgtttacc

SEQ ID NO: 422832 - DNA, 622 bp, Homo sapiens
  misc_feature: GZ8MTXP02GX3WD.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagacgcctccagcatactgatggatacaatattggattggacctgacagaacgccgagggcagtcctaccactaacctcctgtacttcgttaagtttcgggttactaagtccgggaccgttccggggtacccctgacgtaggttcaggtggactggtgatcgagtctaatagttatttaaccataagtaaaatcgacgagaagacggtagggacgtgtaggtagggttaagggtttaggggtttattacgtagactagtcgaacgtaacggtaactaaaccgaaaccccgtatacccgtaaccgttccgggaaccggtaacggggactaccggcgttacggaacgtaaacgtttaacgaaacgtggtacggactacgacctaccgtacgtcttacg

SEQ ID NO: 422833 - DNA, 635 bp, Homo sapiens
  misc_feature: GZ8MTXP02GTJRV.15.25.C03.1.454.CMB.2.raw
  modified_base (314)..(314): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagagcctccagcatactgatggatactaacttagtttggattggtacctgacagaacgccgaagggcagtcctaccactaacctctnacttcttagtttcgggtactaacggtccgggtcccgttccggggccccctagaccgtaggtcaggtcggacaggtgatcgaggtctaagtaagttactttaactacgtaagtaaaatcgaagacgaggtagtaggggaggcgtagggtagggttacgggtttagggtttaattacgtgacgtagtacgtacgtaacggtacctaaccgaaaccccgtactaccgtaaccgttcggggaccgtacgggacctaccggaccgtagggaactaaacgtaaacggtaacgtggtacggctacggtaccacgtacttcggtttacg

SEQ ID NO: 422834 - DNA, 641 bp, Homo sapiens
  misc_feature: GZ8MTXP02HB8G7.15.25.C03.1.454.CMB.2.raw
  modified_base (245)..(245): a, c, t, g, unknown or other
  modified_base (257)..(257): a, c, t, g, unknown or other
  modified_base (452)..(452): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactcctccctgcccgtcacccctggagacgccggcctcatcctcctgcaggtctagtcagacgcctccagcatacngatgatacactnttgattggtacctgcagacgcgaggcagtccaccacaactcctagtattcgtttagtttcggttactaacggtcccggggtcccgttccggggtccccctaggaccgtacgggttcaaggttggacctaggggtcgtaagtccgaagggtactaaagttagttaacttttaaccagttaaagaaaactcgaacgngtaaggtaggtagggacggtacgtagggtaacggttacgggtttaggggtttaattacgtgtactagttacgacgtaacgtacctaaacccgaaacccgtgtacccgtaccggtcggaccggtacggacgaccgtcgaaggtacgtaaacgtaacgtacgtgtacgctacgacctacctagtcgttacg

SEQ ID NO: 422835 - DNA, 655 bp, Homo sapiens
  misc_feature: GZ8MTXP02FR9NQ.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcaccctggagagccggcctccatctcctgcaggtctagtcagacgcctccagcatactgatggatacaacttattggattggtacctgacagaagccgagggcagtctccaacaactcctgattcttagtttgggttactaagtcgggtccgtccggggtcccctgacgtaggttcagtcggctggtgatcgagctaatagtatttacacttagaaatcagcgaagagtagggaggtcgtaggacggggttacggtttagggggtttaacttaacgtggtactaagttaggaacgtaaacgggttacctaaaacccgtaaaaccccgtagtaaccccgtaaccggtttcccggggaaccggtacggggaaacctaccgggtacccgtaaggggtaaacggttaaaacgttaaaaccggaacgttaagggttaacggccgttacggaccgtaacctacgtttacgtttccg

SEQ ID NO: 422836 - DNA, 698 bp, Homo sapiens
  misc_feature: GZ8MTXP02HQ5HJ.15.25.C03.1.454.CMB.2.raw
  modified_base (467)..(467): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtccacccctggagacgccggcctccactcctcctgcaggtctagtcagacgcctccagcatactgatggatacacttagttgattcgtacctgacaagaacgccgagggctacgtcctacccaactaaccgtcctagtaactttcgtttaacgttttcgggttactaacggtcccggggtcccgttcccggggttccccctagtacgtacggtttcgaggttcggcgtaggtgggaactcgaggtacaagttagttaacttttaacaacttaaagtaaaacncgaagtacgaaggtaggtaggaggtcggtagggttaacgggtttacggttttagggtttaacgttacgtagtacgtagtacgaaccggttaacgtaaccgtaaacccgtaaacccgacgtacccgtaccggtaccgggaccggaacgggaccgacggtacgtaacggtaaacgtaaaccgtaaacgtacggtaacggtacggtacgtacgacctaccgtacgttacgttcg

SEQ ID NO: 422837 - DNA, 586 bp, Homo sapiens
  misc_feature: GZ8MTXP02JAYEM.15.25.C03.1.454.CMB.2.raw
  modified_base (262)..(262): a, c, t, g, unknown or other
  modified_base (375)..(375): a, c, t, g, unknown or other
  modified_base (414)..(414): a, c, t, g, unknown or other
  modified_base (489)..(489): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctcgcccgtcacccctggacgacgccggcctccatcctcctgcaggtctagtcagagccctcagcatactgatggatacaacttnttaggattggacctgacgagaagccgagggcagtcctaccaacaactcctagtattcgttagtttcggtactacgtccgggccgttccggggtccctgacgtcgtcaggtgcnggtgatcgagctagtatattacgatagaaatcagcaggngtaggacgagtaggagggttacggtttggtttactacgtgactagtagacgtacggtacctaaccgaaacccgtntaccgtaccggtacggaccggtaggacctacggtaccgtaggtacgtaaaacgttaaccgagttcggacgtacgaccgactaaccgttacttactcg

SEQ ID NO: 422838 - DNA, 617 bp, Homo sapiens
  misc_feature: GZ8MTXP02FQLCD.15.25.C03.1.454.CMB.2.raw
  modified_base (257)..(257): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactnttggattggacctgacagaagccagggcagtctccacaactctgatctagttgggttctaagtccgggcctccggggtcccctgacgtaggttcaggtggctggtgatcgagcaatagtatttacactagaaatcagacgtagagtggagtcgtaggagggttacggtttaggggtttaacttacgtgtacgtagtagtaaccgtaaacggtacctaaaacccgtaaacccgtagttacccgtacccgttacgggacccggtaacggggaaccaccggtacccgtaggggtaaacgtaaaacgttaaaaccgaaacggttcggttcggacgttacggaccaaccgtacgttcgtttaccg

SEQ ID NO: 422839 - DNA, 556 bp, Homo sapiens
  misc_feature: GZ8MTXP02GGI91.15.25.C03.1.454.CMB.2.raw
  modified_base (300)..(300): a, c, t, g, unknown or other
  modified_base (331)..(331): a, c, t, g, unknown or other
  modified_base (344)..(344): a, c, t, g, unknown or other
  modified_base (349)..(349): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagacgcctcagcatactgatgatacaacttagttgattggtacctgcagacgcgaggcagtctccacactctnatctagttgtactagtcggccgtcggtcccngactgtcagtgcngtgangagcatagtatttacagtagaaatcgagacgagtacgtggaggtcgtagggtaggttacgggtttagggttaattacgtgtacagttacgacgtaacgtacctaaaccgtaaccgtactaccgtaccgtacgggaccgtacggacaccggtagtacggaaactacgtaaaacgtgtaacggtcgacgtcgacctacgtctcgttacg

SEQ ID NO: 422840 - DNA, 738 bp, Homo sapiens
  misc_feature: GZ8MTXP02F1XV8.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtccacccctggagacgccggcctccatctcctgcaggtctagtcagacgcctccagcatactgatggatacaacttattggattggtacctgacagaacgccgagggcagtcctaccaacaacctcctagtactttcgttaagtttcggggtttacctaacggtcccggggtccccgttcccgggggtccccctaggtaaccgtagggtttaccgaggtcggacgtagggtaggacgtacgacgggactaagttagttaacttttaacaacgttaaagaaaactcgaagtacgaaggtaggtagggagggtcgtaggggtaacgggtttacggggttttaggggtttaattacggttagtaccgttaaggtacggtaaccgtaaacgggttaccctaaaacccgtaaaacccccggtattaaccccgttaacccggttacccggggaaccggggtaaaccggggaacccgacccggtaccggtaagggtaaacgtaaaaccgttaaaacggtaacgtcgggtacgacgtacgacctacgtacttaccggtttcg

SEQ ID NO: 422841 - DNA, 636 bp, Homo sapiens
  misc_feature: GZ8MTXP02J36Z0.15.25.C03.1.454.CMB.2.raw
  modified_base (283)..(283): a, c, t, g, unknown or other
  modified_base (306)..(306): a, c, t, g, unknown or other
  modified_base (358)..(358): a, c, t, g, unknown or other
  modified_base (372)..(373): a, c, t, g, unknown or other
  modified_base (413)..(413): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctggtctctggatccaggtgggatatgtgatgactcagtcctccactccgtccctgccccgtcacccctggagacgcccggcctccactcctcctgacgtaggtctagtcagaccgcctcagtcatacagatgtactactatagttgattcggtaccngacagtacgccgaggctacgtcncaacgactcagtctacgttagtttggtacagtcccggccgtaccgggtcccngactgtcagtcggnngtgatcggatacattataacttacagtagaaatcgagtanagggtagtccggagtaggtaggtacggttagggtttaggtttaacctcgtcgtacgtacgtaccgtaaccgtaacccgtaaccctaaaccccgtaacccgtcgtaacccggtaacccgggtaccggaaccgggacgtaccgtacgtacgtaaacgtaaaccgttaaacgttacgtacgtcggtaccgtacctaccgtaccgtaccgttaccgttacgtttccg

SEQ ID NO: 422842 - DNA, 672 bp, Homo sapiens
  misc_feature: GZ8MTXP02G5L3X.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagacgcctccagcatactgatggatactaactagttggtattcggtacctgacagagccgagggcacgtcctaccaacaacctcctagattcgttagtttcggttactaacgtccggggtcccgtcccggggtccccctaggtacctaggttcaggtcggctagggtcgactacgaggtctaagttaagttaacttttaacaacgttaaagtaaaacgtacgaaggacgtaagtagggtagggaacggtacgtagggtaagggttacgggttttacgggggttttaattaacgttgacgtaggtacgtaaacgtaacggtaacccgtaaacccgtaaacccggtactacccgtaccgtaccgggaccggaacgggaccgaccggaccgttaaggacgtaaacgtaaccgtaagtcggtagacgtacgactactacttcgtttacg

SEQ ID NO: 422843 - DNA, 623 bp, Homo sapiens
  misc_feature: GZ8MTXP02JFFRD.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgccctcacccctggagacgccggcctccatcctcctgcaggtctagtcagagcctccagcatactgatggatacaacttattggattcggtacctgacagaacgccgaggcagtctccactactctagtatctagtttcggtactagtccggccgtccgggtcccctgacgtcgttcagtggctaggtgactcgaggactagtagtaactttaacacgtaagtaaaactcgaacgacgtaaggtaggtaggggtaacggtcgtaggggtacgggtttaccgggttttaggggttttacgttaacggttgacgttagtacgaacgtaacggtacctaacccgaaaccgtactaccgtaccgtcggaccgtacgggacctacggacgtaggtacgtaaacgtaaaccgtagtcggtacggtactacgactacctactcgtttaccg

SEQ ID NO: 422844 - DNA, 579 bp, Homo sapiens
  misc_feature: GZ8MTXP02JKS3S.15.25.C03.1.454.CMB.2.raw
  modified_base (216)..(216): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcccgnaggtctagtcagagcctccagcatactgatggatacaactatttggattggacctgcagaagccaggcagtctccacactcctgatctatttgggtctagtccgggcctccggggtcctgactaggtcagtgcagtgatcaagctatagtatttacactagaaaatcagcagagtggagcgtagaggtacgttagggttattacgtgctagtcggactaacggtactaaccgaaaccccgtataccgtaccgttcgggaccggtaacgggaccgaccggaccggtagggaaacggtaacgttaaaaccggaagttcggtaacggaccgttacggacctaaccgtactccgttacggtttaccc

SEQ ID NO: 422845 - DNA, 647 bp, Homo sapiens
  misc_feature: GZ8MTXP02GPLDD.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacacttattgattgtacctgacagaagccagggcagtctccaactaactcctagactcttagtttgggttactaacgtccggggtccctcggggtcccctggaccgtaggttcgaggttcggctagggtgtatccgaggactaagttagtactttaacagttaagaaaatcgagtacagtaggtaggagtcgtaggtaggtacgggtttagggtttacttacgttgactagttacggacgttaaacggtaccgttaaccgaaaacccccgtctaccgtaacccggtttccggggaacccgggaacgggtaaccgacccgggtaacccgtagggtaaaacgttaaaccggtaaaaccgtacgtaaggttcggactcggtcaaaccgtcttcgtttacg

SEQ ID NO: 422846 - DNA, 687 bp, Homo sapiens
  misc_feature: GZ8MTXP02GP2TC.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagacgccggcctccatcctcctgcaggtctagtcagacgcctccagcatactgatggatactaattagttggattcggtacctgacaagaacgcgaggctacgtcctaccaacaactcctagacttcgttagtttgggttactaacggtccggggtacccgtccccggggtacccctaggtaaccgtacgggtttcgagggttcggtaccgtagggttacgggacttcgaacgggtacctaaagtttaacggttaacttttaaacaacgttaaggtaaaactcgaagtacgaaggtaggtacgggaggtacgtaggggtaagggtttacgggtttaggggtttaacttacgtggtactagtacgacgtaaacggtacctaaacccgaacccgtactaccgtacccggttaccgggaccggtaaggaccacggtacgtacggaaacgtaaacgttaaacgaacgtcggtacgtacgtacgaccactacgttcg

SEQ ID NO: 422847 - DNA, 692 bp, Homo sapiens
  misc_feature: GZ8MTXP02G8TQY.15.25.C03.1.454.CMB.2.raw
  modified_base (595)..(595): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctcgcccgtccacccgtggacgacgccggcctccatcctcctgcaggtctagtcagacgcctccagcatactgatggaacttacaacttattggtattcggtactgacagtacggccgagggctacgtccaccaactactctagtattaccgttaggtttacgggttactaacggtcccggggtccccggttccggggtacccctaggtaccgtaggttcgaggtcggactggtcgggtaatcggaggtactaagttaagttacttttaacgaacgttaaacgaaagtcgaaggacgtaagggacggtaggggtacggtacggtacgggtaacgggtttaacgggtttggggtttaaattccggtaggacgtagttacggaccgtaaacggtaccttaaaaccccgaaccgttaccnccgtaccggtaccggaccgggacgtacgtaccggagtacggtaaacgaaacgtaacgtagtcggacggacttacggactaccgtacggttcttacgg

SEQ ID NO: 422848 - DNA, 689 bp, Homo sapiens
  misc_feature: GZ8MTXP02H4ZWL.15.25.C03.1.454.CMB.2.raw
  modified_base (273)..(273): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccaggtggggatattgtgatgactcagtctccactctccctgcccgtcaccctggagacgccggcctccatctcctgcaggtctagtcagacgcctcagcatactgatggatacaatatttggattcggtaccngacagaagccgagggctagtcctaccacaactcctagtacttcgttagtttcgggttactaacgtccggggtcctccgggggtccccctaggtacgtacggttcaggtcggctaggtggaatccgaggtactaacgtagttaatttaaccaacgtagtaaaactcgaaaggacgtaaggtaagggtggggtaacggtacgttaggggtaacgggttacgggttttagggggttttaacttacggtgtacgtagtacggtaacgtaaacggttacctaaacccgtaacccgtacgtaccgtacccggttaccgggaccgggaaacgggtaccgacggtacccggtaagggtaaacgtaaaacgttaaaccgaacgttcggtacggtaacgtcggtaccctacgtacgtttacgtccg

SEQ ID NO: 422849 - DNA, 640 bp, Homo sapiens
  misc_feature: GZ8MTXP02I73JW.15.25.C03.1.454.CMB.2.raw
  modified_base (369)..(369): a, c, t, g, unknown or other
tcagtctacgtagccacgaccggtgctcgatttagtagtgtagatttgggtttgggggatcaggactcctcagttcaccttctcacaatgaggctccctgctcagctctggggctgctaatgctctgggtctctggatccagtggggatattgtgatgactcagtctccactctccctgcccgtcacccctggagacgccggcctcatctcctgcaggtctagtcagacgcctccagcatactgatggatacaacttattggattggtacctgacagaacgccgagggcagtcctaccaacaactctgtatcttagtttgggttctaacgtccgggccgtccggggtcccctgacgtgttcagtcggcnggtgactcgagctaatagttatttaacacttaagaaatcagacgaggtaggtaggacggtgtaggtagggttaggtttaggggtttaattacgtgacgtaagtcgtaacgaacggttaacaaacccgtaaaacccgtacgtacctaacccggttacgggacccggaacggggaactaccgggaaccgttagggaaaacgtaaacgttaaaaccggtaaaccggttgggtaacggtcggttaccgaccgtaaaccgtacttcggtttacccg

SEQ ID NO: 422850 - DNA, 555 bp, Homo sapiens
  misc_feature: GZ8MTXP02IX6FS.15.25.C03.1.454.CMB.2.raw
  modified_base (255)..(255): a, c, t, g, unknown or other
  modified_base (270)..(270): a, c, t, g, unknown or other
  modified_base (346)..(346): a, c, t, g, unknown or other
  modified_base (383)..(383): a, c, t, g, unknown or other
  modified_base (469)..(469): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacatnttgatgactgcaganccaggcagtctcacactctgatcttagtttggttactaagtccggcctccggggtcccctgactggttcagtggcnggtgatcgagctagtagtatttacactagaaatcagnagagtggagtcgtaggagggttacggtttaggggtttattacgtgtacgtagtcgacgtaacggtacctaaccgaaaacccccgtntaccgtaccgtacggaccggacggaccgacggtacgtacggaacgtaaacgtaaacgtacgtggtcgctacgacctactactctcg

SEQ ID NO: 422851 - DNA, 639 bp, Homo sapiens
  misc_feature: GZ8MTXP02IIE9A.15.25.C03.1.454.CMB.2.raw
  modified_base (289)..(289): a, c, t, g, unknown or other
  modified_base (358)..(358): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactctccctgcccgtccaccctggagacgccggcctccatcctctgcaggtctagtcagagcctcagcatactgatggatactaactagttgattggacctgacagagcgaggcagtccncacactctagattcgtagtttcggtactacgtccggccgtccggtccctgacgtggttcaggtcggacnggtacgatcgagctaagtagttacttacgaagtaacgaaaatcgaagtacgaaggtagtagggaacggtcgtagggtaacgggttacggttttaggggtttaacttacggttagacgtaagttcggtaaaccgtaaacggttaacctaaacccgaacccggtaactacccgtaccgtacccggtaccgaacgggtaccgaccgtaccgttaaggaacgtaaaacgttaaacggacgtaacggtacggacccgttgaaccccgtacgtaacgtttcgttacg

SEQ ID NO: 422852 - DNA, 674 bp, Homo sapiens
  misc_feature: GZ8MTXP02HGREU.15.25.C03.1.454.CMB.2.raw
  modified_base (563)..(563): a, c, t, g, unknown or other
  modified_base (597)..(597): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccgaggtggggattattgtgatgactcagtctccactcctccctgcccgtcacccgtggacgacggcccggcctccattcctcctgcaggtctagtcagacgccctccagcatactgatagataactaattgttaggattcggacctgacaagacgccgaggcagtcctaccacaactctagtacttacgtttagtttcggtactaacggtcccggggtcccgttcccggggtcccctaggtacgtacggtttacgaggttcggacgtaggttggactaccgaggtactagttaaacgttactttaaacgactaaagtaaactcgaagtacgaggtagtagggacgtggtaggtaagggttacgggttttagggtttatcgtagacgtagacgtaactaaccggtactaaacccgaaacccgtntacccgtaccggtaccgggaccgaacgggtaccnccggtacggtaacggtaaagttaacgtaaaccgggtactcggggtcgtactacggacctactaacggtttcgttccg

SEQ ID NO: 422853 - DNA, 723 bp, Homo sapiens
  misc_feature: GZ8MTXP02JXHRW.15.25.C03.1.454.CMB.2.raw
  modified_base (301)..(301): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccgatggggatattgtgatgactcagtctccactctccctcgcccgtcaccccgtggacgacgcccggcctccatctcctgcaggtctagtcagacgcctcagctatactgatggatacaacttattggattggacctgacaggaagccgaggcacgtccnccactaactctgattcgttagtttagggttcgtaacgtcccggggtcccgttaccccgggggtccctaggaccggtaggtaggcccgttggggccgtagggtcttaagggccgtaagtaggactttaacgtaaactttaacgtaaaactaacgtaaacgtacgaacgagtaggaagggtacgggtagggtacgggtaagggttacgggggttttaaagggtttaccgggttttaggaaaaaccgttggtacggttaacgttcgaccgttaaaccggtaacccgtaaacccgtaaccccggtaaacccgttaacccggtacccggttaaccggggtaacccgggacgggcccggaacggtcggaaacgtacggaaaacgttaacggtaacgtacggtgtacgtaccgactacgttcgaaaccg

SEQ ID NO: 422854 - DNA, 554 bp, Homo sapiens
  misc_feature: GZ8MTXP02FL0IC.15.25.C03.1.454.CMB.2.raw
  modified_base (355)..(355): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcaccctggagagccggcctccatctcctgcaggtctagtcagagcctccagcatactgatggatacaactatttggattggtacctgcagaagccagggcagtctccacaactcctgatctatttggttctaagtcgggcctccggggtcccctgacaggttcagtggcngtggatcagcatagtattttacactagaaaatcagcagagtggaggcgtagagggtacggtttggggtttattactgcatgacgaacggtactaaaccgaaaccccgatacctaccgttccgggacccggagggaccaccgccgtaggaacgtaaacttaaacggaaacgtggtcggctcggaccaccgtactcttacg

SEQ ID NO: 422855 - DNA, 680 bp, Homo sapiens
  misc_feature: GZ8MTXP02GGVEG.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagacgccggcctccatcctcctgcaggtctagtcagacgcctccagcatactgatggatacaacttattggattcggtacctgacagaagccgagggcagtctaccactaactcctagtactcttaagtttggggttactaaagtccggggtcccgtccggggtcccctagaccgtaggttcaggtcggctagggtggactcgaggctaagtacgtaattttaacgaactaagtaaaactcgaagacgaaggagggtagggaaggtcgtagggtaaggggttaacgggttttagggggtttaaacttacggtacgtacgtaagttacggaaccgtaaacgggttaccctaaacccgtaaaaccccggtactacccgtacccggttaccgggaccggaacggggaccaccggtaccgttagggaaacgtaaacgttaaacgtaacgtaacggttacggacctacggactaccgactttccgtttacg

SEQ ID NO: 422856 - DNA, 611 bp, Homo sapiens
  misc_feature: GZ8MTXP02JUZ5Q.15.25.C03.1.454.CMB.2.raw
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccagcctccatctcctgcaggtctagtcagacgcctccagcatactgatggatacaacttattggattggtacctgacagaacgccgaggcagtctccacactctgatcttatttggtctaagtccgggtccgtcccccggggtcctgaccgtaggttcaggtggctaggtgatcgagctatagtatttacactagaaaatcagcaggaggtagggaggtcgtagggtaggggttacggttttagggggtttacttacgtgtacgtagtacgtacgtaaacgggtacctaaacccgaaaccccgtactacccgtacccggttaccgggaccgggaacgggacccgaccggtaccgtacgggaacgtaaccgttaaaacgaacgtcggtacggctacggaccacctacgttccg

SEQ ID NO: 422857 - DNA, 635 bp, Homo sapiens
  misc_feature: GZ8MTXP02J13PF.15.25.C03.1.454.CMB.2.raw
  modified_base (215)..(215): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactcctccctgcccgtcaccctggagagcccggcctccatctccngcaggtctagtcagacgccctcagcatactgatggatacaacttattggattcggtacctgacaagaacgccagggcagtcctaccaactacctcctgtacttcttagttttcgggtactaacggtccggggtccgtccggggtccccctgtacgtaggttcaggtggcaggtggatcgagctaagttagtactttacaacgtagtaaaactcgaagtacgaggtaggtagggacggtagtagggtagggttacgggtttaggggtttactacgtgactagttagactaacggtacctaaaccaaacccgtactaccgtaccgttcgggaccggtacgggaaccgaccggaccggtacggaacgtaaacgtaaaccggtaaagtcggttacgacgtacgtaccgaactacgttcgttacg

SEQ ID NO: 422858 - DNA, 664 bp, Homo sapiens
  misc_feature: GZ8MTXP02FYK4G.15.25.C03.1.454.CMB.2.raw
  modified_base (369)..(369): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctggtctctggatccagtgggatattgtgatgactcagtctccactctcctgcccgtcacccctggagacgccggcctccatctcctgcaggtctagtcagagcctccagcatactgatggatacaacttattggattggacctgacagaagccgagggcagtctccaacactcctgtatcttagtttgggttactaagtccgggtccttccggggtcccctagaccgtaggttcaggtcggcngggtcgatacgaggtaccaagttaacgttatttaacaactaagaaaactcgaagacgtaagaggtggaggtactaggaagggttacggtttaggggtttatacgttgacgtagtagtaccgtaagggtaacctaacccgaaaaccccgtagttaccgtaacccggtaccgggtaccgggaacgggtaacccgtaccggtaccggtaaacgggtaacgttaaaaccggttaaaaccggtaaacgtcgggttacgggtacctaacgtaccgtaaacccggtacttaccgtttaccgg

SEQ ID NO: 422859 - DNA, 650 bp, Homo sapiens
  misc_feature: GZ8MTXP02F48Y4.15.25.C03.1.454.CMB.2.raw
  modified_base (194)..(194): a, c, t, g, unknown or other
tcagtctacgtagccacgaccggtgctcgatttagtagtgtagatttgggtttgggggatcaggactcctcagttcaccttctcacaatgaggctccctgctcagctcctggggctgctaatgctctgggtctctggatccagtgggatattgtgatgactcagtctccactctccctgcccgtcaccctggancgccgcctcatctcctgcaggtctagtcagacgcctacagcaatactgatggaatacaacttattggtaattcggtacctgaccaagaacgccgtagggcaagtcctaccaactaacctctgtattacgttgtttacgggtactaacgccgggtacccgttccggggtacccctagacgtaggttcgaggtggactaggtggaactcggaacgggtactaaagtttaaacggttaacttttaaccaaactttaaggaaaaattcgaaggacgtaaagagggtagggaggtagtagggtaaggttacgggtttaggggtttaattacgtgtacctaaggtagaccgtaaaggttacccaaacgaaaccccgtgtacccgtacgtcggaccgagggacctcggacgtacggaaagtaaacgtaacacgtgtacgacgtacacctaacgtctactttcg

SEQ ID NO: 422860 - DNA, 641 bp, Homo sapiens
  misc_feature: GZ8MTXP02JH6RC.15.25.C03.1.454.CMB.2.raw
  modified_base (247)..(247): a, c, t, g, unknown or other
  modified_base (288)..(288): a, c, t, g, unknown or other
  modified_base (365)..(365): a, c, t, g, unknown or other
  modified_base (419)..(419): a, c, t, g, unknown or other
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtcacccctggagacgcccggcctccatcctcctgcgagtctagtcagacgcctccagcatcngatgatacatgttgattggactgcagaagccaggcacgtcncacaactctagtacttcgtgtttacgggtactacggtccggtcccgtcccggggtcctgactaggttcaggttgcgnggtaggcgtacgagtctaagttacgtactttaacaacgttagaactagacgtanagggtaggtacgggtagacggtagggtaacggggttagggttttaggggttaattccgtagtcgtaacgtacgacgtaacggtacctaaaccggtaaacccctacgtcccgtaaccggttccgggaaccgggtacggggaaccctacggttaaccggacgggaaacttaacggtaaacggtaaccgtaggtacggtacgtccgacgttaacctacggtttcc

SEQ ID NO: 422861 - DNA, 681 bp, Homo sapiens
  misc_feature: GZ8MTXP02H3ILS.15.25.C03.1.454.CMB.2.raw
tcagtctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtatccactctccctgcccgtccaccctggagacgccggcctccatctcctgcaggtctagtcagacgcctcagcatactgatggatacaacttattggattggacctgacagaacgccgaggctagtctaccaactaactcctgtattcgtttagtttgggtacctaaggtccggggtcccttccccggggtccctgacgtacggttcaggttcgcgtaggtggactacgaggtacaaattagttactttaacaacgttagaaacttcgaagtacgaaggtaggtagggacggtgtaaggggtagggttaacggttttggggtttaatttacgaggtacgtagtagaaccgtaaacggttaccctaaaccgtaaccccgtacgttacccgtaacccggttccgggaacccggtaacggggaaccctaaccgggtaccgtaggggtaaaacgtaaaacggtttaaaacggaacgtttcgggaacggtaccgtacggaacccgtacctaacgttccg
